United States Patent 12,371,699 (NUCLEIC ACIDS ENCODING CRISPR-ASSOCIATED PROTEINS AND USES THEREOF) - sequence listing, part 8

SEQ ID NO: 5915 - RNA, 3646 nt, synthetic construct
  misc_feature 1..3646: note = Cas9 variant mRNA product
  source 1..3646: mol_type = other RNA
ggggcgctgcctacggaggtggcagccatctccttctcggcatcaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5916 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5917 - RNA, 3730 nt, synthetic construct
  misc_feature 1..3730: note = Cas9 variant mRNA product
  source 1..3730: mol_type = other RNA
ggggcgctgcctacggaggtggcagccatctccttctcggcatcaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5918 - RNA, 3430 nt, synthetic construct
  misc_feature 1..3430: note = Cas9 variant mRNA product
  source 1..3430: mol_type = other RNA
ggggcgctgcctacggaggtggcagccatctccttctcggcatcaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5919 - RNA, 3841 nt, synthetic construct
  misc_feature 1..3841: note = Cas9 variant mRNA product
  source 1..3841: mol_type = other RNA
ggggcgctgcctacggaggtggcagccatctccttctcggcatcaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5920 - RNA, 4399 nt, synthetic construct
  misc_feature 1..4399: note = Cpf1 variant mRNA product
  source 1..4399: mol_type = other RNA
ggggcgctgcctacggaggtggcagccatctccttctcggcatcaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5921 - RNA, 4378 nt, synthetic construct
  misc_feature 1..4378: note = Cpf1 variant mRNA product
  source 1..4378: mol_type = other RNA
ggggcgctgcctacggaggtggcagccatctccttctcggcatcaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5922 - RNA, 4484 nt, synthetic construct
  misc_feature 1..4484: note = Cas9 variant mRNA product
  source 1..4484: mol_type = other RNA
gggagagtcccgcagtcggcgtccagcggctctgcttgttcgtgtgtgtgtcgttgcaggccttattcaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5923 - RNA, 5267 nt, synthetic construct
  misc_feature 1..5267: note = Cas9 variant mRNA product
  source 1..5267: mol_type = other RNA
gggagagtcccgcagtcggcgtccagcggctctgcttgttcgtgtgtgtgtcgttgcaggccttattcaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5924 - RNA, 3539 nt, synthetic construct
  misc_feature 1..3539: note = Cas9 variant mRNA product
  source 1..3539: mol_type = other RNA
gggagagtcccgcagtcggcgtccagcggctctgcttgttcgtgtgtgtgtcgttgcaggccttattcaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5925 - RNA, 4607 nt, synthetic construct
  misc_feature 1..4607: note = Cas9 variant mRNA product
  source 1..4607: mol_type = other RNA
gggagagtcccgcagtcggcgtccagcggctctgcttgttcgtgtgtgtgtcgttgcaggccttattcaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5926 - RNA, 3683 nt, synthetic construct
  misc_feature 1..3683: note = Cas9 variant mRNA product
  source 1..3683: mol_type = other RNA
gggagagtcccgcagtcggcgtccagcggctctgcttgttcgtgtgtgtgtcgttgcaggccttattcaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5927 - RNA, 4544 nt, synthetic construct
  misc_feature 1..4544: note = Cas9 variant mRNA product
  source 1..4544: mol_type = other RNA
gggagagtcccgcagtcggcgtccagcggctctgcttgttcgtgtgtgtgtcgttgcaggccttattcaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5928 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5929 - RNA, 4382 nt, synthetic construct
  misc_feature 1..4382: note = Cas9 variant mRNA product
  source 1..4382: mol_type = other RNA
gggagagtcccgcagtcggcgtccagcggctctgcttgttcgtgtgtgtgtcgttgcaggccttattcaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5930 - RNA, 4415 nt, synthetic construct
  misc_feature 1..4415: note = Cas9 variant mRNA product
  source 1..4415: mol_type = other RNA
gggagagtcccgcagtcggcgtccagcggctctgcttgttcgtgtgtgtgtcgttgcaggccttattcaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5931 - RNA, 3548 nt, synthetic construct
  misc_feature 1..3548: note = Cas9 variant mRNA product
  source 1..3548: mol_type = other RNA
gggagagtcccgcagtcggcgtccagcggctctgcttgttcgtgtgtgtgtcgttgcaggccttattcaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5932 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5933 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5934 - RNA, 3332 nt, synthetic construct
  misc_feature 1..3332: note = Cas9 variant mRNA product
  source 1..3332: mol_type = other RNA
gggagagtcccgcagtcggcgtccagcggctctgcttgttcgtgtgtgtgtcgttgcaggccttattcaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5935 - RNA, 3743 nt, synthetic construct
  misc_feature 1..3743: note = Cas9 variant mRNA product
  source 1..3743: mol_type = other RNA
gggagagtcccgcagtcggcgtccagcggctctgcttgttcgtgtgtgtgtcgttgcaggccttattcaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5936 - RNA, 4301 nt, synthetic construct
  misc_feature 1..4301: note = Cpf1 variant mRNA product
  source 1..4301: mol_type = other RNA
gggagagtcccgcagtcggcgtccagcggctctgcttgttcgtgtgtgtgtcgttgcaggccttattcaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5937 - RNA, 4280 nt, synthetic construct
  misc_feature 1..4280: note = Cpf1 variant mRNA product
  source 1..4280: mol_type = other RNA
gggagagtcccgcagtcggcgtccagcggctctgcttgttcgtgtgtgtgtcgttgcaggccttattcaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5938 - RNA, 4581 nt, synthetic construct
  misc_feature 1..4581: note = Cas9 variant mRNA product
  source 1..4581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5939 - RNA, 5364 nt, synthetic construct
  misc_feature 1..5364: note = Cas9 variant mRNA product
  source 1..5364: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5940 - RNA, 3636 nt, synthetic construct
  misc_feature 1..3636: note = Cas9 variant mRNA product
  source 1..3636: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5941 - RNA, 4704 nt, synthetic construct
  misc_feature 1..4704: note = Cas9 variant mRNA product
  source 1..4704: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5942 - RNA, 3780 nt, synthetic construct
  misc_feature 1..3780: note = Cas9 variant mRNA product
  source 1..3780: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5943 - RNA, 4641 nt, synthetic construct
  misc_feature 1..4641: note = Cas9 variant mRNA product
  source 1..4641: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5944 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5945 - RNA, 4479 nt, synthetic construct
  misc_feature 1..4479: note = Cas9 variant mRNA product
  source 1..4479: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5946 - RNA, 4512 nt, synthetic construct
  misc_feature 1..4512: note = Cas9 variant mRNA product
  source 1..4512: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5947 - RNA, 3645 nt, synthetic construct
  misc_feature 1..3645: note = Cas9 variant mRNA product
  source 1..3645: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5948 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5949 - RNA, 3729 nt, synthetic construct
  misc_feature 1..3729: note = Cas9 variant mRNA product
  source 1..3729: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5950 - RNA, 3429 nt, synthetic construct
  misc_feature 1..3429: note = Cas9 variant mRNA product
  source 1..3429: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5951 - RNA, 3840 nt, synthetic construct
  misc_feature 1..3840: note = Cas9 variant mRNA product
  source 1..3840: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5952 - RNA, 4398 nt, synthetic construct
  misc_feature 1..4398: note = Cpf1 variant mRNA product
  source 1..4398: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5953 - RNA, 4377 nt, synthetic construct
  misc_feature 1..4377: note = Cpf1 variant mRNA product
  source 1..4377: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5954 - RNA, 4517 nt, synthetic construct
  misc_feature 1..4517: note = Cas9 variant mRNA product
  source 1..4517: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5955 - RNA, 5300 nt, synthetic construct
  misc_feature 1..5300: note = Cas9 variant mRNA product
  source 1..5300: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5956 - RNA, 3572 nt, synthetic construct
  misc_feature 1..3572: note = Cas9 variant mRNA product
  source 1..3572: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5957 - RNA, 4640 nt, synthetic construct
  misc_feature 1..4640: note = Cas9 variant mRNA product
  source 1..4640: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5958 - RNA, 3716 nt, synthetic construct
  misc_feature 1..3716: note = Cas9 variant mRNA product
  source 1..3716: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5959 - RNA, 4577 nt, synthetic construct
  misc_feature 1..4577: note = Cas9 variant mRNA product
  source 1..4577: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5960 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5961 - RNA, 4415 nt, synthetic construct
  misc_feature 1..4415: note = Cas9 variant mRNA product
  source 1..4415: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5962 - RNA, 4448 nt, synthetic construct
  misc_feature 1..4448: note = Cas9 variant mRNA product
  source 1..4448: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5963 - RNA, 3581 nt, synthetic construct
  misc_feature 1..3581: note = Cas9 variant mRNA product
  source 1..3581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5964 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5965 - RNA, 3665 nt, synthetic construct
  misc_feature 1..3665: note = Cas9 variant mRNA product
  source 1..3665: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5966 - RNA, 3365 nt, synthetic construct
  misc_feature 1..3365: note = Cas9 variant mRNA product
  source 1..3365: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5967 - RNA, 3776 nt, synthetic construct
  misc_feature 1..3776: note = Cas9 variant mRNA product
  source 1..3776: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5968 - RNA, 4334 nt, synthetic construct
  misc_feature 1..4334: note = Cpf1 variant mRNA product
  source 1..4334: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5969 - RNA, 4313 nt, synthetic construct
  misc_feature 1..4313: note = Cpf1 variant mRNA product
  source 1..4313: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5970 - RNA, 4466 nt, synthetic construct
  misc_feature 1..4466: note = Cas9 variant mRNA product
  source 1..4466: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5971 - RNA, 5249 nt, synthetic construct
  misc_feature 1..5249: note = Cas9 variant mRNA product
  source 1..5249: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5972 - RNA, 3521 nt, synthetic construct
  misc_feature 1..3521: note = Cas9 variant mRNA product
  source 1..3521: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5973 - RNA, 4589 nt, synthetic construct
  misc_feature 1..4589: note = Cas9 variant mRNA product
  source 1..4589: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5974 - RNA, 3665 nt, synthetic construct
  misc_feature 1..3665: note = Cas9 variant mRNA product
  source 1..3665: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5975 - RNA, 4526 nt, synthetic construct
  misc_feature 1..4526: note = Cas9 variant mRNA product
  source 1..4526: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5976 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5977 - RNA, 4364 nt, synthetic construct
  misc_feature 1..4364: note = Cas9 variant mRNA product
  source 1..4364: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5978 - RNA, 4397 nt, synthetic construct
  misc_feature 1..4397: note = Cas9 variant mRNA product
  source 1..4397: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5979 - RNA, 3530 nt, synthetic construct
  misc_feature 1..3530: note = Cas9 variant mRNA product
  source 1..3530: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5980 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5981 - RNA, 3614 nt, synthetic construct
  misc_feature 1..3614: note = Cas9 variant mRNA product
  source 1..3614: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5982 - RNA, 3314 nt, synthetic construct
  misc_feature 1..3314: note = Cas9 variant mRNA product
  source 1..3314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5983 - RNA, 3725 nt, synthetic construct
  misc_feature 1..3725: note = Cas9 variant mRNA product
  source 1..3725: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5984 - RNA, 4283 nt, synthetic construct
  misc_feature 1..4283: note = Cpf1 variant mRNA product
  source 1..4283: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5985 - RNA, 4262 nt, synthetic construct
  misc_feature 1..4262: note = Cpf1 variant mRNA product
  source 1..4262: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5986 - RNA, 4452 nt, synthetic construct
  misc_feature 1..4452: note = Cas9 variant mRNA product
  source 1..4452: mol_type = other RNA
gggagagtccgctcagccaggttgcagaagcggcttagcgtgtgtcctaatcttctctctgcgtgtaggtaggcctgtgccgcaaacaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5987 - RNA, 5235 nt, synthetic construct
  misc_feature 1..5235: note = Cas9 variant mRNA product
  source 1..5235: mol_type = other RNA
gggagagtccgctcagccaggttgcagaagcggcttagcgtgtgtcctaatcttctctctgcgtgtaggtaggcctgtgccgcaaacaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5988 - RNA, 3507 nt, synthetic construct
  misc_feature 1..3507: note = Cas9 variant mRNA product
  source 1..3507: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5989 - RNA, 4575 nt, synthetic construct
  misc_feature 1..4575: note = Cas9 variant mRNA product
  source 1..4575: mol_type = other RNA
gggagagtccgctcagccaggttgcagaagcggcttagcgtgtgtcctaatcttctctctgcgtgtaggtaggcctgtgccgcaaacaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5990 - RNA, 3651 nt, synthetic construct
  misc_feature 1..3651: note = Cas9 variant mRNA product
  source 1..3651: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5991 - RNA, 4512 nt, synthetic construct
  misc_feature 1..4512: note = Cas9 variant mRNA product
  source 1..4512: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5992 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5993 - RNA, 4350 nt, synthetic construct
  misc_feature 1..4350: note = Cas9 variant mRNA product
  source 1..4350: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5994 - RNA, 4383 nt, synthetic construct
  misc_feature 1..4383: note = Cas9 variant mRNA product
  source 1..4383: mol_type = other RNA
gggagagtccgctcagccaggttgcagaagcggcttagcgtgtgtcctaatcttctctctgcgtgtaggtaggcctgtgccgcaaacaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5995 - RNA, 3516 nt, synthetic construct
  misc_feature 1..3516: note = Cas9 variant mRNA product
  source 1..3516: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5996 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5997 - RNA, 3600 nt, synthetic construct
  misc_feature 1..3600: note = Cas9 variant mRNA product
  source 1..3600: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5998 - RNA, 3300 nt, synthetic construct
  misc_feature 1..3300: note = Cas9 variant mRNA product
  source 1..3300: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 5999 - RNA, 3711 nt, synthetic construct
  misc_feature 1..3711: note = Cas9 variant mRNA product
  source 1..3711: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6000 - RNA, 4269 nt, synthetic construct
  misc_feature 1..4269: note = Cpf1 variant mRNA product
  source 1..4269: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6001 - RNA, 4248 nt, synthetic construct
  misc_feature 1..4248: note = Cpf1 variant mRNA product
  source 1..4248: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6002 - RNA, 4433 nt, synthetic construct
  misc_feature 1..4433: note = Cas9 variant mRNA product
  source 1..4433: mol_type = other RNA
gggagagtcccgcagtcggcgtccagcggctctgcttgttcgtgtgtgtgtcgttgcaggccttattcaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6003 - RNA, 5216 nt, synthetic construct
  misc_feature 1..5216: note = Cas9 variant mRNA product
  source 1..5216: mol_type = other RNA
gggagagtcccgcagtcggcgtccagcggctctgcttgttcgtgtgtgtgtcgttgcaggccttattcaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6004 - RNA, 3488 nt, synthetic construct
  misc_feature 1..3488: note = Cas9 variant mRNA product
  source 1..3488: mol_type = other RNA
gggagagtcccgcagtcggcgtccagcggctctgcttgttcgtgtgtgtgtcgttgcaggccttattcaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6005 - RNA, 4556 nt, synthetic construct
  misc_feature 1..4556: note = Cas9 variant mRNA product
  source 1..4556: mol_type = other RNA
gggagagtcccgcagtcggcgtccagcggctctgcttgttcgtgtgtgtgtcgttgcaggccttattcaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6006 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6007 - RNA, 4493 nt, synthetic construct
  misc_feature 1..4493: note = Cas9 variant mRNA product
  source 1..4493: mol_type = other RNA
gggagagtcccgcagtcggcgtccagcggctctgcttgttcgtgtgtgtgtcgttgcaggccttattcaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6008 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6009 - RNA, 4331 nt, synthetic construct
  misc_feature 1..4331: note = Cas9 variant mRNA product
  source 1..4331: mol_type = other RNA
gggagagtcccgcagtcggcgtccagcggctctgcttgttcgtgtgtgtgtcgttgcaggccttattcaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6010 - RNA, 4364 nt, synthetic construct
  misc_feature 1..4364: note = Cas9 variant mRNA product
  source 1..4364: mol_type = other RNA
gggagagtcccgcagtcggcgtccagcggctctgcttgttcgtgtgtgtgtcgttgcaggccttattcaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6011 - RNA, 3497 nt, synthetic construct
  misc_feature 1..3497: note = Cas9 variant mRNA product
  source 1..3497: mol_type = other RNA
gggagagtcccgcagtcggcgtccagcggctctgcttgttcgtgtgtgtgtcgttgcaggccttattcaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6012 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6013 - RNA, 3581 nt, synthetic construct
  misc_feature 1..3581: note = Cas9 variant mRNA product
  source 1..3581: mol_type = other RNA
gggagagtcccgcagtcggcgtccagcggctctgcttgttcgtgtgtgtgtcgttgcaggccttattcaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6014 - RNA, 3281 nt, synthetic construct
  misc_feature 1..3281: note = Cas9 variant mRNA product
  source 1..3281: mol_type = other RNA
gggagagtcccgcagtcggcgtccagcggctctgcttgttcgtgtgtgtgtcgttgcaggccttattcaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6015 - RNA, 3692 nt, synthetic construct
  misc_feature 1..3692: note = Cas9 variant mRNA product
  source 1..3692: mol_type = other RNA
gggagagtcccgcagtcggcgtccagcggctctgcttgttcgtgtgtgtgtcgttgcaggccttattcaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6016 - RNA, 4250 nt, synthetic construct
  misc_feature 1..4250: note = Cpf1 variant mRNA product
  source 1..4250: mol_type = other RNA
gggagagtcccgcagtcggcgtccagcggctctgcttgttcgtgtgtgtgtcgttgcaggccttattcaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6017 - RNA, 4229 nt, synthetic construct
  misc_feature 1..4229: note = Cpf1 variant mRNA product
  source 1..4229: mol_type = other RNA
gggagagtcccgcagtcggcgtccagcggctctgcttgttcgtgtgtgtgtcgttgcaggccttattcaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 6018 - RNA, 51 nt, synthetic construct
  misc_feature 1..51: note = NLS2 variant
  source 1..51: mol_type = other RNA
atggcgccgaaaaagaaaaggaaagtgggaatacacggggtgccggcggcg

SEQ ID NO: 6019 - RNA, 48 nt, synthetic construct
  misc_feature 1..48: note = NLS4 variant
  source 1..48: mol_type = other RNA
aaaaggccagcggcaacaaaaaaggccgggcaagcgaaaaaaaaaaag

SEQ ID NO: 6020 - RNA, 4107 nt, synthetic construct
  misc_feature 1..4107: note = Cas9 variant
  source 1..4107: mol_type = other RNA
atggataagaagtacagcatcggactagacatcggaaccaactcagtcggatgggccgtcataacggacgaatacaaagtaccgtcgaagaaatttaaagtactaggaaacaccgaccgccacagcatcaagaaaaacctgatcggtgccctactattcgactccggagagaccgcagaagccactcgactcaaaaggaccgccagacgacgatacacacgccgcaaaaaccggatctgctacctccaagagatcttctcaaatgagatggccaaagtagacgactcgtttttccacagactagaggaaagtttcctggtcgaggaagacaagaaacacgagcgacacccaatattcggcaacatagtcgacgaggtcgcgtaccacgaaaaataccccacaatttatcacctacggaaaaagctcgtcgattccaccgacaaggcagacctcaggctgatctacctagccctcgcccacatgattaaattccgaggacacttcctcattgagggagacctcaaccctgacaactcggacgtagacaaactattcattcaactggtacagacgtacaaccagctattcgaagaaaaccccataaacgcctccggggtcgacgctaaagccatactctccgcgagactttcaaaaagccggcgcctcgaaaacctcatagcccaactacccggagaaaagaaaaacggcctatttggcaacctcatagccctatcgctaggacttacaccaaacttcaagtcaaacttcgatctggccgaagacgccaaactacaactcagcaaagacacctatgacgacgacctagacaacttactagcacagatcggagaccagtatgctgacctcttcttggccgcgaagaacctgagcgacgcaatacttctctccgatatcctaagagtcaatacggagatcaccaaggcccctctaagcgccagcatgataaagcgctacgacgaacaccatcaagacctcaccctcctcaaagcactcgttagacagcagctccccgagaaatacaaggagatctttttcgaccaatccaaaaacggttacgccgggtacatagacggaggggcctcacaagaagagttctacaagttcattaaacccatcctcgagaagatggacggaacggaagaactactggtcaaactcaacagagaagatctcctacgcaagcaaagaaccttcgataacggcagcataccccatcaaatccacctcggagaactacatgcaatcctcaggcgccaagaagacttctacccattcctaaaagacaaccgagaaaagatagagaaaatactcactttccgaataccatactacgtcgggccactcgcacgcggcaactcaagattcgcatggatgacccgcaaatccgaagaaaccatcaccccgtggaacttcgaggaagtcgtcgacaaaggagcctcagcccagtccttcatcgaacggatgacaaacttcgataagaacctccccaacgaaaaggtactcccgaagcacagtctcctctacgagtatttcaccgtatacaatgaactgaccaaagtaaagtacgtgactgaaggcatgagaaagccagcgttcctaagtggggagcaaaagaaagcaatcgtcgacctactcttcaaaaccaacagaaaggtcacagtaaagcaacttaaagaagactacttcaagaagatcgaatgcttcgattccgtagaaatttcgggagtagaggaccgattcaacgccagcctaggcacctaccacgacctactaaaaataattaaagacaaagactttctagacaacgaggaaaacgaagacatactagaagacatagtactaacgctcacccttttcgaggaccgcgaaatgatagaagaaagactaaaaacctacgctcacctattcgatgacaaggtaatgaaacagttaaaacggcggcggtacaccggatgggggagactctcccgaaagctcataaatggcatccgagacaaacaatcaggaaagacaatcctcgacttcttaaagagcgacgggttcgcgaatagaaacttcatgcagctaatacacgacgacagtctaacattcaaggaagatatacaaaaagcgcaggtcagcgggcagggcgacagcctccacgagcacatagccaacctcgccggatccccagccatcaaaaagggcattcttcaaactgtcaaagtggtggacgaactggtaaaggtaatgggacgacacaaacccgaaaacatagtcattgaaatggcccgagaaaaccagaccacccaaaagggacagaaaaatagccgagagcgcatgaaaagaatcgaagagggcatcaaggaactcgggtcacagatcctaaaggagcaccccgtcgaaaacacacaactccaaaacgaaaaactatacctttactatctccagaacggcagagacatgtacgtcgaccaagaacttgacatcaaccgcctatccgactacgacgtcgaccacatagtgccacaatcctttttaaaagacgatagcatcgacaacaaagtcctcacacggtccgataaaaatcgaggcaaatcagataatgtcccgtcggaggaggttgttaagaaaatgaaaaactactggcgacaactcctcaacgcgaaattgatcacacaaaggaaattcgacaacctcaccaaagcagaacgagggggtctcagcgaactagacaaggcgggcttcatcaaacgccaattagtagagacgcgacagatcactaagcacgtcgcgcaaatcctagactcacgcatgaacacgaaatacgacgagaacgacaagctcatccgcgaagtcaaagtaataacactcaaatccaaactcgtatccgacttccgcaaagacttccaattctacaaggtgcgagaaataaacaactaccaccacgctcacgacgcctatctgaacgccgttgtaggcacggccctcataaagaaataccctaaacttgagagtgagttcgtatacggagactacaaagtatacgacgtccgcaaaatgatagccaaaagcgaacaggaaatcggaaaagcgaccgctaaatactttttctattccaacatcatgaacttcttcaaaactgagatcaccttagccaatggcgagatacgcaaacggcccctaatcgagacaaacggagaaacaggcgaaatcgtatgggataagggacgcgacttcgctaccgtgcgaaaggttctctccatgccgcaggtcaacatcgttaagaagaccgaagtccagaccggcgggttcagcaaggagagcatcctgcccaaaagaaactcagacaagctcatagcccgcaagaaagactgggaccccaaaaagtacggcggcttcgactccccaaccgtagcttactcagtcctcgtcgttgcgaaagtagagaaaggaaagagcaagaaactcaaaagtgtaaaagaactactgggcataaccataatggagagaagctccttcgagaaaaatcccatcgatttcctagaagcgaaaggctacaaagaagtcaagaaagatctaattataaaacttcccaaatactccctttttgaactggaaaacggccgaaaacgaatgttggcaagtgccggcgaactgcagaaaggcaacgaactcgcgctccccagcaagtacgtcaacttcctatatctcgcgtcgcactacgaaaaacttaagggcagccccgaggataacgagcagaaacaattgtttgtagaacaacacaagcactacctcgacgagatcatagaacagatctccgagttctccaaacgcgtgatactcgccgacgcgaacctcgacaaagtgctgtccgcgtataacaaacaccgcgataagccgatcagagaacaagcagagaacataattcacctattcaccctcactaacctcggtgcgcccgcggcattcaaatatttcgacaccacgatcgaccgaaaaaggtacacaagcacgaaagaagtactcgacgccaccctgatacaccaatccataacaggcctatacgagacccgaatcgatctaagccagctcggcggcgactga

SEQ ID NO: 6021 - RNA, 4890 nt, synthetic construct
  misc_feature 1..4890: note = Cas9 variant
  source 1..4890: mol_type = other RNA
atgaacttcaaaatcctgccaatagcaatcgacctgggcgtcaaaaacacgggcgtattcagcgccttttaccagaaaggcacctcactggaacgcctcgacaacaaaaacggcaaagtatacgagctcagcaaggatagttacaccctacttatgaacaatcgcaccgcgcgtcggcaccaacgacgcggcatcgaccggaaacagctcgtcaagcgcctattcaaacttatatggactgagcaactaaacctagagtgggacaaagacacgcagcaagctatctcatttctatttaaccgacgaggattctccttcatcaccgatggctatagccccgagtacttaaacattgtcccggaacaggttaaagcaatactcatggacatcttcgatgactacaacggagaggacgatctcgacagctatctgaaacttgccaccgaacaagaaagcaagatctccgaaatttacaataaacttatgcaaaagatactcgagttcaaactaatgaaactttgcacagatatcaaagacgataaagtctccacgaagaccctcaaagaaatcacttcctacgagttcgaactgctcgccgactacctcgccaattattccgagtcacttaaaacgcagaaattctcgtacaccgacaaacagggcaacctaaaagaactaagctactaccatcacgacaagtacaacatccaggagttcctcaagcgccacgcaacaattaacgaccgcatcctagacaccctgctcactgacgatctcgacatctggaacttcaactttgaaaagttcgacttcgacaaaaacgaggagaaactgcaaaatcaagaagataaagatcatattcaggcacacctccaccatttcgtcttcgcggtcaacaagatcaaatcggagatggcatctggaggtcgtcaccgatcacaatacttccaggagatcaccaacgtcctagacgagaacaaccatcaggagggctacttgaaaaacttctgcgagaacctgcacaataagaaatactccaacctttcagttaagaacctagttaacctcatcggaaatctctctaacctggaacttaaaccactccggaagtactttaacgacaagatccacgcgaaagccgaccattgggatgaacaaaagttcacggaaacatactgtcactggatcctaggcgagtggcgcgtcggggtaaaggaccaggacaaaaaggatggagcgaaatactcctacaaggacctatgcaacgagctcaaacaaaaggtaacaaaggctggactcgtcgatttccttctcgagctcgacccatgccgcaccataccaccatatttggacaacaacaaccggaagccacccaaatgtcagtcacttatcctgaaccccaagtttctagacaatcagtaccctaactggcaacaatacctccaggaactcaagaaactgcaatcaatacaaaactacctggactcatttgaaacagaccttaaagtattgaagagttccaaagaccagccctactttgtggaatacaaatcctccaaccaacagatcgcatcaggacaacgcgactacaaagatctcgacgctcgaatactccagtttatatttgacagagtaaaggcatcagacgagctgctactaaacgagatatacttccaggcaaagaaactcaagcaaaaggccagctccgagctcgaaaaacttgaaagcagtaagaaactcgacgaagtaatagcaaactcgcaattatctcagatcctaaagtcacaacacacgaatggcatcttcgagcaaggcaccttccttcaccttgtctgcaaatactacaagcagcgccaacgcgcaagagacagcagactgtacataatgccagagtaccgctacgacaagaaactgcacaaatataacaacactgggagattcgacgatgataaccaactcctcacatattgcaaccacaagcccagacagaaaagataccaactcctgaacgacctcgcaggcgttctgcaagtctcgcccaacttcttgaaggacaaaataggctccgacgacgacctgttcatcagcaagtggctcgttgagcacatccgcggcttcaagaaagcatgcgaagacagccttaaaatacagaaagacaaccgaggccttctaaaccacaagatcaacattgcccggaacaccaagggcaaatgcgaaaaagagatcttcaaccttatttgcaagatagaggggtccgaggacaagaaaggtaactacaaacatggactggcatacgaactgggggtcctactcttcggcgaaccaaacgaagcaagcaaaccggagttcgatcgcaaaataaagaagttcaactcaatctactccttcgcccaaatccaacaaattgcgttcgccgaaagaaaaggcaacgccaacacatgcgctgtatgcagcgcagacaacgcccaccgcatgcagcagattaaaatcacggagccagtggaagacaataaggacaaaatcatcctgtctgccaaggcacaaaggctacccgcaatccccacacgaatcgtagacggcgcggttaagaaaatggcgaccatcttggccaagaacattgttgacgacaactggcaaaacatcaagcaagttctctcggccaaacaccaactacatattccaattataacggagtcaaacgccttcgagttcgaaccagcactagccgatgtgaaaggcaaatctttaaaggacaggcggaagaaagcactcgaacgcatttcccccgaaaatatcttcaaggacaaaaacaaccgcatcaaggaatttgctaaggggatatccgcatactccggcgcgaaccttacagacggcgactttgatggcgccaaggaggaactagaccatattatcccacgaagccacaagaaatacggcaccctcaacgacgaagcaaatctcatctgtgtcacccgcggagacaacaaaaacaaagggaaccggatattctgcctccgcgacctagcggacaactataaactcaagcaattcgagacaacggatgacctcgaaattgagaaaaagatcgccgacaccatttgggacgcaaacaaaaaggacttcaaatttggaaactaccggagcttcatcaatcttactccccaagaacaaaaggctttccgccacgcactcttcctagcggacgaaaacccgatcaaacaggcagttataagagccatcaacaaccgcaaccgcacctttgtcaacggcacccaacgctacttcgcggaagtactagcaaacaatatatacctacgcgccaaaaaggaaaacctaaacactgacaaaatatccttcgactacttcggcatcccaaccatcggcaacggcagaggaatcgccgaaatacgccagctatatgaaaaagtggacagcgacattcaggcctacgccaagggcgacaagccccaggcctcttactctcacctcatcgacgccatgctcgcgttctgcatagcggccgacgaacaccgaaacgacggttccataggccttgagatagacaaaaactactcactatacccactagataaaaacaccggcgaagtattcactaaagacatcttctcacaaatcaaaataaccgacaacgagttctccgataaaaagctcgtccgcaagaaagcgatagaaggcttcaacacccaccggcagatgactcgagatggtatctacgccgaaaactacctccctatcctaattcacaaggaacttaacgaagtccgcaagggatacacttggaagaactccgaagaaataaaaatcttcaagggcaaaaagtatgacatccaacagctcaacaacctcgtctactgcctaaagttcgtcgacaaaccgatcagcatcgacatccaaatcagcacgctggaagaactccgaaacatattaacgaccaacaacatcgccgccacggcggaatattattacatcaaccttaagactcaaaaacttcacgaatactacattgagaactacaacactgccctcggctacaagaaatactctaaagagatggagttcctccgctccctcgcctatcggtcggaacgagtaaaaattaaatccatcgacgacgtcaaacaggtgctcgacaaagactcgaacttcatcataggcaagataaccttaccattcaaaaaggaatggcaacgcctgtatcgcgaatggcagaacaccaccatcaaagacgattacgagttcctaaaatcattcttcaacgtcaaatctataactaagctacacaagaaggtacgaaaagacttctccctacccatatcgacaaacgaaggcaaattcttagtcaaaagaaaaacctgggataacaacttcatataccagattttgaacgactcagactcccgagcggacggaaccaaaccgttcattccagccttcgatatctccaagaatgaaattgtcgaagcaatcattgactcctttacctccaaaaacatcttctggctccccaagaacatcgaactacagaaagtagacaacaaaaacatctttgcaatagacacgtccaaatggttcgaagtggaaacccccagcgacctccgcgatatcggcattgctacaatccaatacaaaattgacaacaactcccgcccaaaagtgcgcgtcaagctcgactatgtcatagacgatgactccaagatcaactatttcatgaaccacagcctcctaaaatccagatatcccgacaaggtcttagaaatcctcaaacaatcaaccatcattgagttcgaaagcagcggtttcaacaaaaccataaaagagatgctcggcatgaagctggccggcatatacaacgagacatctaacaactga

SEQ ID NO: 6022 - RNA, 3162 nt, synthetic construct
  misc_feature 1..3162: note = Cas9 variant
  source 1..3162: mol_type = other RNA
atgaaacgcaactacatcctaggcctagacataggcatcaccagcgtcggatacggaatcatagactacgaaacccgtgacgtcatcgacgccggtgtgagactcttcaaagaagccaacgtcgaaaacaatgaggggcgccgctcaaaacgcggagcccgccgcctcaagagaagacgacgtcaccgcatccaacgcgtgaagaaactactattcgactataacctactcacagaccactcggaactctcaggaataaacccctacgaagcccgcgtcaaaggactctcacaaaaactaagcgaggaggagttctccgccgccctgctccacctggccaaacgccgaggcgttcacaacgtcaatgaagtcgaagaagacaccggaaacgaactctcaacgaaagagcagatcagccgcaactccaaagccttggaagagaagtacgtggcagagctgcaactggaacgactgaaaaaggacggcgaagtacgcggctccatcaacagattcaaaacatcagactacgtcaaggaggcaaagcaactactaaaagtgcaaaaagcgtatcaccaactagaccagagcttcatcgacacctacatcgaccttctcgaaaccagacggacctactacgaaggaccaggcgagggcagccccttcggatggaaggacataaaggaatggtacgaaatgctgatgggccactgcacgtacttccctgaggaactgcggtcggtaaagtacgcatacaatgccgacctatacaacgccctcaacgacctcaacaacctcgtaatcacgcgagacgaaaacgagaagctcgaatactacgagaagttccaaatcatagagaacgtctttaaacaaaagaagaaaccaactcttaaacaaatcgccaaagagattctagttaacgaagaagacataaaaggataccgggtgacatcaacgggaaagcccgagttcactaacctcaaagtgtaccacgacattaaagatatcaccgcacgtaaagaaatcatcgaaaatgccgaactcctcgaccaaatcgccaagatactaacgatataccaatcctcagaagacatccaagaggaactaaccaacctcaacagcgaactgacacaagaagagatcgagcagatcagcaacctcaagggctacacaggtacccacaacctgtccctcaaggctatcaacctaatcctagacgagctgtggcacacaaacgacaaccaaatagccatattcaaccgccttaagctcgttcccaagaaagttgacctatcgcaacaaaaggagatcccaacgaccctagtcgacgacttcatactcagcccagttgtcaaacggagttttatacaaagcatcaaggtcataaacgcaatcatcaagaaatacggcctcccaaacgacataataatcgagctagcccgcgagaaaaacagtaaagacgcccagaaaatgatcaacgaaatgcaaaagaggaacagacaaaccaacgaacgcatagaggaaataataaggacaaccggcaaagaaaacgcaaaatacctaatcgagaaaatcaaactacacgacatgcaagaaggcaaatgcctatactccctcgaagcaatccccctagaggacctcctcaataacccattcaactacgaagtcgatcacataatcccccgcagcgtatcattcgacaactccttcaacaacaaggtcctggtaaaacaagaggagaactccaagaaaggaaaccgaacccccttccagtacctcagcagctcagacagtaaaatcagctacgaaaccttcaagaaacatatcctcaacctcgccaaagggaaaggccgcataagtaaaactaaaaaggaatacctactcgaagaacgagatataaaccgcttctcagttcaaaaagacttcataaaccgaaacctcgtcgacacacgatacgcaacccgcggcctgatgaacctcctacgctcctacttccgtgtgaacaacctagacgtaaaggttaaaagcattaatggcggcttcacgagtttcctacgcagaaaatggaagttcaagaaagaacgcaacaaaggctacaaacaccacgccgaggacgccctaatcatcgcaaatgctgacttcatattcaaagagtggaagaaactcgacaaagcaaagaaagtaatggaaaaccagatgttcgaagaaaaacaggccgaatcaatgccggaaatagagacagaacaagaatataaagaaatcttcatcacaccccaccagataaaacacatcaaagacttcaaagactacaaatactcccaccgcgtcgacaagaaaccaaaccgcgaactaataaacgacaccctctactccacacgaaaagacgacaaaggcaacacactaatcgtaaacaaccttaacggcctctacgacaaagacaacgacaaactaaagaaactcatcaacaaaagcccagagaaactactaatgtaccaccacgacccgcagacataccaaaaactaaaactcatcatggaacaatacggcgacgagaaaaacccgctctacaagtactacgaagaaaccggaaactacctcaccaaatacagtaagaaagacaatgggcccgtgatcaagaaaatcaaatactacggaaataaactcaacgcccaccttgacatcaccgacgactaccccaacagccgaaacaaagtcgtcaaactatcccttaaaccgtaccgcttcgacgtctacctcgacaatggcgtatacaaattcgtcacagtcaagaaccttgacgttataaagaaagaaaactactacgaagtcaactccaaatgctacgaggaggcgaagaaactcaagaaaataagcaatcaggccgagttcatagcctcgttctataacaacgacctcatcaaaatcaacggagaactctacagggtaatcggggtgaataacgacctcctgaatcggatcgaagtaaatatgatagacatcacctaccgagaatatttagaaaacatgaacgacaaacgcccaccaagaataatcaaaaccatagcaagcaaaacccagtccatcaagaaatactccacagacatacttggaaacctctacgaggttaaatccaagaaacacccgcagatcatcaagaaaggctga

SEQ ID NO: 6023 - RNA, 4230 nt, synthetic construct
  misc_feature 1..4230: note = Cas9 variant
  source 1..4230: mol_type = other RNA
atgcttttcaacaaatgcataatcatttcaatcaacctcgacttcagcaacaaagagaaatgcatgaccaagccatactccatcggcctagatatcggcaccaattcggtaggttgggcggtcataacagacaattacaaagtaccatccaagaaaatgaaagttctaggtaacacaagcaagaaatatataaagaaaaacctactcggggtcctcctgttcgactctggcataaccgcagagggccgacggctaaaacgaacagcgcgtcgcaggtacacccgccgcagaaaccgcatactgtacctacaagaaatcttctcgacggagatggccacgctagacgacgcattcttccaacgcttggacgactccttcctagtgcccgatgacaaacgggactccaaatacccgattttcggcaacctcgtggaagagaaagtgtaccacgacgagttccccacaatctatcacctacgcaaatacctcgccgactccactaagaaagcagacctcagattggtctaccttgccctcgcccacatgataaaataccggggtcacttcctgatagaaggtgagttcaactccaaaaataacgacattcagaaaaactttcaagactttctcgacacctacaacgccatcttcgaaagcgatttgtccctcgaaaactcaaaacaactagaggaaatcgtcaaagacaaaatttccaaactggagaaaaaggaccgaatcctcaaactctttccgggtgaaaagaactccggaatattctccgagttcctcaaactcatagtcggaaaccaggcagacttccgcaaatgcttcaatctcgacgaaaaagcatcgttacatttcagtaaagaaagctacgacgaagaccttgaaactctcttaggctacatcggggatgactacagcgacgtattcctgaaagccaagaaactctacgatgcaatacttctctccggcttcctgaccgtaaccgataacgaaaccgaagcaccactttccagcgcaatgatcaagcgatataacgaacacaaggaagacctcgcactactgaaggagtatataagaaacatctcgctaaagacttacaacgaagtcttcaaggacgacaccaaaaacgggtacgctggctacatcgacggcaaaacaaaccaggaagacttctacgtctacctgaaaaacttgctcgcagagttcgaaggagcagactacttcctagagaaaatcgaccgcgaagatttcctccgcaaacaacgaacattcgacaacggctccatcccgtaccagattcacctacaggaaatgcgagccatactcgacaagcaggcaaagttctaccccttcttagccaaaaataaggaacggatcgagaaaatccttactttccgtatcccctattacgtcggcccactcgcaaggggcaactccgacttcgcctggtccatccgcaagcgcaacgagaaaatcaccccctggaacttcgaagacgtcatcgacaaagaatcctcagccgaggcgtttataaacaggatgacttccttcgacctttacctacccgaagaaaaagtcctcccaaagcactccctcctctacgaaacattcaacgtctacaacgagctcacaaaagtgcgattcatcgccgaatccatgcgggattaccaattcctagacagcaaacagaaaaaggacatcgtgagactctacttcaaagacaaacgcaaagtcacagacaaggatataatagaatacctccacgcgatatatggctacgacggtatcgaactaaagggcatcgaaaagcaatttaactcctccctgtcaacataccacgatctgctaaatatcatcaacgataaggagttcctcgatgacagtagcaatgaagccatcatcgaagaaataatccatactctaaccatattcgaagatcgtgagatgatcaaacaacggctcagcaagtttgagaacatattcgataagagcgttctcaagaaactgtcacgccgtcactatactgggtggggcaaattgtcagccaaactcatcaacggcatccgcgacgaaaaatccggcaacacaatccttgactatctcatcgacgacgggataagtaaccgcaacttcatgcagcttatacacgatgatgcgctgtccttcaagaagaaaatccagaaagcacaaataataggcgacgaggacaaaggaaacatcaaagaggttgtaaagagcttaccaggctcccccgccatcaaaaagggcatcctacaaagcatcaaaattgtggacgaactcgtgaaagtgatgggaggaagaaaacccgagtccattgtcgtggaaatggctcgtgagaaccaatataccaaccaaggcaagtccaactcgcagcagcgcctaaaacgtctggaaaagtccttgaaagagttaggatccaaaatcctcaaagaaaacatccccgccaaactgtccaaaatcgataacaatgccctgcagaacgaccgcctgtacctctattacctgcaaaacggcaaggacatgtacacgggggacgatttggacatagaccgattatctaactacgacatcgatcacataatcccccaggcattcctcaaagacaacagcatcgacaacaaggtgctagtatcatccgcctcaaaccgcggcaaaagcgacgactttccatccctagaagtcgtaaagaaacgcaaaacattctggtaccaactcctcaaaagcaaactaatctcccaacgcaaatttgacaacttaacgaaggccgaacggggtggcttactgccagaggacaaagcaggattcatccagcgccaactggtggaaacccgccaaatcaccaaacacgtggcgcgactcctagacgaaaagttcaacaacaagaaggacgagaacaaccgggccgttcgcacggtcaagataataaccctgaagtccaccctagtctcccaattcaggaaagacttcgagctgtacaaagtacgcgaaataaacgacttccaccacgcacacgacgcgtatctcaacgccgtaatcgctagcgcgttgctcaaaaagtaccccaagctcgagccagagttcgtctacggcgactaccccaaatacaactcgttccgtgaaaggaagtccgccactgaaaaagtctacttctactctaacatcatgaacatcttcaaaaagtccattagcttggccgacgggcgcgtaatagaacgaccactcatagaagtcaacgaagagacgggggaaagcgtatggaacaaggaaagcgacctcgccacagtacgcagagtactgagctacccccaagtaaacgtcgtcaaaaaggtcgaagaacaaaaccacggactagatcgcggaaaacccaagggcctcttcaacgcaaacctatccagcaagccaaagcccaatagcaacgagaacctagtaggagcgaaagagtaccttgaccctaaaaagtacggcggctatgccggcatctccaacagcttcgccgtgctggtaaaaggcaccattgaaaaaggcgccaagaagaaaatcacgaacgtcctcgagttccaaggcataagcatactcgaccggatcaattatcgaaaagacaaactaaacttcctcctggagaaaggatacaaagacatcgaactaataatagaactcccgaagtattcactctttgaactctcggacggaagccggcggatgctcgcctccatactcagcacaaacaacaaacggggagaaatccacaagggaaaccaaatattcctatcacagaagtttgttaaactgctgtaccacgcgaaaagaatatccaataccatcaacgaaaaccaccgtaaatacgtagaaaaccacaagaaagagttcgaagaactgttctactacattctggagttcaacgaaaactacgtaggcgcaaagaaaaacggcaaactccttaactccgccttccagagctggcaaaaccatagcatagacgaactttgttcctccttcatcggccccaccgggagcgagagaaaaggcctgttcgaactcacgtcccgcggctccgcagctgatttcgagttcctcggcgtaaaaataccgcgctaccgcgactacacgccctccagcctactcaaagacgcgactctcattcatcaatcggttaccgggctatacgagacacgcatcgatttggccaaacttggagaaggatga

SEQ ID NO: 6024 - RNA, 3306 nt, synthetic construct
  misc_feature 1..3306: note = Cas9 variant
  source 1..3306: mol_type = other RNA
atgtggtacgcttcccttatgtccgcacaccacctacgcgtaggcatagacgttggcacccacagcgtgggcctcgccacccttcgcgtcgacgaccacggcacccccatcgagctactctccgcactgtcccatatccacgacagcggagtaggcaaagagggcaagaaagaccacgacaccagaaagaaactctccggaattgcccgccgagcacggcgcctgctccaccacagacggacacaactccagcaactcgatgaagtgctacgggacctgggatttcccatcccaaccccaggggagttcctggacctcaacgaacaaacagacccgtaccgtgtatggagagtgcgcgcccgtctagtcgaagaaaaactgcccgaagaactccgcggaccggccatctcgatggcggtacgccacatcgcaagacaccggggttggaggaacccatactcgaaggtcgaatccctactcagcccggcagaagaatcccccttcatgaaagcactacgtgagcgcatactcgcaaccaccggagaagtactcgacgacggcataacacctgggcaagccatggcccaagtggcactcacacacaacattagtatgcgcggacccgaaggaatcctaggaaaacttcaccagtccgacaacgcgaacgaaattcgaaaaatctgcgcacggcagggcgtaagcccagacgtctgcaagcaactgctaagagctgtctttaaggcagattccccgcgcgggtccgcggttagtcgagtagcccccgacccacttccgggccagggcagcttcagacgagcccccaagtgcgaccccgagttccaacgattccgaataatctctatagtagctaacctccgaataagcgaaaccaaaggcgaaaacagacctctaacagcagacgaacgccgacacgtcgtcaccttcctcactgaagactcccaagcagatctaacctgggtagacgtagccgaaaaactaggagtgcacagacgcgacctccgcggtaccgccgtccacacagacgacggcgaaagatcagccgcaagacccccaatcgacgcgaccgacagaatcatgagacaaacaaaaatatcctccctcaagacttggtgggaagaagcagactcagaacaacgaggcgcaatgatccgctacctttacgaagaccccacggattccgaatgcgcggaaataatcgcagaactccccgaagaagaccaagcgaagctcgactcactacacctccccgccggcagagcagcctacagtcgggaaagtctaacagcactatctgaccatatgctagcaacaacagacgaccttcacgaagcccgaaagcgactcttcggagtcgacgactcgtgggccccaccagccgaagcaatcaacgcccccgtggggaacccgagcgtagacagaaccctaaaaatcgtcggacgatacctcagtgccgtagaaagcatgtggggcacaccagaggtcatccacgtcgaacacgtccgcgatggcttcacctcagaacggatggccgacgaacgtgacaaagcgaaccgacgacgatacaacgacaatcaagaggcaatgaagaaaatacaacgcgactacggcaaagaaggttacatcagtcgaggggacatcgtacgcttagacgcactcgaactacagggctgcgcctgcctgtactgcggaaccaccatcggctaccatacatgtcaactcgatcacatagtgccacaagccggaccaggatccaacaaccgcagaggaaatctcgtcgcagtatgcgaacgatgtaacagatcaaaatccaacaccccattcgcagtatgggcacaaaaatgcggcatcccacacgtcggcgtgaaagaggccatcggcagagtacgcggttggcgtaaacaaacgcccaacacatcctcagaagaccttacccgcctaaagaaagaagtaatcgctcgattacgcagaacgcaagaagacccagagatcgacgagcgaagcatggagtcagtagcatggatggccaacgaactgcaccacagaatcgccgccgcatacccggagactaccgtcatggtctacagaggctccatcacggcagcagccagaaaagctgcagggatcgacagcaggatcaacctcatcggcgaaaaaggcagaaaagaccgcatagaccgacgacaccacgccgtagacgcctcggtggtagcactcatggaggccagtgtcgcaaaaacactcgcagaacgcagttccttacgtggggagcaacgactcaccggaaaggaacaaacctggaagcagtacacaggtagcaccgttggagccagggaacactttgagatgtggcgcggacacatgctacacctcactgaactatttaacgaacgactcgcagaggacaaagtctacgtaacacaaaacatcagactccgtcttagcgacggcaacgcacacaccgtcaacccatcgaaactggtctcacaccgactcggggacggtctgacggtccagcaaatcgaccgcgcctgtacaccagcgctctggtgtgccctaacaagagaaaaagacttcgacgaaaagaacgggctccccgcacgcgaagacagggccatccgagtgcacggccacgaaatcaagtcatccgactacattcaagtcttctcgaaacgaaagaaaaccgactccgaccgtgacgagacaccattcggcgccatcgcggtcaggggcggcttcgttgaaatcggcccttccatacaccacgcccgtatctaccgggtcgaaggaaagaaaccggtctacgcgatgcttagggtcttcacccacgacttactatcacagcgacacggagacctatttagcgccgtcatacccccacaatccatatcaatgaggtgcgccgaacccaaactaagaaaagcaattaccaccggcaacgcgacctacctaggttgggtagtcgtaggggacgaactagagataaacgttgattccttcaccaaatacgccataggcagattcttagaagactttcccaacacaacccgctggcgaatctgcgggtacgacaccaactcaaaattaaccctaaaacccatcgtactagcagccgaaggcctagagaacccctcaagcgcagtaaacgaaattgtcgaactcaaaggctggcgggtagcaatcaacgtcttaactaaggtccacccaaccgtagtgcgccgcgacgcactcggaagaccaagatacagctcacgaagcaacctaccgacatcctggacaatagaatga

SEQ ID NO: 6025 - RNA, 4167 nt, synthetic construct
  misc_feature 1..4167: note = Cas9 variant
  source 1..4167: mol_type = other RNA
atgaccaaaccctactcgatcggcctggatatcggaaccaactcggtcgggtgggcggtcacgacagacaactacaaagtcccttccaaaaagatgaaagtcctgggaaacacgagcaagaagtacatcaagaagaacctactaggcgttctcctattcgattcaggaatcactgcagaggggcgccgcctgaagcgcactgcgcgtcggcggtatacgcgacgccgcaacagaatcctctacctccaagagatcttctccaccgagatggctactctggacgacgcattcttccagcgactggacgactccttcctcgtcccagacgacaagcgcgactccaaatatccaatctttggcaacctcgtagaagaaaaagcctaccacgacgagttccccacgatttaccatctcagaaagtacctagcggattccacgaagaaggccgacctgcgactggtatatctcgctctggcgcacatgataaaataccgtggacacttcctgattgaaggcgagttcaatagcaaaaataacgacatacagaaaaacttccaagacttcctggacacctacaatgcaatcttcgaatccgatctttcactcgaaaactccaaacaactcgaagaaatagtgaaggataaaatatccaagctcgagaaaaaggatcgtatactcaagctattccccggggagaaaaactcgggcattttcagcgagttcctcaaacttatcgttggcaaccaagccgacttcagaaagtgcttcaacctcgacgaaaaagcatccctccacttctccaaagaatcttacgacgaggatctcgaaaccctcctcgggtacatcggggacgactactctgacgtcttcctcaaagcaaagaaactctacgacgctatcttactatcaggcttcctgacagtcaccgacaacgaaaccgaggcgcccctatcctcagctatgatcaaacgttacaacgaacacaaagaagacctcgcactactcaaagagtacatccgcaacattagtctcaaaacctacaacgaagtctttaaagacgataccaaaaatggatatgcaggatacattgatggcaaaactaaccaggaagacttctacgtctacctcaagaaactattagcggagttcgaaggagcagactacttcctcgagaaaatcgaccgcgaagattttctgcgcaaacaaaggaccttcgacaatggttccatcccgtaccaaatccatctgcaggagatgcgagctattctggacaagcaagcaaaattctacccgttcctcgcaaagaacaaagaacggatcgagaaaatcctaacgtttcgaatcccatattatgtaggacccttagcgcgcggcaacagcgacttcgcctggtccataagaaaacgcaacgagaaaattaccccatggaatttcgaagatgtaatcgacaaagaatcatcagccgaggcttttataaaccggatgaccagtttcgacctctacctacccgaagaaaaggtcctgcccaagcacagtttgctctatgaaacgttcaacgtatacaacgaattaactaaagtgcgatttatcgccgaaagtatgcgggactaccaattcctcgattccaaacagaaaaaggacattgtccgcctctacttcaaagacaaacgaaaggtaaccgacaaagacataatcgaatatctccacgccatctacggctacgacggcatagaactaaaaggcatcgaaaaacagttcaacagttccctctcaacctaccacgacctcctcaacataatcaacgacaaggagttcctcgacgactcgtctaacgaagcgatcatcgaagaaataatacacacactcaccatatttgaagaccgcgaaatgataaaacaacgcctctcgaaattcgaaaatatcttcgacaaaagcgttctcaaaaagctatccaggcgacattacaccggctggggcaaactcagtgctaaacttataaacggcatccgtgacgagaaaagcggaaatacaatccttgactacctcatcgacgatgggataagcaaccgtaattttatgcaacttatacacgacgacgcgctatcgttcaagaagaaaatccaaaaagcccagatcatcggtgacgaagacaaaggcaacatcaaagaagtcgtcaagagcctcccgggctctcccgccataaagaaaggcatactccagtctataaaaatcgtcgacgagctcgtaaaagttatgggcggtcgcaaacccgaatccatagtcgtagaaatggcacgagaaaaccagtacacaaatcaagggaaaagcaacagccaacaaagactgaaacggctcgagaagagtctcaaggagctggggtccaaaatcctcaaggagaacataccagctaaactctccaaaatcgacaacaacgccctccaaaacgacaggctttacctgtactacctccaaaacgggaaggatatgtacacaggcgacgatctcgacatagaccgtctcagcaactacgacatagaccacatcatccctcaggccttccttaaagataattcgatcgacaacaaggtgctcgtctcctccgcctccaaccgcggaaaatccgacgacgtcccaagcctggaggtcgtcaaaaagcgcaagaccttttggtaccaactcctcaaatccaaactcatcagccaaaggaagttcgacaacttaaccaaggcagaacgcggaggcctgtccccggaggacaaagccgggtttatacagcgccaactggtcgagacccgccaaataacgaaacacgtcgcccgactactagacgaaaagttcaacaacaagaaagacgagaacaaccgagccgtaaggacggtcaaaatcatcaccctaaaatcaacgctcgtctcacagttccggaaagactttgaactatataaagtgcgcgaaattaacgacttccatcacgcccacgacgcctacctaaacgccgttgtcgcatctgccctattgaagaaataccctaaactagaaccggagttcgtatacggagattatcctaaatacaacagtttccgtgaacgcaaatcagcaacagagaaagtttacttctacagtaatatcatgaacatcttcaagaaaagcataagcctagcagatgggcgagtgatcgaacgacccctcatcgaagtaaatgaggaaaccggtgagtccgtctggaataaagaatcggatctcgcgaccgtcaggcgagtgctcagctacccacaagtcaacgtagtcaagaaagtagaggagcaaaaccatggactcgacagaggaaaacctaaaggactcttcaacgccaacctctcatcgaaacccaaaccaaactcgaacgagaacctcgtcggtgcaaaagagtacctcgatcccaaaaagtacggcggctacgccggaatctctaactcattcacagtattagtaaaaggaaccatcgagaaaggtgcgaagaagaaaatcaccaacgtcctagagttccaaggaatatcaatactcgaccgaattaactacaggaaagacaaactcaacttcctactcgaaaaaggatacaaagatatagaactaatcatcgaactgccaaaatactccctcttcgaactcagcgacggatctcgaagaatgctcgcatcaatcttgtccaccaacaacaaacgaggagaaatacacaaaggcaaccagatcttcttatcccagaaatttgtcaagttactctaccacgcgaaacgaatctcaaacacaataaatgagaaccaccggaaatacgttgaaaaccacaagaaagagttcgaagaactgttttactacatactcgagttcaacgaaaactacgtaggcgcgaagaaaaacggcaaactcctaaactctgcattccaaagctggcaaaaccactcaatagacgaactatgcagctccttcatcggcccaaccggttcagaacgaaaaggccttttcgaactcacctccagggggtcggcggctgacttcgagttcctaggcgtcaagatcccccgctaccgagattatacgcccagcagcctcttaaaggacgcgacgctcatacaccaaagcgtaacgggactgtacgaaacccgaatcgacctcgccaaactaggggagggctga

SEQ ID NO: 6026 - RNA, 3249 nt, synthetic construct
  misc_feature 1..3249: note = Cas9 variant
  source 1..3249: mol_type = other RNA
atggcagcgtttaaaccgaatagcatcaactatatactcggcctagacattggaatcgcctccgtcggatgggcaatggtggaaatcgacgaagaagaaaacccaatccgactcatcgacctaggcgtccgtgtcttcgaacgcgcagaagtacccaaaaccggtgacagtctcgcaatggcgagaagactcgcccgaagcgtccggcgcctgacgcgacgacgagcccaccgactcctacgcacccgacgactgctgaaacgagaaggagtcctgcaagctgccaacttcgacgagaacggcctaatcaaatcactacccaacaccccttggcaactacgcgccgccgccctcgaccgaaaactaacgccccttgaatggtccgccgtactactccacctaatcaaacaccgcgggtacctcagccaacggaaaaacgagggtgaaaccgccgacaaagaactcggagccctactcaaaggcgttgccggcaacgcgcacgccctgcaaacaggcgacttccgcacaccagcggaactcgccctcaacaagttcgagaaagagtccggccacattcgcaaccagcgctccgattactcccacaccttcagcagaaaggacctccaagccgaactaatattactgttcgaaaaacaaaaagagttcggcaatccacacgtcagcggcggcctaaaagaaggcatcgaaaccctcctaatgacccaacgacccgccctatcgggagacgctgtacagaagatgctaggacactgtacattcgaacccgcagagccgaaagcagccaagaacacctacaccgccgagagattcatctggctcacaaaactaaacaacctaagaatcctggaacaggggagtgaacgcccgctcacggacaccgagcgggcaaccctaatggacgagccgtacagaaaatccaaactaacatacgcccaagcccgcaaactcctaggcttagaagacacagccttctttaaaggattacgctatggcaaagacaatgctgaagcaagcacacttatggaaatgaaagcataccacgccatctcccgagccctcgaaaaagaggggctgaaagacaagaaaagcccacttaacctcagccccgaactacaagatgaaatagggacagccttcagcctcttcaaaacagacgaggatataaccggccgattaaaagaccgaatccaacccgaaatactggaggcactcctcaaacacatctcgttcgataaattcgtacagataagcctgaaagccctaagacgaatagttccgctcatggaacaaggaaaacgctacgacgaagcgtgcgctgagatatacggagaccactatggcaaaaagaacacggaagagaaaatatacctaccgcccataccagcagacgaaattcgcaaccccgtcgtgctccgagcgctgagccaagcccgaaaggtaattaacggagtagtgcgacgctacggaagcccagcgagaatacacatagaaaccgcacgcgaggtgggcaagagcttcaaagacagaaaagaaatcgaaaaacgccaagaggaaaaccgcaaggaccgcgaaaaggccgcagccaaattccgcgagtacttccccaacttcgtcggagaacccaaatcaaaggacatcctaaaactgcgactgtacgaacaacaacacggaaaatgcctatacagcggcaaggaaatcaacctcgggcgcctcaacgagaagggctacgtcgaaatcgaccacgcactcccattctcccgcacatgggacgactcgttcaacaacaaagtcctagtactgggaagcgaaaatcaaaacaagggaaatcaaaccccatacgagtatttcaatggcaaagataacagccgagaatggcaagagttcaaagcaagagtagaaacaagccgcttcccacgctcaaagaagcaaaggattctcctgcaaaaattcgacgaagacggctttaaagaaagaaacctcaacgacactagatacgtaaaccgattcctatgccaattcgtagccgaccgaatgagactgaccgggaaagggaagaaacgagtgttcgcctccaacggacaaatcaccaacctactacgaggcttctggggcctccggaaagtgcgcgcagaaaacgacagacaccacgccctggacgccgtagtcgtagcatgctctacggtagccatgcaacaaaagatcacaagattcgttcggtacaaagaaatgaatgccttcgacggcaaaacgatagacaaagaaacaggcgaggtactccaccagaaaacccacttcccccaaccatgggagttcttcgcacaagaggtaatgatcagagtgttcgggaaacccgacggcaaacccgagtttgaagaagccgacaccctcgaaaaactccgaacattactagcggagaaactatccagtcgacccgaagctgtccacgaatacgtgacgcccctgttcgtcagccgcgcacccaaccgcaaaatgagcggacaaggccacatggagaccgtaaaaagtgcaaaaagactagacgagggggtaagcgtcctacgcgtccctctaacccaactaaaactaaaggacttagagaaaatggtaaaccgtgaaagagaaccaaaactatacgaggcgctgaaggcaaggctagaagcccacaaagacgaccccgccaaagccttcgccgaaccattctacaagtacgacaaggcaggaaaccgcacacagcaagtaaaggccgtaagagtcgagcaagtacagaaaaccggggtctgggtccggaaccacaacggcatagccgacaacgcaacaatggtccgagtggacgtcttcgagaaaggcgacaagtactacctcgtccccatatactcctggcaagtagcgaaaggaatcctcccagatcgggcggttgtgcaaggcaaagatgaagaagactggcaactcatcgatgacagctttaacttcaaattctccctacaccccaacgatctcgtagaagtgatcacgaagaaagcccgcatgtttggctacttcgccagttgccaccgcggaactggaaatatcaacatcagaatacacgacctggaccacaaaatcggcaaaaacggtattttagaaggaataggcgtaaaaaccgccctctcattccaaaaataccaaatagacgagctgggcaaagaaatccgcccatgccgcctcaagaaacgcccacctgtacgctga

SEQ ID NO: 6027 - RNA, 4005 nt, synthetic construct
  misc_feature 1..4005: note = Cas9 variant
  source 1..4005: mol_type = other RNA
atgaagaaaccctacacgatcggcctcgacatcgggacgaacagcgtggggtgggccgtgctcaccgatcaatacgacctcgtcaaacgaaaaatgaaaatagcgggcgacagtgagaagaaacaaataaagaaaaacttttggggcgtacgtctcttcgatgaaggacaaacggccgcagacaggcgaatggcccggacggcacgcagacgcatagaacgccgccggaaccgcatctcctacctccaaggcatcttcgccgaggaaatgtcaaaaaccgacgccaatttcttttgccggctcagcgacagcttctacgtcgacaacgagaaaaggaatagccgccacccctttttcgccaccatcgaagaagaagtggaatatcacaaaaactacccaacaatttaccatctccgagaagaactggtgaactcctcggaaaaagccgatttacgactggtatatctagccctggctcacatcataaaataccgagggaacttcctcatcgaaggggccctcgacacacaaaacacgtcagtagatgggatctacaaacaattcatccaaacgtacaaccaagtgtttgctagcggcatcgaagacggctccctcaaaaagctggaagacaacaaggacgtcgccaaaattctggtagagaaagtaacccgcaaggaaaaactcgaacgcatcctaaaactctacccgggcgaaaagtcagcaggaatgttcgcacaattcatatcactcatcgtggggagcaaaggcaacttccaaaagccgttcgaccttatcgaaaagagcgacatcgaatgcgcgaaagactcctacgaagaggacctcgaatccctacttgccctcatcggtgacgaatatgcagaacttttcgtagccgccaaaaacgcctacagcgcggtcgtgctctcttcgatcatcacagtggcagaaacggagaccaacgcgaagttaagtgcaagcatgatagaacgctttgacacacatgaagaagacctaggcgaactaaaagcgttcataaagttacacctccccaagcactacgaagaaatattctcgaacacagagaaacacggctacgccggctacatagacggcaaaacaaaacaggcggacttctacaaatacatgaagatgacgctcgagaacattgaaggcgcggactacttcattgcgaaaatcgagaaggaaaacttcctcaggaagcagagaacctttgataatggcgccatcccccaccagctacaccttgaggaactagaggcgatcctgcaccagcaggcaaagtactaccccttcctaaaagaaaactatgacaagatcaagtcgctggtaaccttccgcatcccgtacttcgtcgggcccctcgcaaacggccaatccgagttcgcatggctcacccggaaggcagacggggaaattcgaccctggaacatcgaagaaaaagtcgactttgggaagtccgccgtcgactttatcgagaaaatgactaacaaggatacataccttccaaaagaaaacgtcctccccaagcattcgctctgctaccagaaatacctagtatacaacgaactcacaaaggtccgctacattaacgatcaagggaaaactagctacttcagcgggcaagaaaaagaacagatcttcaacgacctcttcaagcaaaagcgaaaagtaaagaagaaggacctcgaactcttcctacgcaacatgtcccacgtcgaatcccccaccatagaaggcctcgaggacagtttcaactcctcatactcgacgtatcacgatctactaaaggtggggataaagcaagaaatcctcgataacccagtcaacaccgaaatgctcgagaacatagttaaaatcttaaccgtcttcgaagacaagcgcatgataaaagaacaactccaacaattcagcgacgtgctagatggagtagtcctcaaaaagctagaaagaagacactacaccggctggggtagactatcggcaaagctactgatggggatcagagataagcagtcacacctcacaatattggattatctcatgaacgacgacggcctcaacaggaacctgatgcagcttatcaacgacagcaacctatcatttaagagcattatagaaaaagaacaggtaaccacagcagacaaggacatacagagcatagtagcagacctggcgggaagcccagctatcaaaaagggcatactgcagagcttaaaaatagtagacgagctagtatcggttatgggctacccaccacaaaccatagtagtcgaaatggcgcgggaaaaccaaaccaccggaaaaggcaaaaacaattcccggccaaggtataaaagcctcgaaaaggccatcaaagaatttggcagtcaaattctcaaggaacaccccaccgacaaccaagaactccgaaacaaccggctctacctgtactaccttcaaaacggaaaagacatgtataccggacaggacctcgacatacacaacctctcaaactacgacatcgaccacatcgtcccccaatcgtttataaccgacaacagcatcgacaacctagtcctcacctccagcgcaggaaaccgcgaaaagggagacgacgtcccaccccttgaaatcgtcagaaaacgcaaggtcttctgggaaaaactctatcaaggaaacctaatgtcaaaaagaaaatttgactacctgacgaaagccgagcgcggtggcctcaccgaggccgacaaagcccgtttcatccatagacaacttgtcgaaacaagacaaatcaccaaaaatgtagcaaacatcctccaccagcgcttcaactacgaaaaagacgaccacggcaacacaatgaaacaagtgcgcatcgtgacactaaaatcagcacttgtgagccagtttcgcaaacaattccagctctacaaagtacgggacgttaatgactaccatcatgcgcacgacgcatacctgaacggcgtcgtggccaataccctcctcaaagtatatccccaactcgaaccggagttcgtctacggagactaccaccaattcgactggtttaaagcaaacaaagccacagcaaagaaacaattctacacgaacataatgctattcttcgcccagaaagaccgaatcatagacgaaaacggagaaatactctgggataagaaatacctggacactgtcaagaaagtcatgtcctaccgccaaatgaacatcgtcaagaaaacggaaattcaaaaaggagagttcagcaaagccaccatcaaaccgaaaggcaattcatcaaaactaatccccaggaaaaccaactgggacccgatgaaatacggagggctcgactcccccaacatggcctacgcagtcgtcatagaatacgcgaaagggaaaaacaagctcgtctttgaaaagaagataatacgagttaccatcatggaacgaaaagcctttgaaaaagacgaaaaagcatttctagaagaacagggataccggcaaccaaaggtccttgcaaaactcccaaagtacacactatacgaatgcgaggaaggtaggaggcgaatgctcgccagtgccaacgaggcccagaaaggcaatcaacaagtgctgcccaatcacctcgtgaccctattgcaccacgccgccaactgcgaagtttcagacggcaagtcactagactatatcgagagcaatcgggaaatgttcgcagaactactagcccacgtctctgagttcgcaaagcgatacaccctcgcggaagcaaacctaaacaaaatcaaccaattattcgaacagaacaaagaaggagacatcaaggcaatagcccagagcttcgtggatcttatggcattcaacgccatgggggcaccggcatcattcaagttctttgagacaactatcgagaggaaaagatataacaacttaaaagagctcctgaactccacaatcatctaccaatccataacaggcctgtacgaaagccggaaacgactagacgactga

SEQ ID NO: 6028 - RNA, 4038 nt, synthetic construct
  misc_feature 1..4038: note = Cas9 variant
  source 1..4038: mol_type = other RNA
atgaaaaagccctactcaataggactcgacatcggcacgaacagcgtcgggtgggcggtcgtcacggacgattacaaagtgcccgccaagaagatgaaagtcctaggaaatacggacaaatcccacatagagaaaaaccttctcggtgcactcctgttcgacagcggaaatacggcagaagaccgacggctcaagcgtacagctcggcgccgatacacccggcgcagaaacaggatcctctacctacaagaaatattctcagaagagatgggcaaagtggatgactcattctttcaccgcttagaagattcatttctcgtaaccgaagacaaacgcggagaacggcacccaatatttggaaatttagaagaggaagtcaagtaccacgaaaacttccccacaatataccatctgcggcaatacttagccgacaacccggaaaaagtggatctccgtctagtctacctggcacttgctcacataatcaaattccgcggacacttcctgatcgagggtaaattcgacactcggaacaacgacgtccagagattattccaggaatttctcgccgtatacgacaacaccttcgagaacagcagtcttcaggagcagaacgtacaggtggaagaaatactcaccgacaaaatcagcaagagcgcgaagaaagatcgcgtcctgaaactattcccgaacgaaaagtctaatggccgattcgcggaatttctgaaactcatcgtcggtaaccaagccgacttcaagaaacacttcgaactcgaagagaaagcaccccttcaattctccaaggacacctacgaagaggagctcgaagtgctactcgcacaaatcggcgacaactacgccgaactctttttatcagccaagaaattatacgactccatccttctatcaggcatcctcaccgtaacggacgtaggcacaaaagctcccttgtctgctagcatgatacagcgctacaacgaacaccaaatggacctagcacaactgaaacaattcatccgccaaaaactgagcgacaaatacaacgaagtcttctcagacgtttcaaaagacggctatgcaggctacatcgatggcaaaacaaaccaggaggccttctacaaatatctgaagggcctactaaacaaaatcgaaggctccggatacttcctagataaaatcgaaagagaagacttcctccgcaagcagcgcacattcgacaacgggagcatcccacaccaaatacacctccaagaaatgcgagcaatcatccgtcgacaagctgagttctaccctttcctcgccgacaaccaagaccgcatcgaaaaactcctcaccttccgaataccatattacgtcggcccccttgcaaggggaaaatccgactttgcctggttatcaagaaaatcggcggacaaaattaccccctggaattttgacgaaattgtcgacaaagaaagttccgccgaagccttcataaaccgcatgactaactacgacctttaccttccgaaccagaaagtactaccgaaacacagtctcctctacgaaaaattcaccgtctacaacgaactcacaaaggtaaagtacaaaaccgaacaaggtaagacagcattctttgacgccaacatgaaacaagaaatcttcgacggtgtcttcaaggtatatcgaaaagtaacaaaagacaagttgatggatttcctggaaaaagagttcgatgagttccgcatcgtagacctcacaggcctagacaaagaaaacaaagtgttcaacgcgagctatggaacgtaccacgatctgtgtaagattctcgacaaagatttcctagacaatagcaagaacgagaaaatcctcgaagacatcgtcctaactcttacactgtttgaagaccgcgaaatgatccggaaacgactagaaaactacagcgatctgctaacaaaagaacaagtcaagaaacttgaaagaagacactacaccggctggggtcgcttatcagcggaactcatccatggcattcgaaacaaagaaagccgcaagaccatcctcgactatctgatcgacgacggaaactcaaaccggaacttcatgcagctaatcaacgacgacgcactctcctttaaagaagaaatagccaaggcccaggtcatcggcgaaacagataaccttaaccaggtagtctccgacattgccggctctcctgctatcaaaaagggaatcctccagagtctcaaaatcgtcgacgagctagtaaaaatcatgggccaccaacccgaaaacatagtggttgaaatggcacgcgagaaccaattcacaaaccaagggcgccgtaactcgcagcaacggctcaaaggcctaaccgactccataaaagagttcggaagccagatcctaaaagaacacccagtggaaaactcccaactccaaaacgatcgcctctttctctactacctacagaacggccgggacatgtacaccggagaggaactcgacattgactacctctcgcaatacgacatcgaccacataatcccacaggccttcatcaaagacaactccatcgacaaccgcgtgctaacatcctccaaagaaaaccgcggaaaatccgacgacgtcccctcaaaagacgttgtccgaaaaatgaaaagctattggagcaagctactgagcgccaaattaatcacacaacgcaaattcgacaacttgaccaaagccgaacggggcggactcacagatgacgacaaggcaggcttcatcaaaagacaactggttgagacacgacagattaccaagcacgttgcgcgaatcctcgacgaacgcttcaacacagaaactgacgagaacaacaagaaaatccgtcaagtcaaaatcgtgaccctaaagtcgaacctcgtcagcaacttccgtaaagagttcgaactctacaaagtacgcgagatcaatgactaccaccacgcccacgatgcctacctaaacgcggtcatcggcaaggcactactaggagtgtatccccaactggaaccggagttcgtgtacggcgactacccccactttcacggccacaaagaaaacaaagccacggccaaaaagttcttctactcaaacatcatgaatttcttcaagaaagacgacgtacgcaccgacaaaaatggagaaataatatggaaaaaggacgaacacatctccaacattaagaaggtcctttcctacccacaggtcaatatcgtaaagaaggtagaggagcaaaccggcggattctcaaaagaatccatcctgcccaaaggaaactcggataagctcataccccgaaaaaccaaaaagttctactgggacaccaaaaagtacggaggcttcgacagcccaatcgtggcctactccatcctagtcatagcggacatcgaaaagggaaaaagcaagaaactaaaaacagtcaaagctctcgtcggggtaacaataatggagaaaatgaccttcgaacgagaccccgtagcattcctcgaacggaaagggtaccgcaatgtccaagaagagaacatcatcaaactacccaagtatagcctgtttaaactcgagaacggccgcaagcgactcctagcctccgcccgggagttacaaaagggtaacgagattgtcctcccaaaccacctcggtactctcctataccacgccaaaaacatccacaaagtagacgagccaaaacacctagactatgtcgacaaacacaaagacgaatttaaagaactactcgacgtagtaagtaatttctccaagaaatacacccttgcagaaggaaacctcgagaaaatcaaagaactctatgcacaaaacaatggggaggacctgaaagaactcgcatcctcattcatcaacttactaaccttcacagccatcggggcccccgcaaccttcaaattcttcgacaagaacatcgaccggaagcgatacacgtctactacagaaattctgaatgctacgctcatccaccaaagtatcaccgggctatacgaaacccgaatcgaccttaataaactaggaggcgactga

SEQ ID NO: 6029 - RNA, 3171 nt, synthetic construct
  misc_feature 1..3171: note = Cas9 variant
  source 1..3171: mol_type = other RNA
atgcaaacaacaaacctctcctacatcttgggactcgacctgggcatcgcttctgtcgggtgggctgttgtagaaatcaacgaaaacgaagacccaataggcctcatcgacgtaggggtccgcatcttcgagagggcagaggtcccaaaaacaggagaatcactagcactttccaggcgcctcgcaaggtccacccggagactcatcagacgccgcgcccaccggctcctactcgccaagcggttcctaaaacgcgaaggcatcctatccaccatagacctcgagaaagggctaccaaaccaagcctgggaacttcgcgtggcgggcctcgaaaggcgactaagcgccatagagtggggcgccgtccttctacacctcatcaagcaccgcggttacctaagtaaaaggaagaacgaatcccagaccaacaacaaagaactcggagcgctcctcagcggggtcgcacaaaaccaccaactcctacaatccgacgactaccgcacccccgcggagctcgcgctcaagaaattcgccaaagaggaaggacacattcgtaaccaacggggcgcctacacccacacgttcaaccgactcgacctacttgcagaactcaacctactcttcgcgcaacagcaccagttcggcaatccacactgtaaagaacacatccagcagtatatgacagaactcctcatgtggcagaagcccgccctctcaggagaggcaatactaaagatgctgggcaaatgcacgcacgaaaagaatgagttcaaagcagcaaaacacacctacagcgccgaacgcttcgtatggctaacaaaactcaacaacctccgcatcctagaggacggcgcagaaagggcccttaacgaagaggagcgacaactgctgataaaccacccctacgagaaatcaaaactcacgtacgctcaggtccgaaaactcctaggactatccgaacaggccatattcaagcacctcaggtacagtaaggaaaacgccgaatccgcgacattcatggaactcaaggcatggcatgccatccggaaagccctcgaaaaccaagggctaaaagacacatggcaagacctggccaaaaagccagacctcctggatgaaatcggcacagccttctcgctctacaagacagacgaagacatacaacagtacctaaccaacaaagtaccgaactcagtgatcaacgccctattagtatcactaaacttcgacaaattcatcgaactgtccctaaaatccctacgcaaaatcctaccgctaatggagcaaggtaaacggtatgaccaagcctgcagagagatctacggacatcactacggggaagccaaccagaaaacatctcaactcctccctgctatccccgcccaagaaatccgtaaccccgtcgtactacgcacattaagccaagcccgaaaggtcataaacgcaatcatccgtcaatacggatccccagcacgggtccatatcgaaactggcagagaactcggcaagtcctttaaagaacgccgcgaaatccaaaaacaacaggaagataaccgcacaaaacgggagagcgcagttcagaaattcaaagagctattctccgacttctcaagtgaaccaaaatcaaaagacatactaaagttcaggctctatgaacaacagcacggtaaatgcctttactcaggcaaggaaatcaacatccaccggctaaacgaaaaagggtacgtagagatcgaccatgcactaccattctcgcgcacttgggacgactcattcaacaacaaagttctagtcctggcatcggaaaatcaaaacaaaggcaaccaaaccccatacgagtggctacagggaaaaataaatagcgaaagatggaagaacttcgtggccctggtactcggttcacaatgctcagcagctaagaaacaacgtctattgacccaggttatcgacgacaacaaatttatagatcgcaaccttaacgacacccggtacattgccagattcctatccaactacatccaggaaaacctactcctcgtaggtaaaaacaagaaaaacgtcttcacaccaaacggacagatcacagcccttctcaggtcaaggtggggcctcataaaagcgagggaaaacaacaaccgacaccacgcactggacgcaatagtagtagcctgcgccacccctagcatgcaacagaaaatcacaagattcattcgatttaaagaagtgcatccctacaaaatcgaaaaccgatacgaaatggtagaccaagaaagcggagagataatcagcccccacttcccagaaccgtgggcctatttccgtcaagaagtcaacataagagtgttcgacaaccaccctgacacagtcctgaaagaaatgctcccagatcgcccccaagccaaccaccaattcgtacaacccctctttgtctcccgcgcaccgactaggaaaatgtccggccaaggacacatggagaccattaaatccgcgaagcgcctcgctgaaggaattagtgtcctacggatcccactaacacaactcaaacccaacctactagaaaacatggtaaataaagaacgcgaacccgccctatacgcaggactcaaagcccgcctagccgagttcaaccaagaccccgccaaggctttcgccactccattctataaacaaggcggacagcaagtaaaagctatcagagtagaacaagtacagaaatccggcgtcctagtccgggagaacaatggagtcgccgacaacgcaagcatagtacgcaccgacgtcttcattaaaaacaataaattcttcctcgtccccatctatacatggcaagtcgcgaaagggatcctccccaacaaagcaatcgtcgcgcacaaaaacgaggacgaatgggaagaaatggacgaaggagcaaagttcaaattcagtctattccccaacgacctagtagagctgaaaactaaaaaggagtacttcttcgggtactacataggcctcgaccgcgctacaggaaacatctccctcaaagaacacgacggggagataagcaaaggaaaagacggcgtttaccgtgtgggcgtcaaactagcactatctttcgagaaataccaagtcgatgaactcggcaaaaatcggcaaatctgccgaccccaacagcgccaaccggtcaggtga

SEQ ID NO: 6030 - RNA, 3249 nt, synthetic construct
  misc_feature 1..3249: note = Cas9 variant
  source 1..3249: mol_type = other RNA
atggccgccttcaaacccaacccaatcaactacatcctaggcctggacatcggaatcgcctccgtaggttgggccatggtggaaatcgacgaagacgaaaacccaatctgcctaatcgacctgggagtccgcgtattcgagcgagctgaagtccccaaaaccggtgactcccttgccatggctcggcggctcgcgcgcagcgtacgccgactgacccgccgtagagcacacagactactacgcgcacgacgcctactcaaacgcgaaggagtcctgcaagccgcagacttcgacgaaaacggactaatcaaatccctaccaaacacaccatggcaactccgagcagcagccctagatagaaaactcacgcctctggagtggagcgcggtactgctccacctgataaaacacagagggtacctatcacaacgaaagaacgaaggcgagaccgccgacaaagaactcggtgccttactaaaaggcgtcgcagataacgcacacgctctacaaaccggggacttccgaaccccagccgagctggcactcaacaaattcgaaaaggagagcggacacatcagaaaccaacgaggagactactcacacacgttctctagaaaggacctccaggcggaattgattctcctgttcgaaaagcaaaaagagttcggcaacccgcacgtcagcggaggcctaaaagaaggcatagaaaccctactcatgacccagcgaccagcgctaagcggcgacgccgtgcagaaaatgctcggccactgcacgttcgaaccagcagaaccgaaggcggccaaaaacacttacacggcagagcgattcatatggctaacaaagctgaacaacctacgcatactagaacaaggcagtgaaaggcctctcaccgacacagaaagggccacgcttatggacgagccctacagaaaaagcaaactaacatacgcacaagcacggaaactactcgggctggaagacacggcattcttcaaaggtctccggtacggaaaggacaacgccgaagcctccacactcatggaaatgaaagcctatcacgccatctcgagagcgctagaaaaggaaggcctcaaggacaaaaagagcccactcaacctcagcccagaactccaagacgaaatcggcacagcattctcactcttcaagacggatgaagacataaccgggcgcctaaaggaccggatacaaccggaaatcctcgaggccctcctaaaacacatctccttcgacaaattcgtccaaatatcactaaaagccctacgacgcatagtcccccttatggagcaaggcaaaagatacgacgaggcgtgcgccgagatctacggagaccattacggcaagaaaaacactgaagagaaaatttatctcccacccatacccgcagacgaaataagaaacccggtcgtgctcagggccctctcccaagccagaaaagtcatcaatggagtagtccgccgatacggctcaccagcacgcattcacattgaaaccgcccgagaagtaggaaagagcttcaaagaccggaaagaaatcgaaaaacgtcaagaagaaaatcgaaaagaccgcgaaaaagcggccgcaaaattccgcgaatactttccaaacttcgtgggggaaccaaagtcaaaggacatactaaaactgcgactctacgaacaacaacatgggaaatgtctgtactccggcaaagaaatcaacctcggacgactcaacgaaaaaggctatgtcgaaatcgaccacgcactgcctttctcacgaacatgggacgacagcttcaacaacaaagtgctagtactagggtcagaaaaccaaaacaaaggaaaccaaaccccatacgaatacttcaacggaaaggacaacagccgggagtggcaagagttcaaagcaagggtagaaacatcacgcttcccacgatccaagaaacaacgcatactcctacaaaaattcgacgaagacggcttcaaagaacgcaacctaaacgatacacgctacgtgaacagattcctatgccaattcgtcgcagataggatgcgtctcaccggcaaaggaaagaaacgcgtcttcgcatccaacggacaaataactaacctgctccggggattttggggcctccgcaaagtccgcgccgagaatgacagacaccacgccctggacgcagtcgtggtagcatgttcaaccgtcgccatgcagcagaaaataacgagatttgtgagatacaaagagatgaatgcattcgacgggaaaaccatcgataaagaaaccggagaggtactacatcagaaaacacacttcccccaaccatgggagttcttcgcccaagaagtaatgatccgcgtgtttggcaaaccagacgggaaacctgagttcgaagaagcggacaccccagaaaaactacgcacactgctcgctgaaaaactatcaagcagaccagaagcagtgcacgagtacgtaacaccactattcgtatccagggcccccaaccgcaaaatgagtggccaaggacacatggagaccgtcaaatcagccaaacgcctcgacgagggtgtgagcgtgctccgagtgccgcttacccaactgaaactaaaagacctcgaaaagatggtcaaccgcgaacgcgagccaaagctatatgaagcactgaaagcacgcctagaggcacacaaagatgaccccgccaaagcgttcgcagaaccattctacaaatacgataaagccgggaaccgcacccaacaagtcaaagccgttcgcgtcgaacaagtccaaaagacgggcgtatgggtacgaaatcacaacgggatagccgacaacgccactatggtgcgcgtcgacgtcttcgaaaaaggcgacaaatactacctcgtcccgatctattcctggcaagttgcaaagggaatcctgcctgatcgcgctgtcgtacaaggcaaagacgaagaagactggcaactcatcgacgacagcttcaatttcaagttcagtctccaccccaacgacctagtagaagtaataacgaaaaaggcgcggatgttcggctacttcgccagctgccaccgcggcacaggaaatataaatatcagaatacacgaccttgaccacaaaataggcaaaaacggaatcctcgagggaattggtgtcaagacagcgctctccttccaaaaataccaaatcgacgagctcggaaaagagataagaccttgtcgattaaagaaaagaccgcccgtaagatga

SEQ ID NO: 6031 - RNA, 3255 nt, synthetic construct
  misc_feature 1..3255: note = Cas9 variant
  source 1..3255: mol_type = other RNA
atgaaataccacgtcggaatcgacgtaggaaccttttcagtcggactcgcggcaattgaggtggacgacgccggaatgccaatcaaaaccctcagcctggtctctcacatccatgatagcggccttgaccccgacgaaataaagtcagcagtaacaagactcgccagttcaggaatagcccggagaacacgccgcctttatcgacgcaaacgacgaagactccaacaactcgacaagttcatccaacgacaaggatggccggtaatagaactagaagactactcagaccccctatacccctggaaagtacgagccgaactagcggcaagctatatcgccgacgaaaaggaacgcggggagaaactatcagtagcactacgacatatagccaggcaccggggatggcgtaacccatacgccaaagtcagctcgttatacctaccggacggaccaagtgatgcattcaaagcaatcagagaagaaataaaacgcgcgagcgggcaacccgtcccagaaacagcaaccgtaggccaaatggtcacactctgtgaactggggacactaaagctaagaggggaaggaggagtactctcagcgcgacttcaacaaagtgactacgcaagagaaatacaagaaatatgcagaatgcaggaaataggccaagaactataccgcaaaatcatagacgtagtattcgcagccgaatcaccgaagggatccgcaagttcgcgagtagggaaagacccactccaaccgggcaaaaacagagcactgaaggcgagcgacgcgttccagaggtatagaattgcggcgctcataggaaacctacgcgtacgcgtggacggagaaaaacgaatactaagtgtagaagagaaaaacctggtgttcgaccacctcgtcaacctgacaccaaagaaggaaccagagtgggtaacaatagccgaaatcctcggcatcgaccggggacaactaataggcacagcaaccatgaccgacgatggcgaacgagcaggagccaggccaccaacacacgatacaaaccggtcgatcgtcaattcacgaatcgcgccactcgtggactggtggaaaacggcaagcgctctagaacagcacgccatggtgaaagcactctcaaacgcagaagtagacgacttcgactcaccagagggagcaaaagtccaggcatttttcgcggacctggacgatgacgtccacgcaaaactagacagtctacacctccccgtggggagagcagcatacagcgaagacaccttagtgcgcctcacccgaaggatgctgagcgacggagtcgatctatacacagcaagactgcaagagttcggcatcgaaccatcctggaccccacccacaccccgcatcggagaacccgttggcaatccagccgtagaccgagtcctaaaaaccgtcagccgatggctggaatccgcaacaaagacatggggagcacccgaacgcgtgatcatcgaacacgtacgcgaagggtttgttacagagaaacgcgcacgcgagatggacggcgatatgagacgacgcgccgcgcgaaacgcaaaactcttccaggaaatgcaggagaaactgaacgtccaaggcaaacccagccgagccgacctctggcgataccaatcagtacaaagacaaaactgccaatgcgcctactgcggaagcccgatcactttcagcaacagcgaaatggaccatatagtaccccgcgcaggccaaggatcaaccaacacccgcgagaacctagtagcggtatgtcacagatgtaaccaatccaaaggcaacaccccattcgccatctgggcgaagaacaccagcatagagggggtaagcgtcaaggaggccgtagagagaacacgccactgggtcacagacaccggaatgcgaagcaccgatttcaagaaattcacaaaagccgtagtcgaacgattccaacgagcaacaatggacgaggaaatagacgccagatccatggaatccgtagcatggatggcaaacgaactccgctcaagagtagcacagcacttcgcgtcccatggcaccacagtaagagtctacagaggctccctaacagcagaagcacgacgcgcttcaggcataagtgggaaactgaaattctttgacggagtaggaaagtcacgattggaccgacggcaccatgcgatcgacgccgccgtaatcgcatttacatcagattatgtcgccgagaccctagcagtaagatcgaacctcaaacaaagccaggcacatagacaggaagcgccccaatggcgagagttcacggggaaagacgcagaacaccgagccgcctggagagtatggtgccaaaagatggaaaaactgagtgccttactaaccgaggacctacgagacgaccgagtggtcgtcatgtcaaacgtacggctaagactagggaacggatccgcccacaaggaaaccataggcaaactcagcaaagtcaaactcagtagccagctgtcagtcagcgacatagataaagcaagcagcgaagcgttgtggtgcgcacttacgcgagaacccggcttcgacccaaaagagggactccctgcaaaccccgaacgccacataagagtaaacggcacacacgtatacgcgggagacaatatcggcctattcccagtcagcgccggatcgatcgccctgcgcgggggctacgccgaactcggaagctcattccaccacgcccgagtatacaagatcacatccggaaagaaaccagccttcgcaatgctgagagtatacacaattgacctcctcccctacagaaaccaagatctatttagcgtagaattaaaaccgcaaacaatgagtatgagacaagcagaaaagaaactacgcgacgcactagcgacaggcaacgcagaatacctgggctggcttgtagtcgacgacgagctagtggtggacacctcaaaaatcgcgacagaccaagtaaaagcagtcgaagcagaactaggaactatacgccgatggcgagtcgacgggttctttagcccttcaaagctgcggctgcgcccactccaaatgtcaaaggaaggcatcaagaaagaaagtgcgcccgagctatcaaaaataatagacagaccagggtggctcccagcagtcaacaaactattcagcgatggaaatgtcaccgtagtaagacgggactcactgggccgagtgcgactagaaagcacagcccacctaccggtcacatggaaagtacagtga

SEQ ID NO: 6032 - RNA, 2955 nt, synthetic construct
  misc_feature 1..2955: note = Cas9 variant
  source 1..2955: mol_type = other RNA
atggcccgtatcctagccttcgacatcggcatctccagcatcggctgggccttcagcgaaaacgacgaactaaaagactgcggcgttcgcatcttcacgaaggtcgagaaccccaaaaccggagaatccctcgcccttccccgaagactcgcccgatcagcacgaaaacgtctggcgcgacgcaaagcgagactcaatcacctgaaacaccttatcgcaaacgagttcaaactcaattacgaagactatcaatcctttgacgaatcactcgccaaagcctacaaagggtctctcatctcaccgtacgaactacgatttcgagccctaaacgaactcctcagcaaacaagacttcgctcgcgtgattctccacattgccaaaagacgcggctacgacgacatcaaaaactccgacgacaaagaaaaaggcgcaatactcaaagccattaagcaaaacgaagaaaaactcgcaaactaccaatcagtcggcgaatacctctacaaggaatacttccaaaaattcaaagaaaacagcaaagagttcaccaacgtcagaaacaagaaagaaagctacgaacgttgcatcgcccaatccttcctgaaagacgaactaaaactaatcttcaaaaagcaacgcgagttcggcttctcattctccaagaaattcgaagaagaagtcctaagcgtcgccttctacaaacgggcactgaaagacttctcccacctcgtgggcaactgcagcttctttaccgacgaaaagagagccccgaagaactccccactggcattcatgttcgtagccctcacccgtatcatcaacctcctaaacaacttaaagaacaccgaaggcatactatacacgaaagacgacctcaacgcactcctaaacgaggtgctcaaaaacggcacgctcacgtacaagcaaaccaagaaactcctcggactctcggacgactacgagttcaaaggggaaaaaggcacatacttcattgagttcaagaagtataaagagttcattaaagcactaggggaacataacctcagccaagacgacctgaatgaaatagccaaggacataacactgatcaaagacgaaatcaagctgaagaaagcactcgccaaatacgacctaaaccagaaccaaatcgactccctatccaaactggagttcaaagaccacctaaacatcagcttcaaggctctcaaactggtcacaccactcatgctcgaaggaaagaaatacgacgaagcatgcaacgagttaaacttgaaagtggcaatcaacgaggacaagaaagacttcctgcctgcgttcaacgaaacctactacaaagacgaagtcaccaaccccgtagtactaagagctataaaagagtaccgaaaagtcctcaacgccctcttaaagaaatacggcaaagtccacaaaataaacatcgaactcgcacgagaggtcggcaaaaaccacagccaacgggctaaaatagaaaaagaacaaaacgagaactataaagctaagaaagatgcagaactggagtgcgaaaaactcggcctgaaaatcaactccaaaaacatactcaaactccgcctcttcaaagaacaaaaagaattttgcgcctacagcggcgagaaaatcaaaatctcagacctacaagacgagaaaatgctggaaatagaccacatctacccctacagccgcagctttgacgactcatacatgaacaaggttctagtattcacaaagcagaatcaagaaaaactcaaccagaccccgttcgaagcattcgggaacgactcagccaaatggcaaaagatcgaagtactcgccaaaaacctcccaaccaagaaacagaaaagaatattggacaaaaactataaagacaaagaacaaaagaacttcaaggaccgaaacctcaatgacacacgttacatagcgcgcctcgtcctcaactacaccaaagactaccttgacttcctaccgctatccgatgacgaaaacaccaagctcaacgacacccaaaagggcagcaaggtccacgtggaagcaaagagcggcatgctaaccagcgccctccgacacacatgggggttctcagccaaagaccgaaacaaccacctccaccacgcaatcgacgcggtaataatcgcctacgccaacaactcaattgtaaaggctttctcagacttcaagaaagaacaggaatcaaacagcgcggaactctacgcgaagaaaatatcggaactcgactacaaaaacaaacgcaaattcttcgaacccttctctgggttccgccagaaagtcttagacaaaatcgatgaaatattcgtcagcaaacccgaacgcaagaaaccctccggagcactacacgaagaaaccttccgcaaagaagaagagttctaccaatcctacggcgggaaagaaggcgtactaaaagccctcgagctcggcaaaatacgaaaagtcaacggaaaaatcgtcaaaaacggagacatgttccgcgtagatatcttcaaacacaagaaaaccaacaaattctacgcagtacccatatacacaatggacttcgcattgaaggtcctacctaacaaggcagtcgccagaagcaagaagggagaaataaaagactggatcctcatggatgagaactacgagttctgcttctccctctacaaagacagcctgatccttatccaaaccaaagacatgcaagagcccgagttcgtatactacaacgccttcacatctagcacagttagcctgatagtgtccaaacacgacaacaaattcgaaaccctctccaaaaaccagaagatcctcttcaagaacgccaacgaaaaggaagtaatcgccaaatcaatcgggatccaaaacctcaaagtattcgaaaaatacatagtcagcgccctcggcgaagtcacgaaagccgagttcagacaacgggaagacttcaagaaatga

SEQ ID NO: 6033 - RNA, 3366 nt, synthetic construct
  misc_feature 1..3366: note = Cas9 variant
  source 1..3366: mol_type = other RNA
atgtcggacttggtcctaggcctagacataggcataggctccgtaggcgtcggcatactaaacaaagtcaccggcgaaatcatccacaaaaactcgcgaatttttcccgctgcgcaggcagagaacaacctagtccgccgcacgaaccgccaaggccgcaggctcgcccggcgaaagaaacaccgacgtgtccgcctcaatcgcctattcgaggagtcaggactaatcaccgacttcacaaaaatctctatcaacctgaacccctaccagttacgcgtcaaaggtctaacagatgaactgtcaaacgaggaactgttcatagccctcaaaaacatggtgaaacacagaggcatcagctacctggacgacgcgtccgacgatggcaactccagcgtcggcgactacgcgcaaatcgtaaaagagaacagtaaacaacttgagaccaaaacacccggccaaatccagctcgagcggtatcagacctatggccaactcagaggagacttcacggtcgaaaaagacggcaagaaacaccgcctaatcaacgtcttccccacctcagcctaccgttcggaagccctcagaatcctacaaactcaacaagagttcaacccgcaaatcacagatgaatttatcaaccgctacctcgaaatccttaccggtaaacgaaaatactaccacgggccggggaacgaaaaatctcgcaccgattacggtcgctaccgaaccagtggcgaaactctagacaatattttcggcatcctaataggcaaatgcacattctatccagacgagttccgagccgcgaaagcctcatacaccgcccaagagttcaacctcctcaacgacctcaacaacctaacagtacccaccgaaaccaagaaactaagcaaagaacagaaaaaccaaatcataaactacgtcaaaaacgaaaaagcaatgggccccgcaaaattattcaaatacatagccaaactcctcagctgcgacgtcgccgatatcaaaggctaccgtatagataaatccggcaaagctgaaatccacaccttcgaggcataccgcaaaatgaaaacactagaaacccttgacatagaacaaatggacagagaaaccctagacaaactagcctacgtactcaccctaaacacggagagagaaggtatccaagaagcgctcgaacacgagttcgcagacggttctttcagccaaaaacaagtagacgaactcgtccagttccgaaaggcaaactcgtccatcttcgggaaggggtggcacaacttcagcgtaaagctaatgatggaactcatacccgaattatatgaaacatctgaggagcagatgaccatcctcacccgattaggaaaacagaaaaccaccagttcatccaacaagacaaaatacatcgacgaaaaactcctcacagaagaaatctacaacccagtggtcgcaaaaagcgtacgccaagcaataaaaatcgtcaacgccgctataaaggaatacggagacttcgacaacatagtaatcgaaatggcccgagaaaccaacgaagacgacgagaagaaagccatccagaaaattcaaaaagccaataaagacgaaaaagacgccgccatgctaaaagccgccaaccaatacaacggaaaagcagagcttccgcacagcgtcttccacgggcacaagcaactcgcaaccaaaatcagactatggcatcagcaaggcgagcgctgcctgtacactggcaaaacaatatccatccacgacctcataaacaactccaaccaattcgaagttgaccacatactcccactaagcatcacgttcgacgactccctggcaaacaaagttctggtctacgcaaccgcaaaccaagaaaaaggccaacgcacaccatatcaagccctagactccatggatgatgcctggtcgttccgcgaactgaaggccttcgtacgcgaatcaaaaaccctaagcaacaaaaagaaagaatacctactcactgaggaagacatttccaaattcgacgtacgaaagaaattcatagaacgcaacctggtagacactagatacgcttcccgagtcgtccttaacgctttacaggagcacttccgcgcccataaaatcgacaccaaagtctcagtcgtccgaggccagttcacctcccaactcaggaggcactggggcatcgagaaaacacgcgacacatatcaccaccacgccgtcgatgctctaatcatcgcagcctcaagccaactaaacctatggaagaaacagaaaaacacactggtaagctactccgaggaccagctactagatatcgaaaccggcgagctgatctcagacgacgaatataaagaaagcgtattcaaagcgccataccaacactttgttgacacgctcaaatcaaaagagttcgaagactcaatcctattctcgtaccaggtagactcaaaattcaacagaaaaatctcggacgcaaccatctacgccacccgccaagcgaaagtagggaaagataaggccgacgaaacatacgtcctcggaaagatcaaagatatctatacacaagacggatacgacgccttcatgaaaatctacaagaaagacaaatccaaattcctaatgtatcgacacgacccccaaacctttgaaaaagtaattgaaccaatccttgagaactacccaaacaagcaaatcaacgagaagggaaaagaggtcccatgcaaccccttcctcaagtataaggaagaacacggctacataagaaaatatagcaaaaagggcaacggtcccgagattaaatccttaaaatactacgactcaaaactcggcaaccacatcgacatcacacccaaagacagcaataataaagtcgttctacaatcggtcagcccctggcgggccgacgtctacttcaacaagacaaccggaaaatatgaaatcctgggccttaaatatgccgacctacaattcgagaagggcacgggcacctataaaatatcccaagaaaagtacaatgacatcaagaagaaagagggcgtcgactcggactctgagttcaaattcaccctctacaagaacgacctcctgctagtaaaagatacggaaacaaaagagcaacaactatttcgatttctatcccggacgatgccaaagcaaaagcattacgtagagctcaagccctatgacaaacaaaaatttgaaggcggagaagcgctcatcaaggtccttggaaacgtcgccaactcgggccagtgcaagaaaggactcggcaaatccaacataagcatatacaaagtacgcacagatgtactgggcaatcaacacattatcaaaaacgaaggcgacaaacccaaattagacttctga

SEQ ID NO: 6034 - RNA, 2556 nt, synthetic construct
  misc_feature 1..2556: note = Cas9 variant
  source 1..2556: mol_type = other RNA
atgacaaacggcaagatccttgggctagacatcggcgtagcatccgtcggcgtaggaataatcgaggccaaaaccggtaaggtaatccacgcaaacagccgactcttcagtgcagccaacgcagaaaacaacgcagaacgacgcggcttccggggcgcccgccgcctcacgcgacgcaaaaagcaccgagtcaaacgagtacgagacctgttcgaaaaatacgacatcctaacggacttccgcaacctcaacctaaacccctacgaactccgagtcaaaggcctaaccgaacaactcaccaacgaggaactatttgcagcactacgcacaatagccaagcgacgcggcatctcctacctcgacgacgccgaggacgactcaaccggttcgtccgactacgctaaatcaatcgatgaaaatagacgtcttctcaagagcatgaccccgggccagatccaactagaaaggctagagaaatacggacaactacgcggtaactttaccgtgtacgatgaaaacggagaagcccaccgcctaataaacgtattctcaactagcgactacaaaaacgaagcacggaaaatactagaaacgcaaagcaactacaataaacaaatcacggacgagttcattgaggactacatagaaatactcacccagaagagaaaatactaccacggaccaggcaacgagaagtcgcgcacggactacgggagattccgcaccgacggcacgactttagagaacatatttggaatactcattggcaagtgcagcttctacccagaagaatatcgcgcaagcaaagcctcctacaccgcccaagagttcaacttcctcaacgaccttaacaacctcaaagtccccacagaaacaggcaaattgagcacagaacaaaaagaatacctcgtaaacttcgccaaaaactccaaaaccctcggagcaagcaaacttctaaaagaaatagccaagctagtagacggcgatgtaaaagatatctccggataccgagaagactcaaagggaaaaccagacctgcatacattcgagccctaccgaaaactaaagttcaacctaacgaccgtcgatatcgacaacctaagccgagacatactggacaaactcgccgacatactaaccctaaacaccgaacgcgaaggaatagaagacgcaatcaaccaaaacctaccagagcaatttaccaaagaacaaatatccgaaatcgtccagatccgaaaaagccaatcctccgcattcaacaaaggatggcacagcttcagcgccaaactcatgaacgaactcatccccgagttatacgccaccagtgaggaacagatgaccatactgacccgcctcgaaaaattcaaagccaccaagaaaagctccaaaaacaccaaaaccattgacgaaaaagagataacagacgaaatctacaaccccgtagtggccaaaagcgtccgccagacgataaaaataatcaacgcggcagtcaagaaatacggcgactttgacaaaatagtaatcgaaatgccccgcgacaaaaacgccgacgacgaaaagaagttcatcgacaagaaaaacaaagaaaacaagaaagaaaaagacgactccctaaaacgcgccgcatacctgtacaacgggacggacaaactacccgacgacgtattccatggcaacaaacagctcgcaacaaaaatccgcctttggtaccaacaaggggaacggtgcctctacagtggaaagccaatactcatccaggacctcgtacataacagcaacaatttcgaaattgaccacatactccccttatccctcagcttcgacgacagccttgccaacaaagtgctcgtgtacgcatgggccaaccaagaaaaagagcagaaaacaccatatcaagtaatcgacagcatggacgccgcctggtcattccgcgaaatgaaagactacgtactcaagcaaaagggcatcggcaagaagaaaagggaatacttactcaccaccgaaaacatcgataaaatagaggtcaaaaagaaattcatcgaacggaacctagtcgacacccgctacgcctccagagtagtactcaactcactacaaacagcgctaaaagaactcggaaaagacaccaaggtcagcgtagtccgaggccagttcacctcacaactacgcaggaaatggaaaatagacaagtcccgcgaaacataccaccaccacgccgtagacgcactaatcatagccgcttcaagccagctgaaactctggcagaaacacgagaacctaatgttcgagaactacggagagaaccaagtcgtcaacaaagaaaccggtgaaattctcagcatcagcgacgacgagtacaaagagagcgtattccaaccaccctaccaaggtttcgtcaacacaatctcgtccaaagccttcgaagatgaaatccttttctcctaccaagtcgactccaaattcaacagaaaagtatctgacgcgactatctactccacccgaaaagcaaaactcggcaaggacaagaaggaggaaacctacgtactaggcaaatga

SEQ ID NO: 6035 - RNA, 2598 nt, synthetic construct
  misc_feature 1..2598: note = Cas9 variant
  source 1..2598: mol_type = other RNA
atgcgccacaaaatcggactcgacatcggaatcaccagcgtcggctgggccgtcatcaacctagacataccccgcatcgaagacctcggagttcgcatattcgaccgagcagaaaacccgcagacgggggaaagcctagcactcccgagacgcctagcacgctccgcacgccggcgcctacgacgacgaaagcatcggctcgaaaggatacgccgtctcctaatccgcgaagggatcctcaccaaagaagaactagacaaactattcgaagaaaaacacgaaatagacgtctggcaacttcgcgtagaggccttagaccgcaagctcaacaacgacgaactcgcgcgcgtgctgctgcacctcgccaagagacgcggattcaaatccaacagaaagagcgagcgcaacaacaaagaaaacagtaccatgctaaagcacatcgaagaaaaccgcgcgctactcagcggatacagaaccgtagcagaaatgatagtaaaagacccaaagttcgccttccacaaaaggaacaaaggagaaaactacaccaataccatcgcgcgcgatgacctagaacgcgaaatcaagttaatcttcaccaaacaacgagaatacggaaacatcgtatgcaccgaaacgttcgaaaacgagtacatcatgatctgggctagccagcgaccattcgccagcaaaaacgacatagaaaagaaagtcggattctgcacattcgaaccaaaagaaaaacgagcaccgaaagcaacatacaccttccaatcctttgtggcatgggaacacataaacaaactaagactcgtataccctaccggaactcgcggactcaccgacgaggaacgccgactactctacaaacaagcattccacaaaaacaaaatcacataccacgacatccggacacttctacatctcccagatgacacgtacttcaaggggatagtatatgaccgcggcgccccactaaagcaaagcgagaccatcagatttctagaactcgacgcctaccaccaaatacgcaaagcagttgacaaggtctacggcaaaggaaaaagttcttcattcctcccaatcgacttcgacacatttggttatgctctaaccctcttcaaagacgatgccgacatccgaagctaccttcgcaacgaatacgaacaaaacggcaaacgcatgcccaacctagcgaacaaagtatacgacaacgagcccatcgaagaactgcttaacctctccttcacaaagttcggtcacttatcgctcaaagctctgcgcaacatcctcccatacatggaacagggtgaagtctactccgtcgcctgtgaaagagcaggctacacattcaccggccctaagaagaaacagaaaaccctactgctacccaacattcccccaatcgcaaacccagtagtcatgcgcgccctaacgcaagcacgcaaagtagtcaacgcaatcatcaagaaatacggcagccccgtctcaatccacatagaactcgcccgcgacctcagccagaccttcgacgaacgcagaaaaacaaaacgcgaacaagacgaaaacagaaagaaaaacgaaaccgccattcgccaactaatggagtacgggttaacgataaaccccaccggacacgacatagtaaaattcaaactctggtctgaacagaacggccgatgcgcctactccctgcaaccgatcgaaatcgaaagacttctagaaccaggatacgtagaggttgaccatgtaataccctacagccgaagcctcgacgacagctacacgaacaaagtactcgtcctaacaaaagaaaaccgcgaaaaagggaatcgcatccccgccgagtatctcggagtcggaacagaacgatggcaacaattcaagactttcgtactaacaaacaaacaattctccaaaaagaaacgcgaccgactcctgcgcctccactacgacgaaaacgaagaagccgaatggaaaaaccgaaacctaaacgacacacgatacatatcccgcttcttcgccaacttcatccgagagcacctcaaattcgcagaatccgacgacaaacagaaggtctacaccgtcaacggacgagtaacagctcacctcaggtccagatgggacttcaacaaaaacagagaagaaagcgacctccaccacgcagttgacgcagcaatagtagcatgcacgtccccctccgacatcgcaagagtaacagcattctaccaacgccgtgaacagtgcaaagaaagcgcaaagaaagcagagccccacttcccccaaccctggccccacttcgccgacgaactgcgcgcccgactatccaaaaaccccaaagaaagcataaaagcgctaaacctcggcaactacgacgaccagaagctcgaaagtcttcagccggttttcgtgtcacggatgccaaaacgctcagtcaccggcgccgcgcaccaggagaccctccgacgctacatcggaatcgacgaacgaagcgggaagatccagacggtcgtcaaaaccaagctctcagaaatcaaactggacgaaaccggacacttccccatgtacggaaaagaatctgacccgccagcatccgcctga

SEQ ID NO: 6036 - RNA, 2886 nt, synthetic construct
  misc_feature 1..2886: note = Cas9 variant
  source 1..2886: mol_type = other RNA
atggcacggatactggccttcgacataggcataagcagcatcggatgggcgttctccgaaaacgacgaactcaaggactgcggagtgcggatattcaccaaagccgaaaaccccaaaacaggcgaatcactcgccctcccgcgccggctcgcccgaagcgcccgcaaacgactggcccgcagaaaggcccgcctaaatcacctcaagcatctgatcgctaacgagttcaaactcaattacgaggactaccagtcattcgacgaatccctcgctaaggcttacaaaggctccttaatatccccatacgaacttcggttccgggccctcaacgaactgctgtccaagcaagacttcgcccgtgtcatactacacattgccaaaagaaggggatacgacgacatcaaaaacaacggagatgaagaaaaaggcaagatactcaaggccataaagcaaaacgaagagaaactcgtcaactaccagtcagtgggagaatacctctataaagagtacttccaaaagttcaaagaaaattccaaagagttcatcaacgtcagaaacaagaaggaatcctacgaaagatgcatcacccagagcttcctcaaatacgaacttaaactgatcttccaaaaacaacgagagttcggattctccttctccaagaaattcgaagaagaagttctctccgtcgcgttttacaaacgcgcgctcaaggacttctcccacctcgtcggcaactgctcattcttcagcgacgaaaaacgagccccaaagaactcacccctcgccttcatgttcgtagcactcacgcgcatcataaacctcctaaacaacctaaagaacaccgaaggcatcctgtacacaaaagacgacctgaacgcactcctgaacgaagtgctgaaaaacggaaccctcacctacaagcagacgaaaaagctactaggactatccgacgactacgaatttaaaggcgaaaaaggaacctactttatcgagttcaagaaatacaaagagttcatcaaagcactcggtgaacacaacctgagccaagacgacctgaacgaaatcgccaaggacatcacactgatcaaagacgaaatcaaactcaagaaagcgttggctaaatacgacctgaatcagaatcagatcgactctctgagcaaactagaatttaaagaccacctaaatatcggattcaaagccttaaaactgatcacaccactaatgctggaagggaagaaatacgacgaagcctgcaacgaactcaacctgaaagtggccataaacgaagacaagaaagactttctccccgcattcaatgagacatactacaaagacgaagtaaccaacccagtagtactacgcgcaatcaaagaataccgcaaagtgctgaacgcactactaaagaaatacgggaaagtccacaaaatcaacatcgaactcgcacgcgaagtcggcaaaaaccactcacaacgcgccaaaatcgagaaagaacagaacgaaaactacaaagccaagaaagacgccgagctcgagtgcgaaaaactgggactaaaaatcaacagcaaaaatatactgaaactccgactgttcaaggaacaaaaagagttctgcgcctacagcggcgaaaagataaagctatcagacttacaagacgagaaaatgctggaaatcgaccacatctacccctacagcagatcattcgacgacagctacatgaataaagtcctcgttttcacaaagcaaaaccaggaaaaactcaacaaaaccccattcgaagcattcggaaacgataacgtaaaatggcagaaaatagaagtcctggccaagaacttacccgaaaagaaacaaaaacgcatactcgacaaaaactacaaagacaaggaacagaaagacttcaaagaccgcaacctcaacgacacccgctacatcgcccgcctcgtgctcaattacacaaaagattacctcgacttcctccccctctccgacgacgaaaacacaaagctcaaaggctcaaaagtgcacgtggaagcaaagtctggcatgctcacgagcgcactaaggcacacctgggggttttctaccaaggaccgtaacaatcacctccatcacgccatcgatgcagccataattgcctacgccaacaactccatagtcaaggactttagcgatttcaagaaggagcaggagtcaaacagcgcggaattgtacgctaagaaaatatcagagctcgactacaaaaacaaaaggaaattcttcgaaccgttttctggattcagacaaaaagtactggacaagatagacgaaatcttcgtaagcaagccagaacgcaagaaaccatcgggcgccctacacgaagaaaccttccgcaaagaagaagagttctaccaatcctacggcggcaaggaaggagtcctaaaagccctcgaactcggaaagatccgcaaagtaaacggcaaaatcgtgaaaaacggggacatgttccgggtggacatattcaagcataagaagacaaacaaattctacgccgtccctatatacaccatggacttcgccctcaaagtactgccgaacaaagccgtggcaagaagcaagaaaggcgaaatcaaggactggatcctaatggacgaaaactacgagttctgcttctcactctataaggacagcctcatattaatccaaaccaaagatatgcaggagccagaactcgtttatttcaacgcatttaccagtagcaccgtcagccttatcgtaagcaagcacgacaacaaattcgaaaccctgagcaaaaaccttaaagtgttcgaaaaatacatcgtctccgccctcggcgaagtcaccaaggctgagttccgacaacgcgaagacttcaaaaacgagctacgctga

SEQ ID NO: 6037 - RNA, 2955 nt, synthetic construct
  misc_feature 1..2955: note = Cas9 variant
  source 1..2955: mol_type = other RNA
atggcaaaaattctagcattcgacatcggaatcagcagcatcggctgggcattctctgaaaacgacgaactcaaagactgcggcgtgcgaatcttcaccaaggccgaaaacccaaagacaggcgaaagcctagcgctaccacgccgtatcgcccggtcagcccgaaaacgcctggcacgccgcaaagcccgcctgaaccacctaaagcacctcatagccaacgagttcaaactcaactacgaagattaccagagcttcgacgaaatactcgcaaaagcctataagggctccctaatttccccatacgaactccgattccgcgcacttaacgaactactctcaaaacaagacttcgcccgcgtcatccttcacatagcgaagcgacgaggctacgacgacatcaaaaacaatggcgacgaagaaaaggggaagatactcaaagcgataaaacaaaacgaagaaaagctagccaactaccaatccgtaggcgaatacctctacaaggaatacttccaaaagttcaaggaaaactccaaagaatttatcaacgtccggaacaagaaagaatcctacgaacgttgcatagcacaatctttcctaaaagacgaactgaagctaatcttcaaaaagcaacgcgagttcgggttcagtttcagcaaaaagttcgaagaagaagtcctttcagtcgccttctacaaaagagcactaaaggacttctcccacctcgtgggaaactgctccttcttcaccgacgaaaaacgcgcccccaagaactccccactagcgttcatgttcgtagccctaacaagaattataaacctgctcaacaacctcaaaaacaccctctacacgaaggacgacctcaacgccctactgaatgaagtcctgaaaaacggcacactaacatacaaacaaaccaagaaactactcggcctaagtgatgactacgagttcaaaggagaaaaaggcaactacttcatcgagttcaaaaagtacaaggagttcataaaagccctcggggaacactcactatcccaagatgacctgaacgaaatcgccaaagacatcactcttatcaaagacgaaatcaagctaaagaaagcgctcgcaaaatacgacctcaatgagaaccaaatcgacaacctttccaaactggagttcaaagaccacctcaacatcagcttcaaggcccttaaactcatcacacccctaatgctagaaggtaagaaatacgacgaagcatgtaatgaattgacactgaaagtggcgatcaatgaagacaaaaaggacttcttgcccgccttcaacgagacgtactataaggacgaagtcaccaaccccgttgtactacgcgcaataaaagagtaccgaaaagtccttaacgcccttctcaagaaatacggcaaagtacacaaaatcaacatcgaactcgcccgcgaagtcgggaaaaaccacagccagcgagcgaaaatcgaaaaagagcagaacgaaaactacaaggccaagaaagacgcagaactagagtgcgagaaactaggcctaaaaatcaatagcaagaacatcctcaaactccggcttttcaaagaacagaaggaattttgcgtatactcaggcgaaaagataaaactttccgacctgcaggacgagaaaatgctcgagatcgaccacatctacccatacagcagatcgttcgacgactcctacatgaacaaagtgctagtatttaccaaacaaaaccaggagaaactcaaccaaactccgtttgaagccttcggaaacgactctgccaaatggcagaaaatcgaggtcctagccaaaaaccttcccacgaagaaacaaaaacggatcctcgacaaaaactacaaagacaaggagcaaaaagacttcaaagaccgaaaccttaacgacacccgctacatcgcacgactcgtactgaactacacaaaagactacctagacttcctcccactctcagacgatgagaacaccaagttaaacgacacccaaaaaggatccaaagtacacgtcgaagcaaaatccggaatgctcacctccgcactccggcatacgtggggcttttccacaaaagaccgaaacaaccatctgcaccacgccatagacgcagtaatcatcgcttacgcgaacaacagcatagtcaaagccttctccgacttcaaaaaggaacaagaaagcaataccgcagaactatacgccaagaaaatttctgaactggactacaaaaacaaaagaaaattcttcgaacccttcagcggtttcagacaaaaagtcctcgacaaaatagacgaaatattcgtctcaaagcccgaacggaaaaagccatcaggagccctgcacgaagaaaccttccgcaaggaggaagagttctaccaatcctatggaggaaaggaaggggttctaaaagcactggaactaggcaaaatccggaaggtaaacgggaaaatcgtcaaaaacggagacatgttccgcgtagacattttcaaacacaaaaagaccaacaaattctacgccgtcccaatatatacaatggacttcgccctcaaagtgctaccgaacaaggccgtcgcacgatccaaaaagggcgaaatcaaagattggatactaatggacgaaaactacgagttctgcttctcattatacaaagactcactaatcctaatccaaacaaaggatatgcaagaaccagagttcgtctactacaacgccttcacatcaagcacagtctccctaatcgtcagcaaacacgataacaaatttgaaaccctatccaaaaatcaaaagatcctattcaagaacgcaaacgaaaaagaagtaatagccaaatccatcggcatccaaaacctgaaagtgttcgaaaaatacatagtcagcgcccttggcgaagtgaccaaagccgaatttcgacaacgcgaagagttcaaaaacgaactacgctga

SEQ ID NO: 6038 - RNA, 2955 nt, synthetic construct
  misc_feature 1..2955: note = Cas9 variant
  source 1..2955: mol_type = other RNA
atggcacgcatcctcgccttcgacatcggcatctcgtcaatcggctgggccttctcggaaaacgacgaactcaaagactgcggcgtccgcatattcacaaaggctgaaaaccccaaaaccggcgaatcactggcactaccacgcaggctcgcacgctcagccagaaaacgcctagcccgccgcaaggcgcgcttaaaccgcctcaaacacctcatcgcgaatgagttcaagctaaactacgaagactaccaatccttcgatgaatcactcgcgaaagcctacaaaggctcattaatcagcccctacgaactcagattccgagccctaaacgagctcctctcgaagcaagacttcgcccgggtaatcctacacatagcgaaaagaagagggtacgacgacataaagaactctgacgacaaagaaaaaggagcaatcctcaaggccataaagcagaacgaagaaaagttagccaactaccaatcagtgggggaatacctctacaaagaatacttccaaaaattcaaggagaactccaaagagttcaccaatgtccgaaataagaaagaaagttacgaacgctgcatagcacagagcttcctcaaagacgaactcaaactaatatttaaaaagcaaagagagttcggcttcagctttagtaagaaattcgaagaagaagtcctcagcgtcgccttctacaaacgcgctctaaaggacttctcacacctagtaggcaactgctcgttcttcaccgatgagaaacgcgctccaaagaactccccacttgcattcatgttcgtagcactaacccgcataataaacctgctaaacaacctgaaaaacaccgaaggcatcctatacacaaaagacgacctgaacgcgctactcaatgaatttctcaagaacgggacgctcacctacaagcaaacgaagaaactgctcggcctaagcgacgactacgagttcaaaggagaaaaaggaacctacttcatcgagttcaagaaatacaaagagttcatcaaagcgctaggcgaacacaacctttctcaagacgatctcaatgaaatagccaaagacataacgctaatcaaagacgaaataaaattgaagaaagccctcgccaaatacgacctgaaccagaaccaaatcgactccctcagcaaactagagttcaaagatcacctaaacatatcgttcaaagccctaaaactaataacaccactaatgctggaaggcaagaaatacgacgaagcctgcaacgaactaaacctaaaagtcgcaatcaacgaagacaagaaagacttcctcccagcattcaacgaaacctactataaagacgaagtaaccaatcccgttgtcctccgagccataaaagaataccgcaaagtcctgaatgccctactcaaaaagtacggaaaagtccacaaaataaacatcgaactcgcgagagaagtcggcaaaaattactctcagagggccaaaatcgaaaaggaacaaaacgaaaactacaaggccaagaaagacgcagaactcgaatgcgaaaaacttggactcaaaatcaacagcaaaaacatactaaaactaagactcttcaaggaacagaaggagttctgcgcatactcaggcgagaaaatcaagatctcggacctgcaggacgaaaagatgctagaaatcgaccacatctacccttacagccgcagcttcgacgattcttacatgaacaaagtcctagtcttcaccaaacaaaaccaagaaaaactcaaccagacccccttcgaagcattcggcaatgacagcgccaaatggcagaaaatcgaggtcctagcgaagaaccttcccaccaagaagcaaaaacggatactcgacaagaactacaaagacaaagaacagaaagacttcaaagaccgaaacctcaacgacacccgctacatcgcacggctcgtactcaactacacgaaagactacctcgacttcctccccctcagtgacgacgaaaacaccaagctcaatgacacacacaaaggttccaaagtacacgtagaggccaaatccggcatgctaacgagtgcgctacggcacacatgggggttctcgacaaaagaccgcaacaaccacctaagacacgccatcgacgcagtcataatcgcctacgctaacaattccatagttaaagccttctccgacttcaagaaagagcaagaaagcaactccgcagaactctacgccaagaaaatctccgaactggactacaaaaacaaacgtaagttcttcgagccattctccgggttccggcaaaaagtcctagacaagatcgacgaaatattcgttagcaaacccgaacgcaaaaagccaagcggcgcattgcacgaagaaacattccgcaaagaggaagagttctaccaatcctacggcggcaaggaaggagtactcaaagccttagaactagggaaaatcagaaaagtaaacggaaaaattgtgaaaaacggggacatgttccgagtagacatcttcaaacacaagaaaactaacaaattctacgcagtgccgatctacaccatggacttcgcattgaaagtactacccaacaaagcggtcgcgagatcgaagaaaggagaaataaaagactggatacttatggatgaaaactacgaattttgcttcagcctatacaaagacagcctcattctaatccaaacaaaagacatgcaagaacccgagttcgtgtactacaacgccttcacttctagcaccgtctccttaatcgtaagcaaacacgacaacaagttcgaaaccctctccaaaaaccagaagatcctattcaaaaacgcaaacgaaaaagaagtgatagcgaaatcaatcggcatacagaacctaaaagttttcgaaaaatacatcgtttcggcgctcggagaagtcacgaaagccgagttccgccagcgggaagatttcaagaaatga

SEQ ID NO: 6039 - RNA, 2955 nt, synthetic construct
  misc_feature 1..2955: note = Cas9 variant
  source 1..2955: mol_type = other RNA
atggcaagaatcctggcattcgacatcgggatatcatcgatcggctgggcgttcagcgaaaacgacgaactaaaagactgcggcgtgcgcatcttcacaaaagtagagaacccgaagaccggcgaatctctcgccctaccacgacgactcgccaggagcgccagaaaacggctagcacgccggaaggcgcgtctcaaccacctaaagcacctcatcgcaaacgagttcaagctcaactacgaagactaccaatctttcgacgaatcactagcgaaggcctacaaggggtctctgatctccccatacgaactccgattcagagcattgaatgaactcctgagcaaacaagacttcgcacgggtaatactacacatcgccaaacgacgtggctacgacgacatcaaaaattctgacgacaaagaaaagggggcaatcctcaaggcaattaaacaaaatgaggaaaagctcgcaaactaccaatccgtgggcgaatacctgtacaaagagtacttccaaaaattcaaagaaaactccaaagagttcaccaacgtacgcaacaagaaagaaagttacgagcgctgcatcgcgcagagcttcctgaaagacgaactaaaactaatcttcaagaaacagcgagagtttgggttctcgttctcgaagaaattcgaagaagaggtcctaagtgtcgccttctataaacgggcgctcaaagacttcagccacctcgtgggcaactgctccttcttcaccgacgaaaagcgcgcgcctaaaaattcacccctggccttcatgtttgtcaccctaacgcgaataatcaacctactaaacaacctcaaaaacacggaagggatcctatacaccaaagacgacctgaacgcactccttaacgaagtcctgaaaaacgggacactaacctacaaacaaacgaaaaagctgctcggcctctcggacgactacgagttcaaaggcgaaaagggaacctacttcatcgaatttaaaaagtacaaggagttcataaaagccctgggagaacacaatctttcccaagacgatctaaacgaaatcgccaaggacataaccctcattaaggacgaaatcaaactcaagaaagctctggccaaatacgacctcaaccaaaatcagattgattccctgagcaaactcgagttcaaagaccacctaaacatctcgttcaaggcactcaaactaataacccccttaatgctagaaggcaaaaagtacgatgaagcatgcaacgaactaaatctgaaggtagccataaacgaagacaagaaagacttcctgcccgccttcaatgagacgtactacaaagacgaagtgacaaaccccgtcgtcctgcgcgctataaaagaatacagaaaagtactcaacgctctactgaagaaatacggcaaagtccacaaaatcaacattgaactcgcacgcgaagtcggcaaaaaccactcgcaacgagccaaaatagaaaaagaacaaaacgaaaactacaaagccaagaaagacgcagaactcgaatgcgaaaaactgggattaaaaatcaacagcaaaaacatcctgaaactacgcctattcaaagaacaaaaggagttctgcgcatactccggcgagaaaattaaaatctccgacctacaagacgagaaaatgctcgaaatcgaccacatctacccctacagccgcagcttcgacgattcatacatgaacaaagtacttgtgttcaccaaacaaaaccaggaaaaactgaacaagacaccattcgaagccttcggcaacgactcagccaaatggcaaaagatcgaagtgctggccaagaacctccccacaaagaaacagaaacgcatactagacaaaaattacaaagataaagaacagaaagacttcaaagataggaacctcaacgacaccagatacatagcacgactcgtcctaaactacacgaaagactaccttgatttcctccccctctccgacgacgaaaacaccaaattaaatgacacccagaagggctctaaagtgcacgtagaagccaaatcaggcatgctgacgtccgcgctccgccatacatggggcttctcgaccaaagaccggaacaaccacctccaccacgctatagatgcagtcataatagcctacgcgaacaattcgatcgtaaaagcattttccgacttcaagaaagaacaagaaagcaattcagccgaactctacgcaaagaaaataagcgaactggactacaaaaacaaacgcaaattcttcgaacccttctccgggttcagacaaaaagtcctggacaaaatcgatgaaatctttgtgagtaagccagaacgcaaaaagccttccggcgccctccacgaagagaccttccgaaaagaggaggagttctaccaaagctacgggggcaaggaaggagtcctgaaagccctcgagctcgggaaaatacgaaaagtaaacggcaaaatagtcaaaaacggcgacatgtttcgagtagacatcttcaaacacaagaagaccaataagttctacgccgtccccatctacaccatggacttcgcactcaaggtcctgcccaacaaggccgtggcacgctccaagaagggcgaaatcaaggactggatcttaatggatgagaattacgagttctgcttctccctgtacaaagactccctaatactcatccaaaccaaagacatgcaagaacccgagttcgtctactacaacgcattcaccagctcgaccgtcagcctcatcgtgtcaaaacacgacaacaaatttgaaacactatccaagaaccagaaaatcctcttcaagaacgccaacgagaaagaagtgatcgcaaaatcaatcggaatccaaaacctaaaagtcttcgaaaaatacatcgtcagcgccctaggagaagtgacaaaggcagagttccgacagagggaagactttaagaagtga

SEQ ID NO: 6040 - RNA, 2955 nt, synthetic construct
  misc_feature 1..2955: note = Cas9 variant
  source 1..2955: mol_type = other RNA
atggccagaatactcgccttcgacataggcatttcatcgatcggctgggccttcagcgaaaacgacgaactcaaggactgcggagtccgtatcttcacaaaggccgagaacccaaagacaggggagtcccttgccctaccgagaaggctagcacgctccgcccggaaaagacttgcacgacgcaaagcgcgtctaaaccacctcaaacacctcatcgccaacgaatttaaattgaactacgaagactaccaatccttcgacgaaagcctcgccaaagcatacaagggctcccttatatcaccatacgagctccgattccgcgccctcaacgagctactctcgaaacaagacttcgcaagagtaatcctccacatagcaaagaggaggggttacgacgatatcaaaaactccgacgacaaagagaaaggcgccatactcaaggccataaagcagaacgaagagaaactcgcaaattaccaatcagtcggagaatacctgtacaaggagtacttccaaaaattcaaagaaaacagcaaagaatttacaaacgtgaggaacaagaaagagagctacgaacgatgcatagcccaatcgttcctgaaagacgaactaaaattaatcttcaagaaacaacgagagttcggattttccttttccaagaaattcgaagaagaggtcctctccgtggccttctacaaaagagcgcttaaagacttcagccacctagtaggaaactgctcatttttcaccgatgaaaaacgcgcgcccaaaaacagccccctagccttcatgttcgtagcactaacccgcatcattaatctactcaacaaccttaaaaacacggaggggatcttatacacaaaagacgatctcaacgcactcctcaatgaggtcctcaaaaatggaacactaacatacaaacaaacaaagaaactactggggctctccgacgactacgagttcaaaggcgaaaaaggtacatactttatcgagttcaagaaatacaaagagttcataaaagcactcggagaccactccctctcacaagacgacctcaacgaaatcgcaaaagacataacactaatcaaagacgaaataaagctcaagaaagccctggcgaaatacgacctaaatcagaatcaaatagactcactctccaaactcgagttcaaagaccacctcaacatctccttcaaggcactcaagctgatcacgccactaatgctggaagggaaaaagtacgacgaagcctgcaacgaactgaacctcaaggtcgcgatcaatgaagacaaaaaggacttcctacccgcattcaacgagacgtactacaaagacgaggtgacgaacccagtggtccttcgagcaatcaaggagtaccgaaagattctcaacgcgctcctcaaaaagtacggaaaggtacataagatcaacattgaactcgcacgtgaggtcggcaaaaaccacagccaaagagccaagatcgaaaaagagcagaatgaaaattacaaggccaaaaaggacgcagaaatcgaatgtgaaaaactaggccttaaaataaacagcaaaaacatcctgaagctacgcctgttcaaagaacaaaaggagttctgtgcatacagcggagaaaagatcaaactcagcgacctccaagacgagaaaatgctcgaaattgaccacatctacccatattcccgcagcttcgacgactcctatatgaacaaagtcctcgtcttcacaaaacaaaaccaagaaaaactaaacaaaaccccattcgaagccttcggaaacgacagcaccaagtggcagaaaatcgaagtcctcgcaaagaacctgcccgaaaagaaacagaaaagaatactagacaaaaactacaaagacaaagaacaaaaagatttcaaagaccgaaatcttaacgacaccaggtacatcgcgcggctcgtactaaactatacgaaagactacttagactttctcccgcttagcgacgacgaaaacaccaagctcaacgacacccaaaaaggctcgaaagtccacgtagaagctaaatcaggcatgctcacgagcgccctacgccacacctgggggttctcggccaaggaccggaacaaccacctccatcacgcaatcgacgcggccataatcgcctacgctaacaatagcatagtcaaagcattctccgacttcaagaaggagcaagaaagcaacagcgtggaattgtatgcgaagaagatatcggaactagactacaaaaacaaaagaaaattcttcgaaccattcagcggatttcgccaaaaagtcctggataagatagacgagatattcgtatcaaaaccagaacgaaagaaaccatccggagccctgcacgaagagacattccgtaaagaggaagagttctaccaatcctacggagggaaagaaggagttctcaaagccctggaacttggaaaaatcaggaaggtcaacggcaagatcgtcaaaaatggcgatatgttccgagtagacatcttcaagcacaagaaaacaaacaaattctacgccgtccccatctacaccatggacttcgcactcaaggttttacccaacaaagcagtcgcgcgatccaaaaagggggaaatcaaggactggatactcatggatgaaaactacgagttctgcttctcgctctacaaagacagcctgatcctcatccaaaccaaagacatgcaagaacccgaacttgtatacttcaacgccttcactagctccaccgtctctctcatcgtatcaaagcacgacaataagttcgaaaccctatctaagaaccaaaagatactattcaaaaacgccaacgaaaaggaggtcatcgcgaaatcgatcggaatacaaaacttgaaggtattcgagaaatacatagttagcgcgctcggagaggtgacaaaagccgagttccgccagagagaagacttcaaaaagtga

SEQ ID NO: 6041 - RNA, 2955 nt, synthetic construct
  misc_feature 1..2955: note = Cas9 variant
  source 1..2955: mol_type = other RNA
atggctcgcatcctagcgtttgacatcggaattagctccattggatgggcattctcggaaaacgacgaactcaaagattgcggcgtgagaatcttcaccaaagtcgaaaatcccaaaacaggagaatccctagccctaccacgccgcctagcgcgctcagcccgcaaacgcctcgcccgaagaaaagcccgactaaaccacctcaaacacctcatagccaacgagttcaaactcaactacgaagactatcagtccttcgacgaaagcctcgcaaaagcctacaagggctccttgatcagcccatacgaactccgtttccgagccctcaacgagctcctatcgaaacaagacttcgcacgcgtaatcttgcatatagccaagcggcgaggctacgacgatatcaaaaactcagatgacaaagaaaagggcgcaatactcaaagccataaaacagaacgaagaaaaacttgcgaactaccagtcggtaggagagtacctctacaaagaatactttcagaaattcaaagaaaactccaaggagttcacaaacgtccgcaacaagaaagaatcatatgaacgctgcatcgcccaatcgttcctaaaagacgaactcaagctcatattcaagaagcagcgggaatttggattctcattctcaaagaaattcgaagaggaagtcctgtccgtcgccttctacaaacgggccctcaaagattttagccatctcgtaggaaactgctccttcttcacagacgagaaacgcgcgccaaagaactcacccttagcatttatgttcgtcgctctcaccagaatcatcaacctcctgaacaacctcaaaaacaccgagggaatcctgtacaccaaggacgacctcaatgccctcctcaacgaagtcctcaaaaatggaaccttaacatataaacaaacaaagaaactcctaggactgagcgacgactatgagttcaaaggagaaaaaggaacctacttcatcgaatttaagaaatataaggaatttatcaaagcgctaggagaacacaacctatcacaggacgacctaaatgaaatcgcaaaagacatcacgctcatcaaggacgagatcaaactcaaaaaggccctagcgaagtacgacctcaaccaaaaccaaatagattctctgagcaaactcgagttcaaggaccacctcaacatctccttcaaagccctcaagctgataacgcccctcatgctagaaggaaagaaatacgacgaagcatgcaacgaactcaacctcaaagtggccatcaacgaagacaagaaagactttctgccagctttcaacgaaacctactacaaagacgaagtcaccaacccagtcgttctacgcgcgatcaaagaataccgaaaagtcctaaacgccctgctcaagaaatacggtaaggtccacaagatcaacatcgaactcgcccgggaggtcgggaaaaaccactcgcaaagagcaaaaatcgaaaaagaacaaaacgagaactacaaggcgaagaaggacgccgagctagagtgcgaaaaactgggacttaaaattaactccaaaaacatcctaaaactgcggctgttcaaagagcagaaggagttctgcgcctacagcggagaaaagattaaaatctccgatctacaagacgagaaaatgctcgaaatcgaccacatctacccttactcaagatcctttgacgactcatacatgaacaaagtcctagtgttcaccaaacaaaaccaagaaaaactcaataaaacaccattcgaagccttcggcaacgactccgcaaagtggcagaaaatagaagtcttggcgaaaaacctgccaaccaagaaacaaaaacgtatactcgacaaaaactacaaagacaaggaacaaaaggacttcaaggatcgcaacctgaacgacaccagatacatagccagactcgtcctcaactacaccaaggactacttagactttctcccccttagcgacgacgaaaacaccaaactcaacgacacccagaagggatccaaggtccacgtggaagccaaatcgggcatgctcacaagcgcgctccggcatacatggggattctctacgaaagaccgaaacaaccaccttcaccacgcaatcgacgcggtcatcatcgcctacgccaataattcaatcgtcaaggccttctccgacttcaagaaagaacaggagtccaactccgccgaactctacgcaaagaaaatctccgagctagactacaaaaacaaacgaaagttcttcgagcccttcagcggattcagacagaaagtcctggacaaaatcgacgagatattcgtatccaaaccggagcgaaagaaaccctcaggtgccctccacgaagagacttttagaaaagaggaggagttctaccaatcatacggtggaaaagaaggagtccttaaagccctcgaactaggtaaaatacgcaaagtcaacgggaaaatcgtcaaaaacggcgacatgttccgcgtagacatcttcaaacacaagaaaactaacaaattctacgcagtccccatatacaccatggatttcgcactcaaagtcctgcccaacaaagccgtcgcccgcagcaagaaaggcgaaatcaaagactggatcctcatggacgaaaactacgagttttgcttctcactctacaaagactccctgatcttgatccagaccaaagacatgcaagaaccggagttcgtctactataatgcgttcacgagctcgacagtgtccctcatcgtcagcaaacacgacaacaagtttgaaaccctgtcaaagaaccagaagatcctattcaaaaacgccaacgaaaaagaggtcattgccaaatcgataggcatacaaaacctaaaggtcttcgagaagtatatcgtcagcgcactaggcgaagtgaccaaagccgagttcaggcaacgcgaagacttcaagaaatga

SEQ ID NO: 6042 - RNA, 2955 nt, synthetic construct
  misc_feature 1..2955: note = Cas9 variant
  source 1..2955: mol_type = other RNA
atggcccgcatcctggcattcgacattggcatctcgtccatcggctgggcattctccgaaaacgacgagctcaaggactgcggcgtgcggatcttcacgaaagcggagaacccaaagacgggcgaatctctggcgctcccccgcagactagccagatccgcccgaaaacgcctcgcccgcaggaaggcgcgactgaaccacctcaaacacctaatcgccaacgaattcaaactcaactacgaggactaccaatcattcgacgaatccctcgcaaaagcctacaagggctcactcatatcaccgtacgaactacggtttcgagcacttaacgaactcctatcaaaacaagacttcgcgcgagtcatattacacatcgccaagagacgagggtacgacgacataaaaaattccgacgacaaagagaagggagcgatactaaaagccataaagcaaaacgaggaaaaactcgcaaactaccagtccgtcggagaatatctatacaaagagtacttccaaaaatttaaagaaaactccaaggaattcaccaacgttaggaacaaaaaagaatcgtacgagcgatgcatcgcacaaagcttcctgaaggacgagctaaaacttatattcaaaaaacagcgcgaattcgggttctccttctccaaaaaattcgaggaagaagtactaagcgtggccttctataaacgggcactaaaagacttcagccacctcgtcggcaattgcagcttctttaccgacgaaaagcgcgcgcccaaaaactcccccctcgccttcatgttcgtcgcactcacccggatcatcaacctcttaaacaacctcaaaaacaccgaaggaatattatacacgaaagacgacctcaacgcactcctaaatgaagtgctgaaaaacggcacgctcacatacaaacaaaccaaaaaactcctaggactgagcgacgactacgaattcaagggcgaaaaaggcacatacttcatcgaattcaagaaatacaaagaattcatcaaggcgctcggtgaccacagcctttcacaagacgatcttaacgaaatagcaaaagacataaccctaatcaaagatgagatcaagctcaagaaagccctcgcaaagtatgacctaaaccagaaccaaatcgactccctcagcaagctcgagttcaaagaccacctcaacatctcattcaaagccctaaaactcatcacaccccttatgctggagggcaaaaagtacgacgaggcctgcaacgaactgaacctaaaagtagctataaacgaagacaagaaagacttcctgccagcattcaacgaaacgtactacaaagacgaagtaacaaaccccgtggtgcttcgcgccatcaaagaatatcgaaaagtcctcaacgccctgctcaagaaatacggcaaagttcacaagataaacatcgaactagcacgggaagttggtaagaactactcccaacgagccaagatagagaaagaacagaacgaaaactacaaagccaaaaaggacgccgaactggaatgcgagaagctcggcctcaaaattaactccaaaaacatcctcaaactccgccttttcaaggagcaaaaagagttctgcgcttacagcggcgaaaagattaaaatcagcgacctccaagatgagaagatgctcgaaatcgatcacatatatccttacagccggtccttcgacgacttctacatgaacaaagtcctagtattcacgaaacagaaccaagagaaactaaaccaaactccgttcgaagcattcggcaacgacagcgccaaatggcagaaaatcgaagtactagccaagaacctgcccacaaaaaaacaaaaaagaattctcgacaaaaactacaaggacaaggaacagaaggacttcaaagaccgcaacctaaacgacacaaggtatatagcccgcctcgtactaaactacacaaaagactatctcgacttcctacccctctccgacgacgagaacaccaaactaaacgacacacaaaagggctccaaagtgcacgtcgaagccaaatcaggcatgctaactagtgccctgcggcacacgtggggcttctccgcaaaagaccgcaacaaccacctgcaccacgccatagacgcagtaataatcgcctacgccaacaacagcatagtgaaagcctttagcgacttcaagaaagagcaagaaagcaacagcgccgagctctatgccaaaaaaatctccgaattggactacaaaaacaagcggaagttctttgagccattttccggcttccgacaaaaggtcctagacaagatcgacgaaatattcgtaagcaaaccagagcgaaaaaaaccttcaggagccttgcacgaagaaaccttccgtaaagaagaggaattttaccaatcctacggtgggaaagaaggagtactcaaagcgcttgaactcgggaaaatccgcaaagtcaatggcaagatcgtgaaaaatggcgacatgttccgcgtggacatcttcaaacacaagaaaaccaacaagttctacgcagtacccatatacaccatggactttgccctaaaggtgcttcccaacaaagccgtagcacgctccaagaaaggagaaataaaggactggatccttatggatgaaaactacgaattctgcttctcactctacaaagacagcctaatactgatccaaaccaaagacatgcaagaaccagagttcgtatactacaacgcgttcacgagctcgacagtaagcctcatcgtatcgaagcacgacaacaaattcgagacactgtccaaaaaccaaaagatactattcaaaaacgcaaacgaaaaagaagtcatcgcaaaaagtatcggaatccaaaacctgaaggtattcgaaaaatacatagtctcggcccttggtgaagttacaaaagcagaattccgccaacgtgaagatttcaagaaatga

SEQ ID NO: 6043 - RNA, 2955 nt, synthetic construct
  misc_feature 1..2955: note = Cas9 variant
  source 1..2955: mol_type = other RNA
atggcccgaatactcgcgttcgacatagggatatcgtccataggttgggcattctcagaaaacgacgagctcaaagactgcggcgtccgaatctttacaaaggccgaaaacccaaagacgggggaatcgctagcactaccccgaaggctagcgcgatcggctcgcaaaagactagcccgccgcaaagcccgcctgaatcacctcaagcacctgatagccaacgagttcaaactcaactacgaggactaccaatcgttcgacgaatccctggcgaaggcctacaagggctcacttatctctccatacgaactcagattccgagcgctcaacgaactcctaagcaaacaagacttcgcgagagtaatactccacatcgccaagcgcagaggttacgacgacatcaagaactcggacgacaaggaaaaaggggccatcctaaaagctatcaaacaaaatgaagaaaaactcgctaactaccaaagcgtcggtgagtacctctacaaagaatacttccaaaaatttaaagaaaacagcaaggaatttaccaacgttaggaataagaaagaatcctacgaaagatgcattgcccagagcttcctaaaagacgagctcaaactgatcttcaagaaacaaagagagttcggattctcgttttcgaaaaagttcgaggaggaagtcttgtcagtagccttctacaagcgagcgctaaaggacttctcccacctagtcgggaactgctcattcttcaccgacgagaaacgcgcccccaagaactcgcccctcgccttcatgttcgtcgcactcacgcgcatcatcaacctgctaaacaaccttaaaaacacagagggcattctctacaccaaagacgatctcaacgcgctcctaaacgagttcctcaaaaacggcaccctaacatacaagcaaacaaagaaactcctcggcctctctgacgactacgagttcaaaggcgaaaaaggaacctacttcatcgagttcaagaaatacaaagagttcatcaaagccctcggtgaacacaacttaagccaagacgacctgaacgaaatcgccaaagacataactctaatcaaggacgaaatcaagctcaagaaagccctagcaaaatacgacctcaaccagaaccaaatcgacagcctaagcaaactcgagttcaaagaccacctcaacatatccttcaaggccttgaaactgatcaccccactcatgctcgaaggaaagaaatacgatgaagcatgcaacgaactaaacctcaaaatagccatcaacgaagacaaaaaggacttcctaccagcattcaacgaaacatactacaaagacgaagtaacgaaccccgtggtcctgcgagcaataaaagaataccgcaaagtactaaatgcactcctgaaaaagtacggaaaagttcacaaaataaacattgaactcgcccgcgaagtcggcaagaaccactcgcagcgagctaaaatcgaaaaagaacaaaacgaaaactacaaggccaaaaaggacgcagagctagaatgcgagaaactgggactaaaaatcaactccaaaaacatactaaagctccgcctcttcaaagaacagaaagagttctgcgcctactccggagaaaagatcaagatatccgacctccaagacgaaaagatgctcgaaatagaccacatctacccgtactcccgctccttcgacgactcctacatgaataaagtcctagtcttcaccaaacagaaccaagaaaaactcaaccagaccccattcgaagccttcggaaacgactccgccaaatggcagaaaatcgaagtgttagccaaaaacctgccaaccaagaaacaaaaacgcatcctcgataaaaattacaaagacaaagaacaaaagaattttaaggaccgaaacttaaatgacactagatacatagcccgcctggtcctgaactacacaaaggactatctggacttcctcccactctcagatgacgaaaataccaaactcaacgacacacagaagggctcgaaagtacacgtcgaagccaaatcgggcatgcttacgtccgctctccggcacacatggggcttcagcgccaaagacaggaacaaccatctgcaccacgccatagacgcggtaatcattgcatacgccaacaactccatagtcaaagccttcagcgacttcaagaaggaacaggaaagcaactccgccgaactgtatgccaagaagatatccgaactggactacaaaaacaaacgcaagttcttcgagcccttcagcggcttccgacaaaaagtactcgacaaaatagacgaaatctttgtctcaaagcccgaacgcaagaaaccttcgggagcactacacgaagaaacatttcgcaaagaggaggagttctaccagtcctacggaggcaaagaaggagttcttaaagccctcgaactcggtaaaatacgcaaagtaaatggcaaaatcgtaaagaacggagacatgttcagggtggacatattcaaacacaagaaaaccaacaaattttacgcagtccccatctacacgatggatttcgcgctcaaggtcctcccaaacaaagccgtagcacgatcaaagaaaggagagataaaagattggatacttatggacgaaaactacgagttctgcttctcactatacaaagactccctcatcctaatacaaacaaaggacatgcaggagcccgagttcgtatactacaacgcctttacctcctctacggtaagcctcatagtatcgaagcacgacaacaagttcgaaacactcagcaagaatcagaaaatactattcaagaacgccaacgaaaaggaagtgatagcgaaatcaatcgggatccaaaacctaaaggtcttcgagaaatacatcgtaagcgcattaggagaggtaacaaaagccgagttccgccagcgcgaagacttcaagaagtga

SEQ ID NO: 6044 - RNA, 2955 nt, synthetic construct
  misc_feature 1..2955: note = Cas9 variant
  source 1..2955: mol_type = other RNA
atggtcagaatcctggcgttcgacatcggaatcagctccatcggatgggccttcagtgaaaacgacgaactcaaggattgcggcgtcagaatattcactaaggtcgaaaacccgaaaaccggggaaagcctcgccctaccacgccgcctcgcgcggtcggccaggaagagacttgcccgccgtaaagcccgcttgaaccacctcaaacacctcatagccaacgagttcaagctaaactacgaggattaccaatcattcgacgagtccctcgcgaaagcatacaaaggtagcctaatcagcccatacgaactccgcttccgggcactcaacgaactcctatcaaaacaagacttcgcgagagtcatactccacatcgctaaaaggcggggctacgatgacatcaagaactcggacgacaaagaaaaaggagcgatcttgaaagccatcaaacaaaacgaggaaaagctcgcaaactaccagtcagtcggagaatacctatataaggagtacttccaaaaattcaaagaaaactccaaggagttcacaaacgtccgaaacaagaaagaaagctatgaacgatgcatcgcccagagcttcctcaaagacgaactaaagctaatcttcaagaaacagcgcgagttcgggttctccttctcaaagaaattcgaagaagaagtcctcagcgtcgctttctacaaacgggccctcaaagacttcagccaccttgtgggcaactgctcattcttcaccgacgagaaacgggcaccgaaaaactcaccactcgccttcatgttcgtagccttgacacgaattatcaaccttctaaacaacctcaaaaacaccgaaggcatcctatacacgaaagatgacctaaacgccctactaaatgaagtgctgaaaaacggcaccctaacgtacaagcaaacaaagaaactactgggtctgagcgacgactacgagttcaaaggcgaaaagggcacatacttcatagagttcaagaaatacaaagagttcatcaaggcgctcggcgaacacaacctcagccaagacgacctaaatgaaatagccaaggacataaccctaatcaaggacgaaataaaactcaagaaagccctcgccaaatacgacctaaaccaaaaccagatagactccctaagcaaactggagttcaaagaccaccttaatatatccttcaaggccctcaaactaatcacgccactaatgctagaaggcaagaagtacgacgaagcgtgcaacgaactcaacctaaaggtagccattaacgaagacaagaaagacttcctccccgccttcaacgaaacatactacaaagacgaagtcaccaatccggtcgtgctgcgagcaattaaggaatacaggaaagtactgaacgccctcctcaagaaatacggcaaagtacacaaaataaacatcgaactcgctcgcgaggtcggcaaaaaccactcacaacgagccaaaatcgagaaagaacaaaatgaaaactacaaagccaagaaagacgccgaacttgaatgcgaaaaactcggcctcaaaataaactctaaaaacatactaaaattgagactcttcaaagaacaaaaagagttctgcgcctactcgggggagaaaatcaagattagcgacctccaagacgagaaaatgctcgaaatagaccacatatatccctacagccgcagcttcgatgactcatacatgaacaaagtcctcgtcttcacaaagcagaaccaggaaaaattaaacaaaaccccctttgaagccttcggaaacgactccgccaagtggcagaaaatcgaagtactggccaaaaacctacccacaaagaagcaaaaacgaatcctcgacaagaactacaaggataaagaacaaaaagacttcaaagacaggaacctgaacgacacgagatacatagcacgactcgtcctgaactacaccaaagactacctcgacttcctcccactctccgacgatgaaaacacgaaattaaatgatacacagaaaggctcgaaagtgcacgtcgaagcaaaaagtggaatgctcaccagcgcactacgacacacatggggattcagcaccaaggaccgcaacaaccacctccaccacgcaatagacgctgtcataatcgcctacgctaacaactcgatcgtcaaagcattcagcgacttcaaaaaggaacaggagagcaactcggcagaactatacgccaagaaaatctccgaacttgactacaaaaacaaacgaaaattcttcgaaccattctcaggatttcgccaaaaggtcctcgacaaaatcgacgagatattcgtctccaagcccgagcgcaagaaaccctccggcgctttacacgaagaaaccttccgcaaagaggaagagttctaccaatcttacggaggcaaagaaggcgtcctgaaagcgctagaactcgggaaaatacgcaaagtgaacgggaaaatagtcaagaacggcgacatgtttcgcgtagatatcttcaagcacaagaaaacgaataaattttacgcggtccccatatacaccatggatttcgcactgaaggtactacccaataaagcggtagcccgctctaaaaagggcgagataaaggactggatcctaatggacgagaactacgagttctgcttttccctgtacaaggattccctgatcctgatccaaaccaaggacatgcaggaacccgaatttgtatactacaacgccttcacaagcagcacagtctcactaatcgtaagcaagcacgacaacaaatttgagaccctcagtaagaaccagaaaatcctattcaaaaacgccaacgaaaaagaagtaatcgccaaaagcatcggcatccaaaaccttaaggtatttgaaaaatacatcgtctccgccctgggcgaggtcacaaaagccgagttccggcaacgcgaagacttcaagaaatga

SEQ ID NO: 6045 - RNA, 2955 nt, synthetic construct
  misc_feature 1..2955: note = Cas9 variant
  source 1..2955: mol_type = other RNA
atggccaggatcctcgcatttgacatagggataagctccatcggatgggccttcagcgagaacgacgaactaaaagactgcggagtacgcattttcaccaaagcggaaaatccaaaaaccggcgaatcactcgccctcccacggcggctcgcccgatccgcacgtaaaagactagcccgccggaaagcccgcctgaaccacctcaaacaccttatagcaaacgagttcaaactcaactacgaggattaccagtccttcgacgaatccctagcaaaagcctacaagggtagcttaatctccccatacgaactccgcttccgcgcgttaaacgagctgctatccaaacaagacttcgcgcgagttatcctccacatagccaagaggcgcggatacgatgacataaagaactccgacgataaagagaaaggcgccatcctcaaggccatcaagcagaacgaggaaaaactggcaaattaccaatccgtcggggagtacctctacaaagagtacttccaaaaatttaaagaaaactccaaagagttcacaaatgtccgcaataagaaagagagctacgaaaggtgcatagcacagagcttcctaaaagacgaactcaaactcatcttcaagaaacaaagagagttcgggttctctttctccaagaaattcgaagaagaagtcctttccgtcgccttctacaaacgagcccttaaagactttagccatctagtcggcaactgctcgttcttcaccgacgaaaagcgcgcgcccaagaactcacccctcgcattcatgttcgtggccctaacccgcatcatcaacctcctgaacaacctcaagaatacggaaggaatcctatacaccaaagacgacctcaacgcactactaaacgaagttctaaagaacggcaccctaacatacaagcaaactaaaaagctcctaggactctccgacgactacgaatttaaaggtgaaaagggcacatacttcatcgaatttaagaaatacaaagagttcatcaaagcacttggcgaccatagcctctcacaggacgacctcaacgagatagcaaaagacatcaccctgataaaagacgagataaaacttaagaaagcactagccaagtacgacctcaaccagaaccaaatcgactccctcagcaaactagagttcaaggaccacctcaacatatcattcaaggcactcaaattgatcacgcccctaatgctcgaaggtaagaaatacgacgaagcatgcaacgaattgaacctgaaagtggccatcaacgaagacaagaaagacttcctcccggccttcaacgaaacgtattacaaagacgaagtgaccaatccggtcgtcctacgagcgattaaagagtatcgcaaagtcctaaacgccctactcaagaagtatggaaaagtccataagataaacatcgagctcgcacgggaagtcggaaagaactactcacaacgcgccaaaattgaaaaagagcaaaatgaaaactacaaggccaagaaagacgccgagctcgaatgcgagaaactgggcctgaaaatcaacagcaaaaacatcctcaaactgcggctattcaaggaacaaaaagagttctgcgcctactcaggagaaaagatcaaaatatccgacctgcaagacgaaaagatgctagaaatagaccacatctacccctactcacgcagcttcgacgactcatacatgaacaaagtcctagtcttcacaaagcagaaccaagaaaaactcaatcagacgccattcgaagcgttcggtaacgactcagccaaatggcagaaaatagaggtcctagccaaaaaccttccaaccaagaaacaaaaacgaatactcgacaaaaactacaaagataaggaacaaaaagacttcaaagaccgcaacctcaacgacacaagatacatcgccaggctcgtactcaactacacaaaggactacctcgacttccttcctctatcggacgatgaaaacacaaagctcaatgacacccaaaagggaagcaaagtccacgtagaagctaagtccggaatgttaacatccgcgctccgccacacatggggcttcagcgccaaagaccgaaacaaccacttgcaccacgcgattgacgccgtcatcatcgcatacgcgaataactccatcgtcaaggccttctccgatttcaagaaagagcaggagtccaacagcgcggaactctacgctaagaaaatctccgagctcgactacaaaaacaaacgcaaattcttcgagcctttttccggattccggcagaaagtgttagacaaaatcgacgagatcttcgtctcgaagccggaacggaagaaacccagcggagcactacacgaagaaaccttcaggaaagaggaagagttctaccaaagctacggcggcaaggaaggggtcctcaaagcgctagaactcggaaagatccgtaaggtcaacggaaaaatagtaaagaacggcgacatgtttcgcgtcgacatcttcaaacacaaaaagaccaacaagttctacgcagtccccatctacaccatggacttcgcacttaaagtcctacccaacaaagccgtcgcacgatctaagaaaggtgaaatcaaagactggatcctgatggacgaaaattacgagttctgcttctccctgtacaaagactccctaatcctaatacaaacgaaagacatgcaagaaccagaatttgtctattacaatgcattcacgagttcaaccgtcagcctcatcgtgagcaaacacgataacaagtttgagactctatcgaaaaaccagaagatactcttcaaaaacgccaatgaaaaggaagtcatcgcaaagtcgatagggatccaaaacttaaaggtcttcgaaaagtacatagtctccgccctaggagaagtgacgaaggcagaatttcggcagagagaagatttcaagaaatga

SEQ ID NO: 6046 - RNA, 2958 nt, synthetic construct
  misc_feature 1..2958: note = Cas9 variant
  source 1..2958: mol_type = other RNA
atggcaaaaatcctggccttcgacattggaatatcgtccataggatgggccttcgtggaaaacgacgaactcaaagactgcggggttcggatcttcaccaaagcagaaaaccccaaaaccggcgagagcctcgccttgccccgccgactcgcacgatcagcacgcaagcgcctcgcccgtaggaaagcaagactcaaccacctcaaacacctgatcgcaaacgaattcaaacttaactacgaagactaccaaagcttcgacgagagcttggcaaaagcgtacaaaggtaccctaatcagcccttacgagttacgcttcaaagccctcaacgagctactgtccaaacaagacctagcacgagtcatactccacatagccaagcgccgcggttacgacaatataaaaaattcagacgacaaggagaaaggcgccatactaaaggcagtgaaagagaacgaagaaaagctagcgaactacaagtcagtcggcgaatacctctacaaggaatacttccaaaaattcaaggaaaacagcaaagaattcatcaacgtgagaaataaaaaagagagctacgaacgctgtattgcgcaaagcttcctcaaggacgaactcaaactcatcttccaaaaacaacgggagtttggattcaacttctcgaagaaattcgaagaggaggtcctgtccgtggccttctacaaacgggccctgaaagacttcagccatcttgtcggcaactgcagcttcttcgtagacgaaaagcgcgcgccaaagaactcgcccctcgccttcgaattcgtggcgctaaccagaatcgtgaacttactaaacaacctaaataaaaacaactcctacatcaaagacgacctaaacgcactcctatccgaagtactaaaaaacggcacactcacctacaaacaaacaaaaaagattctcggactctccgacgactacgaattcaaggggcaaaaaggcaactacttcatcgaattcaagaagtacaaggaattcatcaaggctctatgcgaacacaacctcaaccaagacgacctgaacgagatcgcaaaagacatcaccctcgtcaaggacgaaacaaaactcaaaaaagcgctcgccaaatacgacctcaaccaaaatcaaatagagaacctcagcaaaatagagttcaaggaccacctgaatatctcattcaaagcactcaaactgatagtgcccctaatgcgagaagggaaaaaatacgacgaagtttgcaacgaactaaacctgaagacggccataaacgaagacaagaaagagttcctccccgcattcaatgagacctactataaagacgaggtaaacaaccccgtcgtcctccgcgctatcaaagaataccgcaaagtgctaaactccctcctaaagaagtacggcaaggtgcataaaataaacatcgagctcgcccgagaggtaggaaagaaccaccgcgagcgatccaaaatagaaaaagagcaaaacgaaaacttcaaagccaaaaaggacgccgagctcgaatgcgagaaactcggcctcaaaatcaacagcaaaaacatcttgaagctacggctgttcaaagagcagaaagaattctgcgtctactccggcgaaaaaatcaaaatctctgacctgcaagacgaaaaaatgctggaaatcgaccacatatacccctactcacggtccttcgacgacagctacatgaacaaagtccttgtatttacgaagcagaaccaagaaaaactcaacaaaacccccttcgaagcctttggaaaagacgacgtcaaatggcaaaaaatcgaaaccttagcaaagaacctccccgccaaaaagcagaaacgcatcctcgacaagaactacaaagacaaggaacaaaaagacttcaaagaccggaacctcaacgacaccagatacatagcacgactagtcctaaactacacgaaagactacctggagttccttccgctcagcgacgacgaaaacataaaactcaatgacacccaaaaaggtagcaaggtccacgtcgaggccaagtcaggtatgctcacatcagtgctacgacacacatggggcttcagcaccaaggacaggaacaaccatctgcaccacgccatagacgcagtaatcatcgcgtacgccaacgcctccgtggtgaaggcattcagcgacttcaagaaagagcaagaaaactacacagccgaattatacgcaaaaaaaatcaacgaactggactttaaaaacaagagaaaatttttcgaacccttcagcaacttccgtcaaaaagtacttgaaaagatagacgaaatcttcgtctccaaacccgaacgtaagaaaccctccggtgccctacacgaggaaaccttctacaaagaagaagaattctacaaagaatacggcggcaaagaaggcgtcctaaaggcactcgagctcggcaagatccgtaaagtcaacggcaaaatcgtcagcaacgcaaacatgtttagggtggacatattcaaatacaaaaaaaccaacaagttctacgccgttcctatctacacaatggacttcgcactcgggatactacccaacaaagcagtcgtcggaggcaaggacaagcaaggaatcatcaaagactggctgctaatggacgaaaactacgaattctgcttctcgctctacaaagacagcctgatactgctacagacaaaagacatgcaagaacccgagctcgtatacttcaaatcattcaaaagcagcaccgccggcctagtagtatccaaacacgacaacaaattcgaaaacctgaacgaaaaccaaaaaaaactattcaagtccgccaacgaaaaaaaagtcgtcgcggaagggatcggcatccaaaacctcaaagtttttgagaaatacatcgtaagcgcactaggagagataaccaaggccgaaattaaagagcgagaaaacttcaaaaaaaaatga

SEQ ID NO: 6047 - RNA, 2961 nt, synthetic construct
  misc_feature 1..2961: note = Cas9 variant
  source 1..2961: mol_type = other RNA
atgccatcagaccctgccgaggcaaaaccactagaattgctagacccctacgccctacgagcacaaggactagaccaggccctcccgctgacacactttggacgcgccctattccacctcaaccagcgtcgaggcttcaagtccaaccgcaaaactgacaggggagacaacgaaaacggaaaaattaaagacgcctcccaacgcttggattgggccatgcacgaagcaaaagcaaggacctatggagagttcctacacctacgccgccaaaaggccccagacccacggcaggtcccaacagtccgcacccgtctctccgtgggaaagagaggcggccctgatgccaaagaagaagcaggctacgatttctatccggacagacggcacctagaagaagagttccacgaactgtggtcggcacaagcccaattccaccccgaactcactcaagacctaagagaccttgttttcgagaaaatattttaccaaagaccactaaaagaacccaaagtcggactgtgcctcttcacaagcgaagaaagacttgcaaaagcacacccactaacgcaaagacgtgtgctctacgaaactgtaaaccaactacgtatcacagcagacggacgcagcgtcaggcctctctcgcgggaacagcgcgaccaaataatactcgctctagacacaaagaaaccgaccaaatccctaaactccatggtcgtaaccctacaagcactaggcaaagttctcaagctccgcgaaggagaacgattcacactcgaatcaggggtacgagaagccatagcgtgtgaccccgtccgtgccgcgatgctggccactttcggaccaaggtggtccgccctagactggccagaacaatggcaagtaataagcagagtccggaaactacaggacgacaaggacttcgcagaacttgtagaatggttaatcgaactctacggcgtcgacaaagaagcagctgtaaaaatcgccaacacacacctaccagaaggctacggccgcttaggactcacggccacaacaagaatcctagaccgtctcaagagcaacgtattcacatacgcccaagccgtagcagcatgcggatggcaccactccgaccaacgcacaggagagtgcctggaccgactaccatactacggagccgtcttagaccgccacgtaatcccgggcacctacgatgaaaacgacgatgacatcacaagattcgggcgaatcaccaatcccacagtccatataggcctaaaccaattacgccgcctagtaaacaaaataatagaagtatacggaaagcctaaccaaattgtagtagaactggcgcgcgaactcaaacaatcagaacagcagaaaaatgacgccataaagctgatccgagacaccacaaccgccgcaaaacaacggagcgaaaaattagaagaactcggcataaccgacaacggcagaaaccggatgctcctaagactctgggaggacctaaaccccgacgacgcaatgcgccgattctgcccctacacaggccaaagaatctctgcagcaatgatcttcgacggatcatgcgatgtcgaccacatcctaccatactcacggacgctcgatgacgggttcgccaatcgcaccctatgtctgcgcgaggccaaccgcgagaaacggaaccaaacaccgtgggaagcctggggcggcacgcccaactgggaagccatagaaacaaacctgaaaaacctccccgagaacaaacgctggcgtttcgcccccgacgcgatggcgcgatttgaaggcgaaaatgacttcctagacagggccctagtcgacacacaatacctagcacgcatatccagaacttacctagacacactattcaccgaaggcggccatgtatgggtcgtgcccggcagactcacagagatgctgagacggcactggggccttaacagcctgctcacagacaaagaccgaggcgcagtcaaatctaaaaaccgcacagaccaccgacatcattcaatcgacgcggcagtcgtggctgccaccgatcggtcactcctgaaccgcatatcacgcgccgctgggcaaggagaagtggcgggtcagagcgcggagcttatcgcacgcgaaacacccccaccatgggaaggtttccgcaacgacctaaaatcccaacttggaagaataatcgtgtcgcaccgcgcagaccacggcagaatcgaccgccaagccagaaaacaaggacgagactccaccgcaggccaactccaccaagagaccgcatactccatcgtcgacgacacccgagtcgccagccgcatcgattttctaagtgtaaagccagcccaactcctcgaccaacccggacgatcaggccaggtaagggacctacaactgcggaaagcactacgcgtcgcaacaggggacctcacaggcaaagactacgaaaaagcactaagagacttcgcagcaaaacccggcccatacaaaggcatccgtcgcgttcgaataataaaacccctacaagagcaagcccgcgtgcccgtccccgtccttgacccaataaaagcgtaccaaggagggtcaaaccatgtttttgaaatctggcacctccctgacggtaaggtcgagccacaggtcatcacgtcattcgaggcccacgccctggaagttgaaaaacgcccccacccagccgcaaaaaggctactccgagtacacaaaggagacatggtagccctcaaaagagaaggccgtacggtcgtgggccatgtccaacaaatgcacatcaaaaacggcctctttatagtaccacacaacgaagcaaacgccgacgcccgaaactccgacaggacagaccccttcaaatggatccaaatagctgcacaacccgcaatagccgcaggcatccgacgagttgcagtcgacgagatcggacgcctccgggacggcggcgctaaaacgatctga

SEQ ID NO: 6048 - RNA, 2964 nt, synthetic construct
  misc_feature 1..2964: note = Cas9 variant
  source 1..2964: mol_type = other RNA
atggcacggatactcgccttcgacatagggatcagctccataggctgggcctttagcgaaaatgacgagctaaaggattgcggagtgcgaatctttacaaaggcagaaaaccccaagaccggggaatcgctagctctgccgcgacgcctaagccgctcagccaggaagcgtctcgcccgtcgcaaagcacggctcaaccacctcaaacacctcatcgccaacgagttcaagctcaactatgaagactaccaatctttcgacgagtccctcgcaaaagcatacaaagggtcactcatcagcccctacgaactgcgattccgggcactgaacgagttccttagcaagcaagatttcgcgagagtgatcctacacattgctaaacgaaggggctacgacgacataaagaacaacggcgatgaagaaaagggcgagattctcaaggccataaagcaaaacgaggaaaaattggtaagctatcaatccgtcggggagtacctctacaaggaatacttccaaaaattcaaggaaaacagcaaggagttcatcaacgtccggaacaagaaggaatcatacgagagatgcatagcacaatcattcctcaaagatgaacttaaactgatcttccagaaacaacgcgagttcgggttttcattctccaagaaatttgaggaagaagtcctctccgtcgcattctacaagcgcgctctcaaagacttctcgcacctcgtaggcaactgttcatttttcaccgacgagaaacgcgcacccaaaaactcacccctcgcattcatgttcgtcgccctcacgcgaatcatcaatctcctaaacaacctcaaaaacaccgaaggcatcctatacacgaaggatgacctaaataccctactcaacgaagtactcaaaaacggaacgctcacatacaaacagaccaaaaagctcctaggacttagcaacgactacgaatttaaaggagaaaagggaacatacttcatcgaatttcagaaatacaaagagttcgtcaaagcccttggcgaacataacctatcccaagacgatctgaacgaaatcgccaaagacatcaccttaatcaaggacgaaatcaaactcaaaaaggccctcgccaaatacgatctcaaccaaaaccaaatcgactccctcagtaagctcgagttcaaagaccacctcaatatctcattcaaagccctcaaactcataacaccccttatgctcgagggaaagaagtacgacgaagcctgcaacgaactaaaccttaaagtagccataaacgaggacaagaaagacttcttgcccgccttcaacgagacatactacaaggacgaggtcaccaaccccgtcgtactgcgggcgataaaggaatatcgaaaagtcctcaacgcgctactcaagaaatatggaaaagtgcacaagatcaacatcgaactagcgagagaagtggggaaaaaccatagccagagagcaaaaatagagaaagagcaaaacgaaaactacaaggccaagaaagacgccgagctcgaatgcgaaaaactcggactaaaaataaacagcaaaaacatccttaaactccgattattcaaagaacagaaagagttctgcgtctactccggagagaaaatcaaaatatcagacctacaagacgagaaaatgctggaaatcgaccacatctacccatacagccgcagcttcgacgatagctacatgaacaaagtactcgtattcacaaaacagaaccaagaaaaactcaacaaaacaccattcgaaaccttcggaaacgaccgcgttaaatggcagaaaatcgaagtactggccaaaaatctaccaaccaaaaagcaaaagcgcatcttggataaaaattacaaggataaagaacaaaaagacttcaaagaccgcaacctgaacgacacccgctacatagcacgcctagtgctcaactacaccaaggactacctcgacttcctacccctcagcgacgacgaaaacaccaaactgaacgatacccaaaagggctcgaaagtgcacgtcgaagccaaatcagggatgctaacaagcacgctacgccacacctggggattctccacaaaggaccgagacaaccacctccatcatgccatcgacgccgccataatcgcatacgcgaacaactccatcgtcaaggctttcagcgacttcaagaaagaacaagagtcaaacaccgcagaactgtacgccaagaaaatatcggagctggattacaaaaataaacgaaaattcttcgagcccttctccggcttccgccaaaaactactcgataaaattgacgaaatattcgtaagcaagccagaacgcaaaaagccctctggcgctttacacgaagaaaccttcagaaaagaggaagagttttaccaatcatacggaggtaaggaaggggtcctaaaagcacttgaactcggaaagatccgcaaggtaaacggcaagatggtcaaaaatggcgacatgttccgagtggacatcttcaaacacaagaaaacgaacaaattttacgccgtccccatctacaccatggacttcgccctgaaagtactacccaacaaagctgtcgtacagggcaaagacaagaaaagcggcctcatcaaagattggatcctcatggatgagaactacgagttctgcttcagcctttacaaggacagcctcatcctcatccagacgaaagacatgcaagaacccgaactcgtctactacgaacgcctcgactccagtaacgcaagcctgaccgtctccaaacacgacaacaaattcgaaaccctctccaagaaccagaaaatactgtttaagaacgctaacgaaaaggaagtcatcgcaaaaagcatcggcatacaaaacttgaaggtcttcgaaaagtacatcgtcagcgcactcggcgaggtcacaaaagccgagttccgccaacgagaagacttcaagaaatga

SEQ ID NO: 6049 - RNA, 2964 nt, synthetic construct
  misc_feature 1..2964: note = Cas9 variant
  source 1..2964: mol_type = other RNA
atggcccgcatactagcattcgacatcggcatcagctcaataggatgggcattctcagaaaatgatgagctgaaagactgcggcgtcagaatattcaccaaggcggaaaaccccaagaccggcgaaagcctcgcactcccacgccgcctagccaggtccgcacgcaagcggctcgccagacgcaaagcacgtctcaaccaccttaaacatctgatcgcgaacgagtttaaactaaattacgaagactaccaatcgttcgacgagtcactcgccaaagcgtacaagggttccctcatatccccctacgaactgagattccgtgcactcaatgagcttctaagtaaacaggactttgcacgcgtaatactccacatcgcaaaacgacgcggatacgacgacatcaaaaactccgacgataaggagaaaggggccatcctcaaggccatcaaacaaaacgaagaaaaactagccaactaccagagcgtaggggaatacctctataaagaatacttccaaaaattcaaggagaactcaaaagagttcaccaacgtccggaacaagaaagaatcctacgaacgctgcatagcccaaagtttcctcaaagacgagctcaaactaatcttcaaaaagcaacgcgagttcggcttctccttctccaagaaattcgaagaagaagtcctaagcgtggccttctacaaaagagcgctcaaagacttttcacacttggtgggcaactgctccttcttcactgacgaaaagcgcgcacccaaaaacagcccacttgcttttatgttcgtggcactcacaagaatcatcaatctcctaaacaacctgaaaaatacggaaggcatactatacacaaaagacgacctaaatgccctccttaacgaagtgctcaaaaacggaacactgacgtacaaacagacaaagaagctcctaggcctcagcgacgattacgagttcaaaggagaaaaaggcacatactttatcgaatttaagaaatacaaagagttcatcaaagcactaggcgaccactcgttaagccaagacgacctgaacgagatcgccaaagacatcacattaatcaaagacgagatcaaactcaagaaagcactcgcaaagtatgacctcaatcaaaaccaaatcgacagcctgagcaaattagaatttaaggaccacctcaacatctccttcaaggcactaaaactaatcacaccactgatgctagaagggaagaaatacgacgaggcctgcaacgagcttaacctgaaagtagccatcaacgaagacaagaaagacttcctgccagccttcaacgaaacgtactataaagacgaagtaaccaaccccgtcgtgcttcgagccatcaaagaataccgcaaagtcctcaacgcgctcctcaagaaatacggcaaagtccacaaaatcaacatagaattggcgcgagaagtcgggaaaaactacagccagcgagccaaaatcgaaaaagagcaaaacgaaaattacaaagcaaagaaagacgccgaactcgagtgcgagaaactcggcttgaaaatcaactccaaaaacatcctgaagctccgactgttcaaggaacagaaagagttctgcgcgtactcaggagagaaaataaagatatcggacctacaagatgagaaaatgctagaaatcgaccacatctacccatactcccggagcttcgacgacagctacatgaacaaagtactcgtctttaccaaacagaaccaggaaaagctcaaccaaacacccttcgaagcctttgggaacgactccgcaaagtggcagaaaatagaagtactcgccaaaaacctcccaacaaagaaacaaaaacgcatcctcgacaaaaactacaaagacaaagaacaaaaggacttcaaagaccgcaatctaaacgacacccgctacatcgcacgtctagtcctaaattacaccaaggactacctagacttcctaccgctatccgacgacgaaaacactaaacttaacgacacccaaaagggctcaaaagtccatgtagaggcaaaaagtggcatgctcaccagcgccctccggcacacctggggcttctctgcaaaggacagaaacaaccatctgcaccacgccatagacgccgtcatcatagcctacgccaacaactccatcgtcaaggccttcagcgacttcaagaaagaacaagagtccaacagcgcggaattatacgcgaagaaaatctccgaactcgactacaaaaacaaacgcaaattcttcgagccattcagcgggttccggcaaaaagtcctcgacaaaatcgacgaaatcttcgtcagcaaacccgagaggaagaaaccctcaggcgcccttcacgaggagacgttccgaaaagaggaagagttctaccagagttacggaggaaaggagggagtcctcaaagccctagaactcggaaaaatacgcaaagtaaatggcaaaatagtcaaaaacggagacatgttccgagtagacatcttcaagcacaaaaagaccaacaagttctacgcagtaccaatctacaccatggacttcgccttgaaagtccttccaaacaaagcggtagcacgctcaaagaaaggagaaataaaagactggatcctaatggatgaaaactacgagttctgcttctcactctacaaagactccctgatattaattcagaccaaagacatgcaggaacccgaactcgtgtacttcaatgcattcacaagcagcacagtatcactcatagtgtccaagcacgacaacaaattcgagaccctaagcaagaaccagaaaatactattcaaaaacgccaacgagaaggaagtcatagccaaatccataggcatccaaaacctaaaagtattcgaaaagtacatcgtgtcggcactaggggaggtaaccaaagccgagttccgccaaagagaagacttcaagaacgaactgcggtga

SEQ ID NO: 6050 - RNA, 2964 nt, synthetic construct
  misc_feature 1..2964: note = Cas9 variant
  source 1..2964: mol_type = other RNA
atggcacgcatcctcgcattcgacatcggcataagctccatcggctgggccttctcggaaaacgacgaactgaaagactgcggcgtccgcatcttcaccaaggcggaaaaccccaagaccggcgaatcactagccctcccccgccgtctcgcccgctcggcaagaaaacgcctggcacgccgcaaagcgcgtcttaaccacctcaaacacttgatagccaacgagttcaagctcaactacgaagactaccagtcgtttgacgaatcactcgcaaaagcctacaaaggcagccttatatccccctacgaactccgattccgcgccttaaacgagctcctaagcaagcaagacttcgcacgcgtaatccttcacatcgctaaacgacgcggctacgacgacattaagaacaacggcgacgaagaaaagagcgagatcctcaaagccatcaaacagaacgaggaaaagctcgtcaactaccaaagcgtcggcgagtacctctacaaagaatacttccaaaaattcaaggaaaactccaaggagttcataaacgtccgcaacaaaaaggaatcctacgaacggtgtatagcccagtcatttctcaaggacgagctcaaattaatcttccaaaaacagcgagagttcggattcagcttttctaagaaattcgaggaggaggtcctaagcgtcgccttctacaaacgcgccctaaaagacttctcccacctggtaggaaactgcagtttctttacggacgaaaaacgtgccccaaagaacagccccctagtcttcatgttcgtagcccttacgaggataataaacctcctgaacaacctcaaaaatacggagggaatcctctacaccaaagacgaccttaacgcattactcaacgaagtactgaaaaacggcacactcacatacaagcaaacgaagaaactactaggcctgtcggacgactacgagttcaaaggtgagaaaggaacctacttcattgagttcaaaaagtacaaagagttcataaaagccctcgacgaacactctctcagtcaagacgacctaaacgaaatagcgaaagacatcactctgatcaaagacgaaataaaactaaagaaagccctagcaaaatacgacctaaaggagaaccaaatagacagcctaagtaaactcgagttcaaagaccacctgaacattagcttcaaggccctcaaactaataaccccactaatgctcgagggaaagaaatacgacgaggcctgcaacgaactaaacctcaaagtggcgatcaacgaagataagaaagacttcctccccgctttcaacgaaacctactacaaagacgaagtcaccaatccagtcgtcctacgcgccataaaagagtaccgaaagatcctgaacgccctactaaagaaatacggcaaagtacacaaaataaacatcgaactagcccgagaagtaggcaaaaaccattcacaacgcgcaaaaatcgaaaaagaacaaaacgagaattacaaagccaagaaagatgcagaactcgaatgcgaaaaactcggcctaaaaatcaacagtaaaaacatcctcaaactccgactattcaaagaacagaaagagttctgcgtctactcaggagagaaaatcaaactctcagacctccaagacgaaaagatgctagaaatcgatcacatctacccctactcgcgcagcttcgacgactcgtacatgaacaaagtcctcgtgttcgcgaaacagaaccaagaaaaactgaacaaaacccccttcgaagccttcggaaacgacagcaccaaatggcagaaaattgaggtcctcaccaaaaacttgcccacgaagaagcaaaaacgcattctcgacaaaaactacaaagacaaagaacaaaaagacttcaaagaccgaaacctcaacgacacgcgatacatcgcacgacttgtcctcaactacaccaaggactacctcgacttcctcccactctccgatgatgaaaacaccaagctgaacgacacacaaaaaggctccaaagtgcacgtagaagcaaaatcaggcatgctaacctccgccctacgccacacctggggcttctcaaccaaggaccggaacaaccaccttcaccacgccatagacgccgtcataatagcatacgccaacaacagcatagtaaaagcattcagcgacttcaaaaaggaacaagagtccaattcggccgaactatacgccaagaagatctccgagctcgactacaaaaacaagcgcaaattcttcgaacccttcagtggcttccgacaaaaagtactagacaaaatcgacgaaatattcgtctccaagcctgaacgcaagaaacccagcggcgcactccacgaagaaacatttcgaaaagaggaagaattttaccaatcatacggcggcaaagaaggggtcctaaaagccctcgaactagggaaaataagaaaagtaaacgggaaaattgtaaagaacggcgacatgttccgagtcgatattttcaaacacaagaaaaccaacaaattctacgccgtccccatatataccatggacttcgcgctaaaagtcctccccaacaaagcagtagcacgatccaagaaaggcgaaataaaagactggatccttatggacgaaaactacgagttctgcttctccctctacaaggacagcttgatactcatccaaacgaaggacatgcaagaacccgaactcgtctacttcaacgctttcaccagctccacagtaagtctcattgtatcaaaacacgataacaagttcgaaacactatcgaaaaaccagaaaattctcttcaaaaatgccaacgaaaaagaagtaatcgcgaagtccatcggcatccaaaacctcaaagtcttcgaaaaatacatagtcagcgcactaggtgaagtcaccaaggccgagttcaggcaacgagaagatttcaaaaacgaactaaggtga

SEQ ID NO: 6051 - RNA, 2964 nt, synthetic construct
  misc_feature 1..2964: note = Cas9 variant
  source 1..2964: mol_type = other RNA
atggcccgcatcctggcctttgacatcggaatatcaagcataggatgggccttcagtgaaaacgatgagctcaaagactgcggcgttcgcatcttcacaaaagcggaaaaccccaaaacaggggagagcctcgcgctccctcgacggctcgcacgatcggcacgcaagcggctggcccgacgaaaagcaagactcaaccacctgaaacacctaatcgcaaacgagttcaagctgaactatgaagattaccagagcttcgacgagtcgctcgccaaagcctacaaagggtctctaatctccccatacgaacttcgatttcgcgctctgaacgagctcttatccaaacaggactttgcccgcgtaatccttcacatagccaaacgacgcggctatgacgacatcaagaactccgacgacaaagagaaaggcgcaatcctaaaagccatcaagcaaaatgaagaaaaactagccaactaccaatccgtaggagaatatctctacaaggagtatttccaaaagttcaaagaaaacagcaaagagttcaccaacgtcaggaataaaaaggaatcctatgaaagatgcatagcccaatcattcctcaaagacgaactaaaactcatcttcaaaaagcaacgcgagttcggcttctcgttctcaaagaaattcgaagaagaagtacttagcgtggccttctacaaacgcgcactaaaagacttctcccacctcgtgggcaactgctccttctttaccgacgaaaagagagcccccaaaaactccccactggccttcatgttcgtcgccctcacccgcataataaacctcctgaacaaccttaaaaacacagaaggaatactctacactaaagatgacctaaacacgctcctgaacgaagtcctgaaaaacgggaccctcacctacaaacagaccaagaaacttctaggcctctcggacgactacgagttcaaaggagaaaaaggcacctacttcatcgaatttaagaaatacaaagagttcataaaagcactcggcgaacacaacctttcgcaagacgacctaaacgaaatagccaaagacataacactgatcaaagacgaaataaagctaaagaaagcccttgccaaatacgacctcaaccaaaaccagatagacagcctaagcaaacttgagttcaaggaccacctaaacatctcattcaaggccctcaagctcgtcacgccactgatgttggaagggaagaaatacgacgaagcctgcaatgagctaaaccttaaagttgccataaacgaagacaagaaagacttcctcccagccttcaacgagacctactacaaagacgaggtgaccaacccagtcgtccttcgcgcaataaaagaataccgtaaggtgctaaacgcgctgctaaagaaatacggaaaagtacataaaatcaatatcgaactcgcccgcgaagtcggcaaaaaccactcccaacgagcgaagatcgaaaaagaacaaaacgaaaactacaaggctaagaaggacgcggaactagagtgcgaaaagctaggactcaaaataaacagcaaaaacatactcaaactgcgcctattcaaagagcaaaaagagttctgcgcatacagcggtgagaaaatcaaaatctccgacctgcaagacgagaaaatgctcgaaatagaccacatctatccatactccagatcattcgacgactcatacatgaacaaagtcctcgtcttcacaaaacagaaccaggaaaaactgaaccaaacccccttcgaagcgttcggcaacgactccgccaaatggcagaaaatagaggtcctagccaaaaacctaccgacgaagaaacaaaaacgaatcctagacaaaaactacaaagacaaagaacaaaagaacttcaaggaccgcaatctcaacgacacgcgctacatcgcccggctcgtcctaaattacaccaaagactacctagatttcctgcccctaagcgacgacgaaaacaccaaacttaatgacacccaaaagggctcaaaagtccacgtcgaagcaaagtcgggcatgctaacgtcagccctacgccacacttggggtttctctgccaaggaccgcaacaaccacctacaccacgccatagacgctgtcatcatcgcgtacgcaaacaatagcatcgtcaaagccttcagtgacttcaagaaagaacaagaatcaaactctgctgaactctacgcgaagaaaatctcggagctggactacaaaaacaaacgaaaattcttcgagcccttcagcggcttccgccaaaaagtactcgacaaaatcgacgaaatcttcgtctccaagccagaacggaagaaacccagcggcgcgctacacgaagagacgttccgaaaagaagaagagttctaccaaagctacggaggcaaagaaggtgtacttaaagcactcgaactcggaaagatccgtaaagtaaacggcaaaatcgttaaaaacggcgacatgtttagagtagacatattcaagcacaagaaaacaaacaaattctacgccgtccccatatacaccatggacttcgccctcaaagtgctgccaaataaagccgtcgcccgctccaagaaaggcgaaatcaaagactggatcctaatggacgaaaattacgagttctgcttcagcctctacaaagacagcctcattctaatccagaccaaagacatgcaagaacccgagctagtctacttcaacgccttcaccagctccactgtatccctcatcgtcagcaaacacgacaataaattcgaaaccctatccaagaaccagaaaatactgtttaaaaacgcaaacgaaaaggaagtcatagccaagtctataggaatccaaaacctgaaagtcttcgaaaaatacatcgtctcagcactaggcgaagtcacaaaggccgagttccggcaacgagaagacttcaaaaacgaactccgctga

SEQ ID NO: 6052 - RNA, 2964 nt, synthetic construct
  misc_feature 1..2964: note = Cas9 variant
  source 1..2964: mol_type = other RNA
atggcacgcatacttgccttcgacatcggtatcagttccatcggctgggctttcagcgagaacgacgagctaaaagactgcggagtgcgaatctttacaaaagcggagaaccccaagacaggagaatcgctagccctcccccgccgactcgcgcgctccgcccggaaacggctcgccagacggaaagcaagacttaatcacttaaaacaccttatagcaaacgagttcaaactcaactacgaagactatcaatcattcgacgaaagcctagcaaaggcttacaaaggctcgcttatcagcccctacgaactacgatttagggccctcaacgagctcctctccaagcaagacttcgcgagggtaatacttcatatcgccaaacgccgaggctacgacgacattaaaaactccgacgacaaggaaaaaggggccatactcaaagccatcaaacagaacgaggaaaaactagcaaactatcagtcagtcggagaatacctgtacaaagaatacttccaaaaattcaaggaaaatagcaaagaatttacaaacgtgcgcaataagaaagagagctacgaacgctgcatagcacaatcattccttaaagacgaactcaaactaatattcaagaaacaacgcgagttcggattcagcttctcgaagaaattcgaagaggaagtcctgtcagtggccttctacaaaagggcgctcaaagacttcagccacctcgtcggaaactgttccttcttcacagacgaaaaacgagcccccaaaaactcacccctcgccttcatgttcgtggccctcacccgcatcattaacctcctcaacaacctcaaaaacaccgaagggatactgtacacgaaagacgacctcaacgctctcctcaacgaggtgttgaaaaacagcaccctaacatacaaacaaaccaagaaactcctcggcctcagcgacgactacgagttcaaaggagaaaaagggacttacttcatagagttcaagaaatacaaagaatttatcaaagccctaggcgaccactccctatcccaagacgacctaaacgaaatagccaaagacatcaccctgatcaaagacgaaattaaactcaagaaagccctggcaaaatacgacctgaaccaaaaccaaatcgacagcctcagcaaactagagttcaaagaccacctaaacatctcatttaaagcactgaaactaataacacccctaatgctcgaagggaagaaatacgacgaagcatgcaatgaactcaacctgaaggtcgcaatcaatgaagacaagaaagacttcctcccggcttttaatgaaacctactacaaagacgaagtcaccaaccccgtggtactccgcgccatcaaagaataccggaaagtcctgaacgccctactcaagaaatacggaaaagtccacaaaataaatatagaactagcccgagaagtagggaaaaactacagccagagagccaaaatagagaaagaacagaacgaaaactataaggcaaagaaagacgccgagcttgagtgcgaaaaactcggcctcaaaataaattccaaaaacatccttaaactacgcctcttcaaagaacagaaggagttctgcgcctacagcggagagaaaatcaaaatctcggatttacaagacgaaaagatgttagaaatagatcacatatacccatactccaggtccttcgacgactcatacatgaacaaagtcctcgtattcacaaaacaaaaccaagagaaactcaataagacacccttcgaagcattcgggaacgactcagcaaagtggcaaaagatcgaggtgctcgccaaaaacctaccaactaaaaagcagaaaagaatcctcgataaaaactacaaggacaaggagcaaaaggacttcaaagaccgtaacctcaacgacacccgctacatcgcgcgcctagtgttaaactacaccaaggattacctagacttcttgcctctctccgacgacgaaaacacaaaactcaacgacacccaaaaagggtcgaaagtacacgtcgaagccaaaagcgggatgctaaccagtgccctccgccacacctggggattctcagcgaaagaccgaaacaatcacctacaccacgcgatcgacgcagtgatcatcgcatacgccaacaacagcatcgtcaaagcattctcagacttcaagaaagaacaagagagcaacagcgccgagctctacgccaaaaagatctccgaactcgactacaaaaacaaacgcaaattcttcgagcccttcagcggcttcagacaaaaggtcctagacaaaattgacgaaatcttcgttagcaagcctgagagaaagaaacccagcggagctttacacgaggagaccttccggaaagaagaagagttctaccaatcatacggcggcaaagaaggggtgcttaaagccctcgagctcggcaaaatacgcaaagttaacgggaaaatcgtcaaaaacggcgacatgttccgcgtagacatattcaaacataagaaaacaaacaaattctacgccgtacccatatacacgatggactttgcactcaaggtcctccccaacaaagccgtggcccgctcaaagaaaggcgaaatcaaggactggatcctgatggacgagaactacgagttctgcttcagcctttataaagactcactaatcctgatccaaaccaaagatatgcaagaaccagagctagtctatttcaacgccttcacaagctcaacagtcagcctgatcgtctcaaaacacgacaacaagttcgagaccctgtccaaaaaccagaaaatcctattcaaaaacgccaatgagaaagaagtcatcgcgaaaagcatcggtatccaaaacctgaaggtattcgagaagtacatcgtatccgccctcggagaagtcaccaaagccgagttccgccaaagggaagatttcaaaaacgaactcaggtga

SEQ ID NO: 6053 - RNA, 2964 nt, synthetic construct
  misc_feature 1..2964: note = Cas9 variant
  source 1..2964: mol_type = other RNA
atggcaagaatactagcattcgacataggcataagctccatcggctgggcattctcagagaacgacgaactcaaggactgcggcgtgcgcatcttcacgaaagccgaaaacccgaagacaggagaatcactcgcactcccccgcagactagcccgctccgcgcgaaagcggctagcgcgtcgaaaagcacgactcaaccacctcaagcacctcatcgccaatgagttcaagctcaactacgaagactatcagtccttcgacgaaagcctagccaaagcatataaaggctcgctaatatccccatacgaacttcggttcagagccctcaacgagctacttagcaaacaggactttgcacgggtgatacttcacattgcaaaacgccgcggatacgacgacatcaaaaacagcgacgacaaagagaaaggagcaattctcaaagccataaaacaaaacgaggaaaaacttgccaactaccaatccgtcggggaatatctatacaaagagtatttccaaaagttcaaagaaaactcaaaggagttcacgaacgtccgaaacaaaaaggaaagctatgaaaggtgcatagcccagagcttcctcaaggacgaactcaaactgatcttcaagaaacaacgcgagttcggttttagtttcagcaaaaagttcgaagaggaagtcctctcggtggcattctacaaacgagctctcaaagacttttcacacctagtgggcaactgttcattcttcaccgacgaaaagagggcccccaaaaactcaccactagcgtttatgttcgtcgcactcacccgcatcatcaatctactcaacaacctcaaaaataccgaaggcatcctatacacaaaagacgacctcaacgcccttctcaacgaagtcctcaaaaacggcaccctcacatacaagcaaaccaagaaactcctcgggctaagcgacgactacgagttcaaaggggaaaaaggaacctacttcatagagttcaaaaagtacaaagaatttataaaagcactgggcgaccacagcctctcccaggacgacctcaatgaaatagccaaagacatcacactcattaaggacgaaatcaaactgaagaaagcgctcgccaaatacgatctgaaccaaaaccaaatcgattccctgagcaaactcgagtttaaagaccacctcaacatcagcttcaaggcactcaaactcatcaccccactcatgctagaaggaaagaaatacgacgaagcgtgcaatgagctcaacctgaaagtagcaatcaacgaagacaagaaagacttcctacccgccttcaacgaaacgtactacaaagatgaggtcacgaacccggttgtactccgcgcaataaaagaatacaggaaagtgctgaacgccctactgaagaaatacggaaaagtgcacaaaatcaacatcgaactcgcacgagaagtcgggaaaaactacagccaacgcgcgaaaatcgaaaaagagcaaaacgaaaactacaaagcaaagaaagacgccgaactcgaatgcgaaaaactaggactgaaaatcaactccaaaaacatcctaaaactccgcctctttaaggaacaaaaggaattttgcgcttacagcggggaaaagataaagatatcagacctacaggacgagaaaatgctggaaatcgaccacatctacccatatagccgatccttcgacgacagctacatgaacaaggtgctggtattcaccaagcagaaccaagaaaaactcaatcaaacccccttcgaggcgttcggcaacgactccgcaaaatggcaaaagatcgaagtattagccaaaaacctacccacgaaaaagcagaaaagaatactcgacaaaaactataaagacaaagagcaaaaggacttcaaagacagaaacctgaacgatacccgctacatcgcaagattggtcctcaattacacgaaagactacctagacttcctacccctcagcgacgacgaaaacacaaaactaaacgatacccaaaaaggttccaaagtgcacgtggaagcgaaatcaggcatgcttacatccgctctccgccacacctggggattcagcgcgaaggaccgaaacaaccacctccatcatgcaatcgacgcagtcataatcgcatacgcaaacaatagcatcgtcaaggcctttagcgacttcaagaaagaacaagaaagcaactccgccgaactctacgccaagaaaattagcgaactggactacaaaaacaaacgcaaattcttcgaacccttctccggcttccgccaaaaagtcctggataaaatcgacgaaatctttgtcagcaaaccagagagaaagaaaccgtctggcgccctccacgaggaaacattcagaaaagaggaagagttctaccaaagctatggaggcaaagaaggcgtcctaaaagcactcgaactgggaaaaatccgaaaggtcaacggcaagatcgtgaaaaacggggacatgttccgagtagatatctttaaacacaagaaaacaaacaaattctacgccgtcccaatctacacaatggatttcgcactaaaagtcttgcccaacaaagccgtcgcccgctcgaagaaaggcgaaatcaaagactggatcctaatggacgaaaactacgagttctgcttctccctctacaaggacagccttattctcatccagactaaggacatgcaagaaccggagttcgtctactacaacgccttcaccagctcgaccgtgagtctaatagtatccaaacacgacaacaaattcgaaacactaagcaagaaccagaaaatcctctttaaaaacgctaacgaaaaggaagtcatcgcaaaatcgatcggaatacaaaacctgaaagtattcgaaaaatacatcgttagtgccctcggggaagtaaccaaagccgagttcaggcaacgggaagacttcaaaaacgagctcaggtga

SEQ ID NO: 6054 - RNA, 2979 nt, synthetic construct
  misc_feature 1..2979: note = Cas9 variant
  source 1..2979: mol_type = other RNA
atgagaatattctccgacggaaggaacccaaaggacggcagttccctggcagtcacgcgcagagcagcccgggcaatgagaagaagaagagacagactactcaaaaggaaaacgcgaatgcaagcgaaactggtggaacacggattcttcccagccgacgcagggaaacgcaaggcactcgaacaactcaacccatacgccctccgggcaaagggattacaagaagcactcctcccaggggaatttgcccgggcactattccacataaaccaaaggagaggattcaaaagcaacagaaaaaccgacaagaaagacaacgactccggagtcctaaagaaagccataggacagctcagacaacagatggccgaacaaggaagtaggacggtgggagaatacctatggacaaggctacaacagggccaaggcgtacgtgcacgataccgagagaaaccatacacgacagaagaagggaagaaaagaatagacaaaagttacgacttatacatagaccgtgcgatgatagagcaagagttcgacgcgctgtgggcagcccaagcagcattcaatccaacactattccacgaagccgcacgagcggacctgaaagacacactactccatcaacggccactacgaccagtcaaacccggccggtgcaccctcctcccagaagaagaacgggcaccactggcactcccgagcacgcaacggttccggatccaccaggaagtaaaccatctacgactcctcgacgaaaacctacgggaagtcgcactcaccctcgcccaacgagacgccgtagtaaccgcactcgagacaaaagccaaactcagtttcgaacagataagaaaactcttgaaactctcgggctcagtacagttcaacctcgaagacgcgaaacgaacagaactcaaaggaaacgcaacaagcgccgcgctagcacgaaaagaattattcggagcagcgtggagcggtttcgacgaggcgctgcaggacgaaatagtatggcagctggtcaccgaagagggagaaggcgcattgatcgcatggctgcaaacccacaccggcgtggacgaagccagagcccaggcgattgtcgacgtctcactgccagaaggatacgggaacctaagccgcaaagccctggcaagaatcgttccagcactgagagccgcagtgataacatatgacaaagcagtccaggcagcgggcttcgaccaccacagccaactaggattcgagtacgacgcgagcgaagtagaagacctcgtacaccccgaaacaggcgaaataaggagtgtgttcaaacaactaccatattacggcaaggccctacaaagacacgtcgcattcggaagtggaaaacccgaagacccagacgaaaagcggtacggaaaaatagcaaatcccaccgtacacataggactgaatcaagtacgaatggtagtaaatgcattaatacgcaggtacggaagacccacagaggtagtcatagaactggcgcgagatctaaagcaatcccgcgaacaaaaagtagaagcccaacgcaggcaagctgacaaccagagacgaaatgccagaatcaggcgatcaattgcagaagtcctaggaataggtgaagaaagggtgcggggaagcgatatccaaaaatggatctgctgggaagaattgagcttcgacgccgccgaccgaaggtgcccatactcaggagtccaaataagcgcggccatgctactaagcgacgaggtcgaagtagaacacattctacccttcagcaagaccctcgacgacagtctaaacaacagaacggtcgcgatgaggcaagcaaacagaatcaaaaggaaccgtacgccgtgggacgcgcgagccgaatttgaagcgcaagggtggagctatgaagacatactccaacgggcagaaagaatgccactccgaaaacgctaccgatttgcacccgacggatatgaaagatggctgggcgatgacaaagacttcctagcgcgagctctcaacgacacaagatacctgagcagagtcgccgccgaatacctaaggctagtatgccccggaacaagggtaatccccgggcagctcaccgcgctgctgagaggcaaattcggactaaacgacgtgctagggctagacggtgagaaaaacagaaatgaccacagacaccacgcggttgacgcatgcgtaatcggagtgacagaccaaggtctaatgcaaagattcgcgacagcaagcgcccaagcgagaggagacggccttacccgactggtcgacgggatgccaatgccctggccgacataccgcgaccacgtcgaaagagcagtgagacacatctgggtatctcaccgaccggaccacgggttcgagggagcaatgatggaagaaacaagctacggaataagaaaagacgggagcatcaaacaacgacgcaaagcagacggaagcgccggcagagaaatatctaacctcataagaatccacgaagcaacacaaccactgcgccacggagtcagcgcagacggacaaccactagcatacaaaggctacgtgggtggaagtaattactgcatcgaaataaccgtaaacgacaaaggaaaatgggaaggcgaagtgatatccacgtttcgcgcgtacggagtcgtcagagcagggggcatgggaaggctcagaaacccacacgaaggccaaaacggacgaaaattaataatgagactggtaataggcgactcagtaagactcgaagtagacggggcggaacgcacaatgagaatagtgaaaataagcgggagcaacggccaaatattcatggcacccatacacgaagccaacgttgacgcgagaaatacagacaaacaagacgcgtttacatacacaagcaaatacgcaggctcactgcagaaggcgaaaacgagaagagtgacaatatcaccgataggcgaggtacgggacccaggcttcaaaggatga

SEQ ID NO: 6055 - RNA, 2985 nt, synthetic construct
  misc_feature 1..2985: note = Cas9 variant
  source 1..2985: mol_type = other RNA
atgacactcgggctagatctcggcaccaactccatcggatgggcactgatagacttcgacgacaaccaacagccaagaaacctgatcgcgtgcggcagccgcatcttccaagaagccgtagaagccaaaacgggcacacccaaaaaccacgcgcggcggacagcaagagcagcccgcaaactggtcgcacgacgcaagcaacgccgcacaaaactactgaacctcctaatacgccacggcctgctcccacaggacgtcgccgagcgaaacgcccttctcctagataaccaagcaaacaacccatatcaactccgtaaacgaggccttgacgagaaactcgaaccattcgcattcgggagagccctgtatcatctcgcgcaccgcagaggattccaatcaaacaggaaagcggcctccgacgaggatggcaaagtcaagaccgcaatctctacgctaagagccgagatgcaaggacgaacactgggcgccttcctcgcagaccaacccacccaacgacgcagatacaccgatcgggccatgtatgtcgaagagttcgaacagctctggtccaaacaagcctccttcacacaagaacaactcacccaggccctaaaagtagcaatccacaattcaatcttcttccaacgacccctgaagtcacagaaacacctcgttggcaagtgcaccttcgagcccacacgcaagagggcagccaaagcgatactcctcacacaacgattccggatcctccaagacgtcaaccacctagcggtaaagaatcccataacacgagagttccgccccctaacccaggacgaacggaacaaactagcagaagcactagacaaacaaaaatcaatgacctggggtgcagtacgcaaggtcatcgggtggaacaagaaagactccctccacgagggagagacgtttaacctcgaagagggaaagaaagacaaactcatcggaaaccgcaccgcatgcgacctccggggcgccctcggcgatcgctgggacgcactcacagcacaacaacaagacgaccttgtaaccgatctgctaacaatagacaacacagacggctttctcaagaggatgaaaacccattgggagttcgacgacgccaccgcggaagtgattgcgaaaatcgagctagaacccggctacgcccgtctctctgcgaaagccatgagagcaatactgccatacctcgagcaaggcatgatctactcagacgcctgcaaagcggcgggatacgaccacagcaaccccaaccaacgtaccattacggataagctcggcctcccatccaatgtccgcaaccccgtcgtgcaaaaagccctcttcgaaacacgcaaggtagtaaacgcgatcgtccgaaaatacggaaaacccgcggtaatccgagtagaaatggcacgcgacatgaaactatcaaagcgccaaaaagaggaacttcaaaaagagcaaaacaaacagaaaaaggccaacgaactcgccgaagggatactcagaaaagagttcggcatacaacaaccagcacgcgcagatatacaaaaatataacctatggcttgaatgcaaggaggtctgcccctacaccgggaccaccatatcccgcgaaatgctatttagccccgaagtcgacgtcgagcatatacttccctactcacggagtctggacgacagctacatgaacaaaacactctgtatggcaactttcaaccgccaagtgaaattaaataatacaccatacgaaatcggacaaggcgaccccctggcctacgcagaaatcttccagcgaataaagactctcccattcccgaaacgacgacggttcgaacaaaaagaaatagaaacggacaaatttatcgaaagacagcttaacgacacccggtatatatgcgtagaagtacgggacttcctacaacaactcggcgcaccagtcgaagtaagcaaaggcgaagcaaccgcaaaactccgcggaaggtggaagctcaacacacttctatcacccgacggtagcaatgaaaaatacagaggggaccaccgccaccatgcaatagatgccgtcgtaatcgcgttgaccaaccgatcactgttccacaaattaagccgcctgtccgcacaaagcatttccctcgataaatcccgatttgacgtacccccaccatgggacggcttctacgacgacgtctatgagaaaatagacaaagtgatcgtcagccacgccccggcacgcaagataggcggagcgctacacgaagacaccgcatacggtcacttcaaggaagaagtcgcggacccaaaaaccggtaaagtgagcatagaagaccgattcgtataccgcaagcccctggccacactgacagcaaacgaagtgggcaagatccgcgatgctaaagtacgagagttcgtcgaagccaggctagcccaatttggcaacaacagcaaaaccgcattcggcgacccaaataaccccctcctccacgcagacggcaaaacccccatacgaaccgtccggctcgtaaccaacttcaacaaggcaacgacgcacgcaatccaaaaaggacaaggcagagactacaaattcttcaaatatggcaacaatcatcacgtcgaaataatagaacacgtagaaacaggaaaacggaagggcatcttcgtcacagccatggaagcggcccggagagtccgaggggtcgcgaacaccgaaaagagtgacatcgtacaaaggaaccacggagaagaatggagattcgtaatgtcattgagcattaacgaccttgtatcgatacaagaggcagaccaggtaaggatcatgcgagtccaactattcgacgcatccaacggcaacataatcttccgagaccaaaagtccgctatgctcgacgataaactatccagataccagactaaagcccacctcctcgtctgccagaaaataaccacagacccactaggaaatctagccccgtgcaacgactga

SEQ ID NO: 6056 - RNA, 2988 nt, synthetic construct
  misc_feature 1..2988: note = Cas9 variant
  source 1..2988: mol_type = other RNA
atgagcaaggtgctgggcctagatataggagccaacagcattggctgggccctcatagacgacgaagagaacgacatcatcggcgccggcgtccgcgtcttcaaagagggggtaaacctcaaaggcgtaaaggaagaaagtaagaacgtcgagcggcgggccgcccgcctagcgcgacggcaacacaaaagacgcagccaacgccgcaaccggctggtggctctactcaagaccctcgaaatgttccccgagaacaacgaggacatcagtgattactacgcacaagacccttacgaactcaggaagaaaggcctatacgaaaaactgaccatgtacgagttcggccgcgtccttctccacatctgcaggcgacgaggcttcaaaagcagccggaaaaccgacatcagcgaagaagggaaaatattcgaaggcaaagacgggatagtgggaatcaaccaaacaagagacagcatccgcgagggcggattcaaaaccatcggtgaatatctcgcaagcctagacccccatgtcatacgaagacgaaaccgcttcacactacgcgacatgtacgaggaagagttcaacctcatgtgggaaaaacaacaaagtttctaccccctacagctgagcaacgagttcaaggaagccatagcggaagtcatcctaagtcaaaggaaactaaagagccagaaagccctcgtcggcaactgcggactagaacccaacaagaaaaccgcaccgaaatccagcccagcattccaatacttcaggatacttgaacagctatccagaatcctaatctccatcccacacaccggccgttacaacgaccccctcaacgaagaggagcgcaggatgctcattgacaaattaagtgtaaccgaaaaactaaaattctctgacatgcggaaaatgctgaatctaccaggggagtccgatataaacatcgaagaggaaggcggaagactcctaggcaacacaacatacgccagattaataaaagtcttcggcaagaaacgatgggccggattcagcgaagaagaaaaagaacaaatatggcatacgttccatttcgctgacaaccacgaatggctcaaagaatacgcactcaagaaatggtcaatcacaccggacgaaataaaggaactaggtaaagtggcactagagaaagaatacgcacgtttcagcaagaagtcactgaaaaagatcataccacagttagaagagggactgacgctggacaaagccaaaatcgaagccggttacacccccgaatacgaaatcgagaaaagcctcagcgcctacctacccctccccgaaaacatccgaaacccaatagtccaacaagccctctacgagctccgacacgttgtcaatgcggtaatcaggacctacggcaagcccgatatcgccagagtagaactcgcaagagagatgaagaagcccaaacaaaagcgcgagaaaatgcgctcggaactacggaagagacagatgaagttcgaagaaataaaaagcatcttaaaggaaagactcggctttatagacccaaaacgcgatgaaatccacaaatacatgctctgggaggaatgcagagaaacatgcccatacaccggccgcaaaatcagcctaagtgccctgtatgggggcgatttcgaagttgaacacatcatcccctacaaacgatccctagacgacagcctattcaacaagacggtatgccttagagaggaaaatcaaatcaaaggagaccgcaccccgtacgaagcatacagcggcgaccgacaaaaatacgaagaaataatcctccgggtgcagaaaacgagcatgcccagaggcaagaaaaacctattcgcgataaaagaactcaaggacgacttcgcccaccggcaactgtccgatacagcctacatatcccgggaaacccgaaaatacctggggtcaaccatcaaaaaggtacaagcggtgaaaggaggctccaccgccaaactacgctactactggggactcaacagtatattaggggtacgcgacataaaaatgcgcgacgaccaccgccaccacgcagtggacgcactggtgatcgccaacacaacatacgcatttgtcaacacacttagcaggtaccactccatggacgtagaaccacacgaatcgcggttccccctaccgtgggaacaattccgaaacgacgcagaaagcgtagtgagaaacatcttcgtaagccacagactcggcaagaaagccactggccaactgcacgaagaaacctactacggaaaaatacgcaatacagacggagaaccatacttcgtagtaaggaagaaactaggcaccctaacggccaaacaaatagcgaacatagtcgacccagtagtaaaaacccaagtcttcgaacgcctagaagaaaaaggcatcgacatagaatcaagcaacaaaatacccgccgacgcgttcgtagagacactgtacatgcccgaccgaaaaacacccatcaagtccgtccgcgtcaaggtaccttccaccacaatgattcaactctacaaggacaaagagctatacgtagaccccgggagcaaccaccacatcgtaatcttcgaaaacgaagagggcaaaagagacggcatagtagtaagtctgttcgaagccgcccaaagacttcggcgaaatgagccggtcatacagaaaacctggaagcccgagtggcacttcgtgatgtcactatcaatcgacgaactaatacttctagacgtcgacgaaaagaacatagactggggcgacacagggctagccctcaggtactccaaagcactgtacagggtccagaaaatggacgtcaacaagatcataaccctacgacaccacctagtagcccgactgaaagacgacgaagggaaagagttcgggcgcgaacaccgaataccaagcacactgaggggactaaaagtcaaaatagaccacatcggcagactgaggcgcgcctacgactga

SEQ ID NO: 6057 - RNA, 2988 nt, synthetic construct
  misc_feature 1..2988: note = Cas9 variant
  source 1..2988: mol_type = other RNA
atgaaagtcatcggcttcgacatcggaatcaactcgatcggctgggcgtttgttgaaaacgacgaactcaaagactgcggagtacgtatcttcaccaaagcggaaaaccccaaaaacaaggagtccctagccctaccgcgtcgaaacgcccggtcctcacgtaaacgcctcaaacgcaggaagctccgactcatcgcaatgaaacacatcttggcgaaagagctaaacctaaattacaaagactacatcgcaaacgacggagaactaccgaaagcctacgagggcaagctaatctcaccatatgaactccgctacaaagcactcaaccaaaagctagaggccaaagacctagtacgtgtcattctgcacatcgccaaacaccgaggctacatgaataagaacgacaaaaagagcaacgatgcagagaaagggaagatcctgagcgctctcaaaaataacgctctaaagctagaaaagtaccaatcggtcggggaatacttttacaaagaatttttccaaaaatacaaggaaaacaccaaggactttataaagatacgaaacataaaggacaactacaacaactgcgttctggccagcgaccttgaaaaagaactaaaactcatcctcgaaaagcaaaaagagttcgggtatagctactccaacgacttcatcgaagaagtaattcaggtcgcgttctttcaacggccactgaaggacttcagtcaccttgtgggcacatgcaccttcttcgaagaagaaaagcgagcctgcaaaaacagctacagcgcctgggagttcgtcgcacttaccaagattgtcaacgaattaaagagcctcgaaaagatctcgggcgagctgatctccacccaaacgatcaacgaaatcctaaactacatactggacaaagggtccatcacctacaagaaattccgatcatacataaacctctatgaaagcataaaattcaaatcactcaagtacgacaaggacaacgcagagagcgccaaactaatcgacttccggaaactcgtcgagttcaagaaagcactcggagaacactactttaaccgacaagaactcgaccaaataagcacatacatcacactaataaaagacaacgtcaagctaaagaccgcattagaaaagtataacctctccaacgaacaaatcaacaatctcctcgaaatagagttcaatgaccacatcaacctcagcttcaaagcactatccatgatactacccctcatgaaggaaggcaagaaatacgacgaagcatgcgaaattgcaaacctcaaacccaaaaccacaaaccaaaaacaagacttcctacccgccttctgcaacagcatatttgtccacgaactcagcaaccccatagtcaatcgcgcgatttccgaataccgaaaggtactcaatgccctcctaaagaaatatggcaaagttcacaagatacacctcgaacttgcgcgagacatcggcctgtccaagaaagcaagagagaaaatcgaaaaagaacaaaaagaaaaccaggccatcaacacatgggcactcaacgaatgcgaaaacatgggaatcaaagccaatgccaaaaacatcctaaagttaaagctatggaaagaacaaaaagaaatctgcatctacagcggcaagaaaatcagcatcgagcacctaaaagacgagaaagcactagaagtcgaccacatatacccctactcccgtagcttcgatgactcgtacatgaacaaggtcctggtcttcaccaaagaaaaccaagaaaaactgaacaaaacaccctttgaggcattcggtaaaaacatagaaaaatggaacaaaatacaaaccctagcacaaatccttccatacaagaagaagaacaaaatcctagacgaaaatttcaaggacaaccaacaacaagacttcatctccagaaacctaaacgacacccggtacatagccacgctaatcgcaaaatacacaaaagaatacctaaacttcctaccgctaaacgaaaatgaaaacataaacctaaaaagcggtgagaaaggctcaaaaatccacatccagactgtgaacggtatgctgacctccgtcctgcgccacacatgggggtttgataagaaagaccgaaacaaccatctgcaccacgccctcgacgccatcatagtcgcctacagcaccaattcgctcataaaagccttcagcgacttcaagaaaaaccaagagctactcaaggcaaaactctacgcaaaagagctcacgaacgacaactacatccaccaagcaaaattcttcgagcccttcgaaggcttccgcgaaaagatactcaataaaatagacgaaattttcgtctccaaaccaccacgaaagagagcccgcggagccctccacaaggagacgttctactccgaaaagaagatgataaagaaatacaacagcaaagaaggactaaacatcgccctagactgcggcaaaataaggaaaattggcaccaagtacgtggaaaacgacaccatggtacgtgtcgacatcttcaagaaacaaaacaaattctacgcgatcccgatctacacgatggacttcgcgctaggaatcctccccaacaagatcgttgtgattggcaaggacaagaacaacaacccaaaacaatggcaagaaatcgacgaatcatatgagttctgcttctcgctctacaaaaacgacctaatactgctccagaaaaaggacatgcaagaagccgagttcgcatactacaacgggttcgacatagactcctcacgcataaatattaagaaacacgacaacaaattcgaaaacctcacctccaaccaaaaactcctctttaccaacaaagagaaaaacagaacaggcatccaaaaccttaaaatattcgaaaagtacatcgtcaccccactagggaacaaaataaaagccgacttccaaccccgtcaaaacatctccctcaaatccagcaagaaaaatggactctga

SEQ ID NO: 6058 - RNA, 2988 nt, synthetic construct
  misc_feature 1..2988: note = Cas9 variant
  source 1..2988: mol_type = other RNA
atgaaaatactgggattcgacataggcataaacagcatcggatgggcattcgtagaaaacgacgagctaaaagactgcggcgtacggatcttcacaaaagcagaaaaccctaaaaacaaggaatccctagctctaccacgacggaacgcgcgaagcaaccgccgacgcctcaaacgtcgcaaatcacgactcatcgcgatcaaacacattctcgcgaaggagctcaacttgaactacaaagactacatcgccaatgatggagaactacccaaagcctacgagggcaagctcactaacgtatacgaacttcgctacaaagcgctaaaccaaaaattagaggctaaagacctcgcgagagtaattctccacatagccaagcaccgaggctacatgaacaagaacgaaaagaaatccaacgactccgagaaaggcaaaatcctctcagccctcaaaaacaatgctctcaaattagaaaaataccagtcggtcggggagtacttctacaaagagttcttccagaagtacaaggaaaataccaaaaacttcataaaaatacgcaacacaaaggacaactacaacaactgcgtcctagcctccgacctcgaaaaagaactcaaactcatcctagaaaaacaaaaggagttcggctactcctacaacgacgacttcatcaaggaaatcatcaacatcgcgttcttccaacgtcccctaaaggatttcagccacctcgtcggctcgtgcaccttcttcgaagaagaaaaacgcgcctgcaagaactcgtactccgcatgggagttcgtcgccctatccaaaatcatcaacgaactaaaacgcctggagaaaataagcggcgaactaatcagcgcccagaccataaacgaaatactcaaccatatactcgacaaaggaaacattacatacaagaaatttcgctcctgcatcaacctccacgaaagcatcgagttcaaatcactcaactacgacaaagacaacgccgaatccgccaaacttgtcgactttaaaaagctaatcgagttcaagaaggcgctaggagaacattcgttcaacagacaagagctcgacgaaatcgctacacacatcactcttatcaaagacaacgacaagctgaaaacagcgcttgaaaaatacaacctcaacaacgaacagatcaacgccctcttggaaatagagttcaacgaccacatcaacttatcatttaaagcactcaatctaatactcccactcatgcgagaaggaaaaagatacgacgaagcctgcgagatcgtgaacctcaaatccaaaacctccaatcagaaacaggacctactacccgccttctgcgattccatcttctcacaagagctgtcaaaccccgtggtaaaccgagccataagcgaataccgaaaagtcctcaacgcgctcctcaagaaatacgggaaagtccataaaatccacctagaactcgcacgcgacgtagggctctccaagaaggcccgcgagaaaatcgaaaaggaacagaaagagaacaaggaaatcaacgattgggcactcgacgagtgcgagaaattcggcctaaaggcgaacaacaagaatatcctaaaactaaaactgtggaaagaacaaaaggaaatctgcgcatacagcggcaagaaaatctccatagaacacctcaaagacgagaaagctctggaggttgatcacatctacccctactcccggagcttcgacgacagttacatgaacaaagtactcgtattcaccaaggagaaccaggaaaaacttaacaaaacaccgttcgaagccttcgggaaaaacatcgaacgctggaacaaaatccaagcccttgcccaaaatcttccctacaagaaaaagaacaaaatcctagacgaaaactttaaagacaaacagcaacaagatttcataagccggaacctcaatgatactcgctacatcgcaaccctcatcgcgaagtacacaaaagaatacttaaatttcctacccctcaacgagaacgaaaacaccaatctcaagagcggcgaaaagggatccaagattcatgttcagaccataaacggaatgctgacaagcgtgctaagacacacctggggattcgacaagaaagaccgtaacaaccaccttcaccacgcattggatgcaatcatagtcgcctactccacaaacagcatcatcaaagcgttctcagatttcaagaaaaaccaagaactactaaaagcaaaactctacgcaaaagaactcaccagtgacaactacaaacaccaagctaaattcttcgaaccgttcgaaggcttccgagagaaaatcctaaacaaaattgacgagatattcgtgtccaagccaccacgaaaacgcgcgaggggcacgttgcacaaggaaactttctatccagaagagactatgatcaagaaatacaactccaaagagggcctcaacatcgccctgaactgcggtaagattcggaaaataggaaccaaatacgtcgagaacgacacgatggtccgactcgacatcttcaagaaacaaaacaaattctacgccatccccatatacactatggactttgcgctcggtatcctacccaacaaaatcgtcatcgcaggcaaagacaaaaataacaacccaaaacaatggcaggagatcgatgaatcctacgagttctgcttctccttatacaaaaacgatctcatcctgctccaaaagaaagacatgcaggaagccgaatttgcctactacaatagcttcgacatcgactcctcccgcatcaacatcaagaaacacgacaacaaattcgaaaatctaaccgacaaccaaaaactcttattcacaaaccaagagaaaaaccgtaccgggatccagaacctcaaaatcttcgaaaaatacatcgtcacgcccctgggtgacaaaatcaaagccgacttccagccgagacagaatatctccctcaaaaccagcaagaaatacggcctatga

SEQ ID NO: 6059 - RNA, 2991 nt, synthetic construct
  misc_feature 1..2991: note = Cas9 variant
  source 1..2991: mol_type = other RNA
atgatgggcaacttcaccctcggactcgatctcggtaccaatagcatcggctgggcgctaatagacttcgatgacaaccaacaacctcaaaacctgatcgcctgcggatcccgcatattccaagaggcggtagaagcaaagacaggcacacccaaaaaccatgcacggcgcgccgcaagagcagcacgcaagctagtcgcgcggcggaaacagcgccgaaccaaactcttaaacctcctggtgtgccacgacctcctcccacaagacgaagccgagagaaacgccctactcctggacaaccaggcgaacaacccctatcagctaagaaagcgcggcctagacgagaaactagaacccttcgcatttggcagagctctatatcacctagcccaccgacgaggattccaaagcaaccgaaaagcggcaagcgacgaagacggaaaagtaaaaaccgccatttcagcgctccgagcagaaatgcaaggacacaccctcggagcctttctagcggaccaaccaacacagcgccgccggtacacagaccgagcaatgtacgccgaagagttcgaacaactctggagcaaacaaaccatattcgctccagaacaactaacgcaagcactcaaagtagaaattaaaaacagcatattcttccagagaccactaaagtctcaaaagcacctagtcggaaagtgcaccttcgaacccacacgcaaacgagcagcaaaagcaatcctcttagcacaacactttcgcattctccaagacgtcaaccacctcgccgtcaaaaacccaatcactcgcgagttccgaccactaacccaggacgaacgaaataaactggccgaggcactcgacaaacaaaaaggcatgaactggagcgcagtacgcaaggtcataggatggaataagaaagactccctccacgaaggagaaacattcaaccttgaagaggggaaaaaggacaaactgatcggcaatagaacagcatgcgaccttcgaggcgccctcggcgaccgatgggacgcattcaccgccccgcaacaagacgacctggtcacagacctattgaccatagacaatcccgacggcttcctcaaacgaatgaaaacccactggggattcgacgacgcaaccgccgaagcactagcaacaacagagctcgagcccggctacgcacgcctatcctcaaaagccatgcgcgccatcctccctcacctagaacaaggcatgatttatagcgacgcatgcaaagcagccggatacgaccactcaaaccccaaccagcgaacgatcaccgacaaactgggcctccccagcaacgtcagaaaccccgtcgtacaaaaagcgctattcgaaaccagaaaggtcgtaaacgcaatcgtccgaaaatatggaaagcccgcagtaatacgagtcgaaatggcacgagacatgaaactgagcaaacggcaaaaagaagaactccaaaaggaacagaataaacaaaagaaagcaaacgaactcgcggaaggaatcctccgcaaagagttcgggatacaacaacccgccagaaccgacatacaaaagtacaacctatggttggaatgcaaagaggtctgcccctacaccggcaccgtcatctcccgggagatgctgtattctccagaagtagacgtggaacacatcctaccctactcccgctccctagatgactcctacatgaacaaaacactctgtatggcaacctacaaccgacaaacaaaactaaacaacacaccctacgaaatcgggcaaggagacccagtggcctacgcagaaatcttccagcgaatcaaaaccctgccgttcccaaaacgacgccgcttcgaacaaaaagaaatcgaaacagacaaattcatagaacggcagcttaatgacacgcgctacatatgcgtagaagtccgtgacttcctgcagcagctgggagccccagtggaggtatcgaaaggagaggcgacggccaaattaagaggccggtggaagctgaacacactactctcccccggcggaggcaacgagaaaaaccgggcggaccaccgccaccacgcaatagacgcagtcgtaatagcattaaccaacagatccttgttccacaaactatcccgactctctgcccaaagcatctcgttcgataaaagccgttttgacgtaccacccccatgggacgacttctacgacgacgtctacgagaaaatagacaaggttatagtctcccacgcacccactcgaaagatatccggtgcgctccacgaagccaccgcatacggccacttcaaagaagaaatagcggacccgaaaacaggtaaattcagcatagaagaccgcttcgtatacagaaaacccctaaccacactcacagcgaacgaagtagggaaaattcgcgatgccaaagttcgcgagctagtagaagcaagactggcccagttcggaaacaactcgaaagccgccttcggggaccccaacgaacccctcctacacgccgacggcaaaaccccaatcaggaccatccgcctaaccaccaacttcaacaagacaactacccacgccatccagaaaggacaagaccgcgactacaaattcttcaagtacggaaacaatcatcacgtcgaaatcatcgaacacgtcgaaacgggcaaaagaaaagggatcttcgtcaccgcgatggaagcagcacgacgcgcgcgcggcgtcgcaaataccgaaaagagcaatatcgtccaaagaaaccacggagatggctggaaattcgttatgtccctcgcggtaaacgacatggtacgaaccgaagacacacaggccatctacagagttcaaaaactcgacggaagcaacaaccgcttcaccctgagatcgcacaacgcagcgacactcgacgacaagcaaacgggcgtcgacaagacccccaacctcttcaaaggaacaaagatcatcgtagacccactcgggaacctaacacagtgcaacgactga

SEQ ID NO: 6060 - RNA, 2994 nt, synthetic construct
  misc_feature 1..2994: note = Cas9 variant
  source 1..2994: mol_type = other RNA
atgaaggtgctcgtcgacgcagggctaatgccatcagacccggccgcagccaaggcactagaaacgctagacccatacgaactacgagcgaccggactagacgtgatgctcccactaacacaccttggccgcgccgtattccacctcaaccaacgaagaggattcaaatcaaaccgtaaaacagaccgcggagataacgaatccgggaaaataaaagacgccacgaagcgcctcacgtgggccatgcaagaagcgggagcaagaacatacggggaatttctacacatgcgacgagcacgcgcgtccgacccccgtcaagtaccatcagtacgaaccaggctttccgttgcaagccggggtggaccggactcaaaggaagaagcaggatacgacttctaccccgaaagggcacacctagaagacgaatttcacgcactctggtccgcccaagctgccttccatccagaccttacctgcgaactcagagacgtagtcttcgagaaaatattctaccagcggccgttaaaagaaccaaaagtcggactgtgtctcttcacagccgaggaaagattaccaaaagcccacccactgacagggcgcagagtactatacgagacagtcaaccaactgagagtaacggcagacggccgcaccactcgccctctcactctggaagaacgcgatatgatagtttacgcactagataacaagaaacccgtcaaatcattatcaagcatgcacctcaaactcgtagccctaggcaaactcgtgaaactcaaagacggcgagagattcaccctcgagagcggagtccgagacgcaatagcttgcgatccaatcagagccacaatgggccaccccgacggattcggccccgcatggagcagactagactggcaggcgcaatgggcgctgatagaaaaactacgacaagtccaaagcgacgacgacttcgccagtctagtcgcctggctaggggcaactcataacctatccgaagaccacgcaaaaagagtagcaaacctacatctgccggaaggatacggacgcctaggcctaaccgcaacagaggcgatcctctgcaacctcaaagcagaagtatgcacctactcgcaggcagtcgagcggtggggaaagcaccacagcaaccaaagaacaggagaatgtctagaggcacttccctactacggagaagtcctggaccgccacgtcatacccggcacctacaacgaagacgacgatgacgtaaccagatacggcagaatcactaaccccacagtgcacataggcctaaaccagctccggcggctcgtaaatcgcataatagccacatacggcaagccggatcaaatcgtcgtagaactcgccagggaactaaaacaatccgaggcacagaaaagtgaagcactcaagaaaattcgagacacaacagccgacgcaatacgacgaggcagacaactggaagaaatagggcagaaaaacaccggcgcaaacagactactcctcagactctgggaggatctgggcccggccgtcggcccacgatgctgcccctacacagggaagccgatctcagtcacaatgctattcgatggcgcatgcgacgtcgaccacatactaccgtactcgcgcaccctcgatgactccttcgcaaacagaactatatgcctacgcgaagccaaccggcaaaaaggcgaccgcaccccatgggaagcatggggcggtagcgaccaatgggatgcaatagaagccaacctaaaagaccttcccgaaaataagcggaaacggttcgcaccagacgcaatggagcgattcgaaggcgaacgcgacttcctcgatagggcactcgtcgacacccaatacctcgcgcgcataagcagggcatatctcgacaccttattcacagaaggcggccacgtctgggtcgtcccaggcagaatgaccgaaatgcttcgcagacattggggactcaatgcgctgttaagcgacaaggaccgaggcgcgggaaaagtcaaaaaccgcacagaccacagacatcatgccatagatgcagccgtcatcgccgcaaccgaccactccctcgttaacaggatctcaaaagccgcgggacaaggcgaatccgccggacaaagtgccgaacttatcgcaagagacacgcccgagccatgggaaggattcagaaacgacatatcagctcaaatagcccggatagtagtctcccacagagccgaccacggccgcatagacgtcgaaggccgcaaacacggcaaagacagcactgcaggacgcctccacaacgacacagcctacggaatcgtagacgaccacacagtggtgtccagaacacctctccttagcctcaaacctggtgacatcgaagtcacaaccaaaggcaaaaatataagagacacgcaactgcaaaaagcactctcggtcgcaacaacaggaaaagacggcaaagggttcgaagaagccctccgaaacttcgcggaaaaagaaggcccataccaaggaataagacgcgtacgcctcatagaaaccttacaatcaagcgcacgagtcgaagtaggcagcgacgaagacggacagccactaaaagcatacaaaggcgactccaaccactgttacgacctctggaaactcccagacggaaaagtagtcccccacgtagtcagcacgtacgaagcccacgcgggaaccgataaacgcccccacccagcagccaaaagaatcctacgggtcttcaagaaggacatggttgcgatagaacaagatgaccaaaccgccatattctacgtacaaaagctcgaccgcgccaacggactattcctcgcacctcacctagaagccaacgccgacgcgcgacaccgcaacccgaacgacgcattcaaattcctacaaatgggagcgggctccgtagtccgaaacaaacttagaagggtctacgtagatgagatcggccgcataaaagacccaggccctccaaaacattga

SEQ ID NO: 6061 - RNA, 2994 nt, synthetic construct
  misc_feature 1..2994: note = Cas9 variant
  source 1..2994: mol_type = other RNA
atgaagatcctcggcttcgacattggcatcaacagcataggatgggccttcgttgaaaacgacgaactcaaggactgcggagtacgtatcttcactgaagctgaaaacccctccaacaaggaatccctagccctcccccgtcgcaacgcccgatcctcacgccgacggcttaaacgacgaaaagccaggctcgtagcaattaaaagaatactagccaaagaactcaagctcaacttcaaagactacgttgcagcagacggcgagctgccaaaagcatacgagggcaaactcacctcaatctacgaactcagatacaaagctctcatacaacaattggaaaccaaagacctagcacgtgtcatcctccacatcgcaaagcaccgggggtacatgaacaaaaacgaaaagaaatcaaacgacaccaagaaaggaaaaattctctcggccttgaaaaacaacgccctgaaactcgagaactaccaaagcgttggcgaatacttctacaaagagttcttccagaaatacaaagaaaacaccaaaaacttcataaaaatcagaaacacaaaggacaactacaataactgcgtcctttctagcgaccttgaaaaagaacttaaactcatcctcgaaaagcaaaaagagttcggctacaactacagtgaagacttcattaacgaaatactcaaagtagccttcttccaaaggccccttaaggacttctcgcacctcgtcggagcctgcaccttctttgaggaggaaaaacgagcttgcaagaactcatacagcgcctgggagttcgtcgccttgacgaaaatcatcaacgaaatcaaatccttagaaaagatcagcggagaaatcgtccccacccaaacaatcaacgaaatactcaacctgatcctcgacaaaggcagcataacatacaagaaatttcgatcctgcatcaacttacacgaaagcatcagcttcaaatcgctaaagtacgacaaagaaaacgccgagaacgccaaactcatagacttccgaaaactcgtagagttcaaaaaggcactcggtgtccactccctgagccgtcaagaactcgaccagatctcaacacatattaccctaatcaaagacaacgtgaaactcaaaaccgttctcgagaagtacaacctaagcaacgaacaaataaacaacctactcgaaatcgagttcaacgactacataaacctgagcttcaaggccctaggaatgattctacccctaatgcgcgaaggaaagcgatactacgaagcctgcgaaatcaccaacttaaaaccaaagacagtcgacgaaaaagaagacttcctgcccgccttctgcgactccatcttcgctcatgaactctcaaaccccgtcgtgaaccgagcaatctcagaatatcgcaaagtactcaacgcccttctcaagaaatacggcaaagtacacaaaatccacctggagctagcccgagacgtcggactctctaaaaaggcccgcgagaagatagaggatcaacagaaaaacaacaaagccatcaacgactgggccctcaaggaatgcgaaaatatcggcatcaaagcgtcggccaaaaacattctgaagctcaaactatggaaagagcaaaaggaaatatgcatctactcagggaacaagatctccatagaacacctcaaagacgagaaagccctcgaggtcgaccacatatatccatatagccgcagctttgacgatagcttcatcaacaaagtccttgtcttcacaaaagaaaaccaagaaaagctaaataaaacaccattcgaagcattcggcaagaacatagagaaatggagcaagatccaaaccctcgcccaaaacctcccatacaaaaagaagaacaaaattctagacgaaaactttaaggacaaacaacaacaggacttcatttcccgcaacctcaacgatacgcgctacataaccacactcatcgcaaaatacacaaaagagtacctcaacttcctcccgctctccgaaaacgaaaacaccaacctcaagtccggcgaaaaaggctccaaaatccacatccaaaccatatcgggcatgctcacctcagtactccgccacacctggggattcgacaagaaagaccgaaacaaccacctccaccacgcgctagacgccatcatagtcgcctactcgacctcttctataatcaaagccttcagcgactttaagaaaaaccaagagctcctgaaagccagattctacgccaaagaactaaccagcgacaactacaaacaccaagtaaagttcttcgaaccattcaaagggttccgagagaaaatcctctccaaaatagacgaaatattcgtcagtaccccaccccgaaagagagcccgaggggccctccacgaagaaactttctattccgaagacaaaatgatcaagaagtacaacagcaaggaaggtctccaaatcgcactgtcctgcgggcgagtccgcaagataggaaccaaatacgttgagaacgacactatggtgcgagtggacatcttcaagaaacaaaataagttctatgcgatccccatctacgtcatggacttcgccctaggaatactccccaacaagatcgtaataaccggcaaagacaagaacaacaatccaaaacagtggcaaaccatcgacgagagctacgagttctgcttttcactctacaaaaatgacctcatcctcctccagaagaaaaacatgcaagaaccagagtttgcttactacaacagcttcgacatcgaccgctccagaataaaaattaagaaacatgacaacaaattcgaaaacctaacctccaaccaaaaactcctattcaccaacaaagacaaagggaaaaacagaaccggcatacagaacctcaagatatttgaaaagtacatagtcacacccctcggcgacaagataaaggcagacttccagccgcgcgaaaacatcagcctcaaaacatcgaagaagcatggactctga

SEQ ID NO: 6062 - RNA, 2994 nt, synthetic construct
  misc_feature 1..2994: note = Cas9 variant
  source 1..2994: mol_type = other RNA
atgggcaactacacactcggcctggacatcgggagcaactctatcgggtgggccctggtagaagacgccgtagaagcgccaagaatagtagacatgggagtgcgagtcttcccagagggggtagacagagacacgaaaggactggaaaagagcaaaaacgccacgcgccgcgaagcacggggagcacgacgaacccatcaacgcaggcgccagcgtaagcagcgactggtacgagcactgagacaggtaggcctgctcccatgcgacaaggcggaggtaaggtccttattccaaaccgacccgtacgaaatacgaaaaaggggtctagaccaccgactagaactatacgaaatcgggcgagctttctatcacctaagccaaagaagaggattcaaaagcaacaggaaatcaggagccctaaaagaagacgggacggtgaagaaagaagcaggcgaactacaacggaaaatagacgaagcaggatgccggaccataggggagtacttcgccggactggaccccgaacaacagagaattagagggcggtacacattcaggagcatgtaccagaaagagttcgacctactatgggctaaacaggtggaattttaccccaaggtactaaccgaggacctacggtcaaaagtccgcgacgagataatattcttccaacgacccctaaagagcgcgaaagacctgataggcgactgcgagctagaaccgacggaaaagcggtgcccaagagccgattggtacgcacggagattccgactactgcaggacataaacaacctaataatacaaaacccagacggcacggaacagaaactctccccagaccagagagcagccctactaggggagctaggccaacgggagaaactcacattcgataacatacgcgccaagctaggactactggaaacacaaaaattcaacgcggaataccgaatcggcagaaagggaaagaaagtagaagcaataaaaggagacgtcttcgtctggacgatgagaggcaaaagtgtattcggacccaaagcatgggatgccatggcagacgagcgcaaagtaagcctaaacgaactgttcgtcgaattagaagacgacgacctcgcaagaaaactcgagacggagtacggactcacagataaacaagtacaagcggcaatgaaagcaagcctccctcaaggatacatgagttttagtagaaaagccgtactaaaactcttacccttcatggaggcgggcgcactaacgcatgaagcaatcgaccaagcaggctacagaaaagaggagcccacgcagacagacgcgatcgcgagggtctccttcccaccagacctaaggaacccaatcgtgcaaaaagcactcttcgaagtgcggaaggtcgtaaacgcgcttgtccgagagtacggaaaacccacacgaattaagatcgaaatggcaagagacgtgcagggatccaagagacaacgagaagaactacattggaggaacgaagacaatagaaagaaaaacgaggaagtgcgcgacaggctacgcacagacatacacatcgacgacccgtcacgagacgatgtaatcaaatacaagctatggcaagagtcaggaaaaatgtgcccatacaccggacgccaaatctgccaggaagctctcttcggacccaacccagagttccaggtagaacacatcctaccatacgacaggagtctagacgacagctatatgaacctaacgctctgcgaagtccatgaaaacatacacggcaagcgaaaccaaacaccattcgaagcctacggcagcggagcagaaagatacgaacagataaaacaaagaataaaagtcctaccctggcccaaaagacaaaaattcctacaacaagagataaacctagacagccacatatctagagaattaaacgacaccaggtacatatgccgcgaaaccgtcgcatacctcaaacagctaggagtacacgtgcgaggaacacgaggaaagataaccgcagagctgagacaccaatggggcctcgacgggatattcagcgaactcggagtccggagagacgacgaccacagacgacacgctgtagacgccctagttgtggcagtaacggacaacgaacacctacgacgactcgccgtaagtaagtacgtattagccggaccgaggttcgaaacgccctggtcagcgttcagggacgaagccagggggaacgtcaagagaatgaacgtgagccacagggtctgccgcaaggtgagcggcgcactgcacgaagaaacgaactacggccccacaggagtgcgagaccaggcaggacaggacatctacgcgtatagaaagaaattagaagacttaaccacaccgatggtggagaaaatcgtggaccccgtcgtacgggacatagtcagacaaaggttgttaatgaagggaatcgacccggcggccgccgacagaaaaataccaaaggacgtctggaaagaaccactctatatgcggagaacaaagagcgacaaaatgatccaaatacgaagggtacgaatacacgacgtcaagaacagcataatagtactcaccgatgagagcggaagaccataccgagcagtagaaccagggggcaaccaccatgtcgaagtctttgaatacgtccacggaacaaagacaggaaccagggaagcagaagtcgtcacgatgttcgaggcagtgaggaggtcacgagcaagggcaccagtcgttaggagggaccacgggccagggacacgcttcgtctgcagccttgcaataaacgacatggtgatgatgcccgataaaagcggcaaaatggacctattcagaatccagaaaatgagcgcatccaagcaagtctacttcagacaccacacggcggcacgaatagactcagaaagaacactgatacggaaacaggcacacctgttcaacgggtacaaggtgagcgtggatcccacaggagcaatatgtcgggcaaacgattga

SEQ ID NO: 6063 - RNA, 3000 nt, synthetic construct
  misc_feature 1..3000: note = Cas9 variant
  source 1..3000: mol_type = other RNA
atgaagatactcggattcgacattggcataaacagcattggatgggccttcgtcgaagacaaccaactccaagactgcggagtccgcctattcacaaaggcggaagacccaaaaactaaagagtcccttgcactcccgcgacgcaacgcgagatcaaaccggcgacgactcggacgaaggcgatcgaggctcatagcccttaaacatatcatctctaaaggcctaaaactaaactaccaagactacatcgccaatgacggggagctcccaaaggcctatgaaggcaggctcatatcaccctacgagctccgatataaggccctcaacgagaaaatcgaaccaaaggacctcgcccgagtaatcctacacatcgcaaaacaccgcggctacatgaacaaaaacgaaaagaaaagctccgacaacgaaaaaggaaagatcctgtccgcactcaagaccaacgcattgaaacttgaaaagtaccagagcgtcggggagtacttctacaaagagttcttccagaaataccgcgaaaataccaaagacttcattaacatccgcaacaaagaaggcagctatgaaaactgcgttctagcttcggatctcgaaaaggaactaaaactgatcctagaaaagcaaaaggaatgggggtacagctacaacgacaacttcataaaagagatcctgaaagtcgcattcttccagcgaccacttaaagacttctcctacctcgtcggggcctgcacgttcttcgaagacgaaaaacgcgcctgcaaaaactcctatagcgcgtgggagttcgtagcacttacaaaaatcataaatgaactcaagagcctggaaaaagagtccggtgaactcgtctccagccaaattatcaacgaaatactaaaccacattctcgacaaaggcagcatcacatacaagaagttccgagagtacatcaaactccacgaatccatgaagttcaaatccctgaagtacgacaaagacaatgtcgaatcaaccaagctcatcgagttccgaaaactcgtcgagttcaaaaaggcgctcggcgaacactcactcagccgcgaggaactcgaccagatagccacctacataacactaatcaaagataacgaaaagctcaagatcaccttagaaaaatacagcctcaacaacgaacaaatcaaaaacttactcgagatagacttcaacgaccacatcaacctctccttcaaagccctcaatctgatcctccccctcatgaaggaaggaaagcggtacgacgaagcatgcaaactcctaaacctcaaaaccaagtccaacaatcaaaagttcgactttctacccgccttctgcgacagcatcttcgcccaagaactcactaaccccatagtaaacagagccatttcagaataccggaaagtgctcaacgcgctactcaagaaatacggaaagatgcacaaaatccacatagaactcgcccgagacatcggactgtccaaaaagctccgagccaagattgaaaaggaacaaaaagaaaactatgaaaataatatctgggccctgaacgaatgcgaaaagttcggcctaaaagcaaacgccaaaaacatactgaagttgaaactgtggaaagagcaaaaagagttctgtatctacagcggcaagaaaataagcatagaacacctccgcgacgaaaaggcactagaagtcgaccatatctacccatactcccgcagcttcgacgattcattcctcaataaagtcctcgtcttcacaaaagaaaatcaggaaaagctcaacaagaccccattcgaggcattcggagcgaacgaagaaaggtggagcaaaatccaggctctcgcccaaaacctcccctacaagaagaaaaataaaatactcgacgaggccttcaaaggcaagcagcagcaagatttcatctcacgtaatctaaacgacacacgctacataagcacactcatcgtcaaatacacaaaagagtacctcgacttcctacccctggacgaaaaggaggacgttaacctcaagtccggcgaaaaaggctccaaaatccacgtccaaaccattaacggcatgctaacctccgtgctcaggcacacatggggcttcgcacaaaaggaccggaacaatcacctccaccacgcactcgacgccaccatcgtagcatactcaacgaacgcaataatcaaagccttttcggacttcaagaaagaacaagaactactaaaagccaaactctacgcgaaagaactcacctccgacagctacaagcaccaagcgaaattctttgaacccttcgaaggcttccgcgaacagatactgaaccagatcaacaaactcttcgtatccaaacccccgcgcaaaagggcccggggcgccttgcacaaggaaaccttctacagcaaagatgagatgatcaagaaatacaactcacaagagggcgtggaaatcgcgctcaattgcggaaaaatccgcaaaattgggaccaagtacgtggagaacgacacaatggtaaggatcgatatcttcaagaaacagaacaaattttacgcgataccaatctacacaatggacttcgcgctcggtgtactccccaataaaatagttataatcggcaaggacaagaaagggaatcccaaacaatggcaagagatcgacgaatcctacgagttctgcttttcgctacacaaagacgacctcgtcctcatccaaaagaaagacatgcaagaacctgagttcgcatactacaacgggttcgacatctccaactcaagcatctgcgtagaaaaacacgacaacaagttcgaaaacctgacagataaccagcgcctcctcttcaccaacgccgaaggcaacgtaaaggcaaagaaaatcggaatccaaggcctaagaatcttcgaaaaatacataataacaccccttggcgagaaaataaaagcggactttaaaccacgggaagacatcgcactaaaaaccagcaagaaacacggcctttga

SEQ ID NO: 6064 - RNA, 3003 nt, synthetic construct
  misc_feature 1..3003: note = Cas9 variant
  source 1..3003: mol_type = other RNA
atgaagatcctcggctttgacataggcatcaactccatcggctgggcatttgtcgagaacgacgagctcaaggactgtggagtacgaatcttcacaaaagcagagaacccgaaaaacaaagaatcgctcgccctcccgcggagaaatgccagatcgtcgagacgccggttaaaacgccgcaaagcgcggctaatcgccataaagcgcattctcgccaaagaactcaagctcaacttcaaggactacgtcgctgccgacggagagctgcccaaggcttacgaaggcagcctcgcaagcgtatacgaactacgatacaaagcactcactcagaaactagagacgaaagacctcgcccgagtaattctacatatagccaaacaccgaggctacatgaacaagaacgagaaaaagtcgaacgatgcgaagaaaggaaaaatcctctcagccctcaaaaacaacgcgttaaaactcgaaaattaccagtccgtaggcgaatacttctacaaagaatttttccagaaatacaaggaaaacaccaaaaacttcataaaaatccgtaacaccaaagacaactacaacaactgtgtattatcttccgacctagaaaaagaactcaaattcatcctggaaaaacaaaaagagttcgggtacaaatacagcgaggggttcatcaacgaaatccttaaggtcgcattcttccaacgccccctaaaagacttcagccacctggttggcgcatgtaccttcttcgaagaagaaaatcgcgcgtgcaagaactcatactccgcatgggagttcgtcgccctcaccaagattataaacgaaatcaagtccctagagaaaatcagcggggaaatcgtatcgacccagactatcaacgaagtcctcaacttaatcctagacaaaggctccataacctacaagaagttccggtcgtgcataaacctccacgaaagcattagcttcaaatcactaaagtacgacaaggaaaacgccgaaaatgcgaagctcatagacttcagaaagctcgtcgagttcaaaaaggccctgggcgtacactccctaagcagacaagaactcgaccaaataagcacccacgtaacactcattaaagataacgtcaaactgaagacggtactcgaaaaatacaacctctcaaatgaacaaatcaacaacctactagaaatcgagttcaacgactacataaacctgtcgttcaaagcgcttggcatgatcctacccctaatgcgggaagggaaacgatacgacgaagcctgcgaaatcaccaacctcaaaccaaaaacggtcgacgaaaagaaagacttcctccccgccttctgcgactccatcttcgcgcatgaactctccaacccggtagtcaacagagccatctcagaataccggaaagtactgaacgcactactcaagaaatacgacaaagttcacaaaatccacctcgaactcgccagagacgtcgggctctccaaaaaggcacgggagaaaatcgaaaaagagcaaaaagagaaccaggccgtcaacgcatgggcccttaaggagtgcgaaaacatcgggctcaaggcatctgctaagaacatccttaagctcaaactttggaaagaacaaaaagaaatatgcatttacagtggcaataaaatctccatcgagcacctaaaggacgaaaaggcactcgaagtcgaccacatctacccctacagccggtcctttgacgattcattcatgaacaaagtacttgtcttcaccaaggaaaaccaagagaaactcaacaagacaccgttcgaggcattcggtaaaaacatagagaaatggtctaaaatccaaaccctcgcgcaaaacctcccgtataagaaaaagaataagatactcgatgaaaacttcaaagacaaacaacaagaggacttcatatctcgcaacttaaatgacacccggtacatcgcgacactcataacaaaatacacgaaagagtacctcaacttcctgcccctcaacgagaacgaaaacaccaatctgaagtcaggagaaaaaggaagcaaaatccacgtacaaactgtcaacggcatgctaacatccgtgcttcggcacacatgggggtttgacaaaaaggaccgcaacaaccatctccaccacgccctcgacgccatcatcgtcgcctactctaccaactctatcataaaagccttctcggacttcaagaaaaaccaggaactccttaaagcgagattctacgccaaagaactaacatcagacaactacaagcaccaagtcaagttctttgaacccttcaaaggcttccgagaaaagatcctatccaagatcgacgaaattttcgtaagcaagccaccacggaaaagggcccgcggcgcattacacaaagaaaccttctacagcgaagacgagatgatcaaaaagtacaactccaaagaaggccttcaaatcgccctcagctgcggacgcgtgagaaaaataggaacaaaatacgttgaaaacgacacgatggtacgggtggacatattcaagaaacagaacaaattctacgcaatacccatctacgcaatggactttgcactcggcatcctccccaacaagatcgtcgtagtcggcaaggacaagaataataacccgaagcagtggcaaaccatagacgaaagctacgagttctgcttctccctatacaagaacgacctaatcatgctccagaagaaagacatgcaggaagcggagttcgcttattacaacggcttcgatatatccacatcgagcatctgcgttgaaaaacacgactcgaaattcgaaaacctaacctcaaaccaaaagctcctcttctccaacgcaaaagaggggtccgtcaaagtcgagaacctggggatacaaaacctaaaaatcttcgaaaaatacatcatcaccccacttggagataaaattaaagccgacttccaaccaagagaaaacatatccctgaaaacctcaaagaaaaacggactgtga

SEQ ID NO: 6065 - RNA, 3003 nt, synthetic construct
  misc_feature 1..3003: note = Cas9 variant
  source 1..3003: mol_type = other RNA
atggcaagagcccaacgacgcctcatctccagacgagccaaccgcatgaacaaactacgtcgcctgctcaaacaggaaaacgtcctacaagccaacgactacgacgaaaaaggcctaatcatcgggctcccaaaccaggcatgggaactaagggcccaagggctagatcgaaaactagagcccaaagagtgggcagccgtcctcatcaacctcgtcaagcatcgaggatatttatcccagcgcaaaaacgaaagccaaaccgcagacaaagaactaggcgcactactatcagggatgaaccacaaccaccaactcctccagtcacaaagcaaccaatacagaaccccagcagaactagcaatcaaacaatttgccacccaggacgggcatatacgaaaccagagaggagcctacacacacacattcaacaggctagacctacaaaatgaactcaaccaactattcgatgcccaaacccgcctcggtaacccacacgtgtccgggagcctaaagaccgccatcaacgacctactcatgaaccagaaagcggcgctatcaggagacgccatcctcgaaatgctcggccgctgcactttcgagcccagcgaatacaaagcagccaaaaatacctactccgccgagcgcttcgtctggctcggaaaactcacaaacctacgaatacaggacaacggcctagaaagcgcactctctcgcgaacaacgcgaattactcctaaacgaaccctacaacaagaccaagctcacataccaacaagtccgcaagctcctccgcctacccgaaacagcctttttcaaaggcctcagatacggcaaagacaatgccgaatcggcaacattcatggaaatgaaaagctaccacgcaatccgaaagtcactcgaaaacaaaagcctcaaaagcgaatgggaaaaactcaaaacccaaccgaagctcctcgacctcatcggcacagcattctcaatctacaaaacagatgatgagatcgcaggatgcctcaaaaaccaactaccagaaaacgtcataatcgccttacaagagcaactcaactttagcaactttatggaactatccctcaaagccctagagaagctcctcccactcatggaacaaggactacgctacgacgaagcctgcacgcagatctacggaaaccgacatgagaaaatcgccgacaaaaccgaaaaattcctacctaacatccccgccgacaaactacgcaatccagtcgtcctcagaaccctcacacaggcgcgcaaggtgatcaacgccatcattcgacgctatggcagcccagcgcgcgtacacatagagacaggccgagaggtagggaaatcattctcagatcgcgacaaactgaagaaacagcaagaggaaaaccaagaacaacgcagacgagcgatagacgaatggaaacaattctttcctaacgcggctcacgaacccaaggcagttgacatcctcaaactccgcctataccagctccaacagggcaaatgcctctacagtgggctgcccatagacgtgcgccgcctcccagaaaaagggtacgtagaaatcgaccacgcgctaccattcagcagaacatgggacgactcgttcaataataaaatcctggtactagcttcggaaaaccaaaacaagggcaaccaaacgccatatgaatacctacgtggagcagacaacagcgaatcttggcgactattcgtcgagaacgtgcaaaactgccaattctcacccaataagaagcagaaaatcatggctaaacaactagatgaaaaaggcttcctcgagaggaacctcaacgacacccggtacgtttcaagattcctatgccaattcatctcagagcacctacacctaacgggcaaaggaaagaagcgcgtcttcgcgtccaatggccaaatcactgcccttctacgtggcagatggggactaagcaaaaaccgagaggaaaatgacagacaccacgccgtggacgccgtcgtcgtagcgtgctcgacagtcgcaatgcaacagaaaatcacccaattcgtccggtatcaaaaaggaaatgtcttcacgggcgaacgcatcgacaaagagaccggagaagtcatctcaatccactttcccacgccttgggagcacttccgcgaagaagtaatgatccgagtattcgatgacaaccccctcaggaccctacccgaaaaactacccaaccgcccagaagcactccacgaatacgtcatgccgctattcgtatcccgcatgccgactcgaaagatgacaggccaaggccacaaggaaacaatcaagagcgccaagagactagacgagaaaatctctgtcctacgagtgcccctcacacaactcaaacttaacgacctcgaaaacatggtaaaccgcgaacgcgaacccgcattatatgaagcgctaaaagcccgcctggaacaatttaaaaacgaccccgccaaagcgttcgcggaaccctttttcaaacaaggaggccaacaagttaaagcagtccgcgtcgaaattgttcaaaaatcaggcatgcttctaagaaaaataaacggagtcgccgacaacggaagcatggtccgagtagacgtcttcgaaaaatcaggtaaattctacctagtcccgatctacgcatggcaagtcgccgaaggcattctcccaaattacgccgtggtcgctcataaagacgagtcagactggatcttaatggacgaatcctaccacttcaagttcgcactctacaaaaacgacctattagaggtgcaaaccaagaaaggaggcataatgggctacttcgcaagcctagatagagccacgggcgccatcacaatacgagaacacgaccgcgacaaaaagaaatgcaaagatggggaacatcgcagcattggcgtgaaaatggcctcgtcattcaagaaactgcaggtcgacgaactcggtaaaaacatacatgaaacgcgatcgcgcaaaaggcccaacatcggatga

SEQ ID NO: 6066 - RNA, 3012 nt, synthetic construct
  misc_feature 1..3012: note = Cas9 variant
  source 1..3012: mol_type = other RNA
atgcgcattcttggcttcgacatcggcatcaactcaataggatgggcgttcgtcgagaacgacgagctgaaagactgtggggtccgaattttcacgaaggccgaaaaccccaagaacaaggaatccctagccctcccaagacgaaacgcgcgctcaagtaggcgccgacttaagcgccggaaagcgcgcctgatcgcgattaaacgcatcctcgccaaagagctaaaactcaactacaaggactacgtcgccgcagatggcgaacttccgaaggcatacgaaggctcacttgcctcagtctacgagctacgttacaaggccctcacccaaaacctagagacgaaagacctcgcgcgcgtgatcctgcacatcgccaaacaccgaggatacatgaacaagaacgaaaagaagtcgaacgacgcaaagaaaggaaaaatcctctccgccctcaaaaacaacgcgctaaaactagagaactatcagtcggtgggtgaatacttctacaaagagttcttccaaaaatacaagaaaaacaccaagaacttcatcaaaatcagaaacacaaaagacaactacaacaactgcgtactaagctccgacctcgaaaaagaactgaaactaatcctcgaaaaacaaaaagagttcggctacaactatagcgaagacttcatcaacgaaatcctaaaagtcgccttcttccaaaggccactgaaggacttctcacaccttgtcggcgcatgcaccttctttgaagaagaaaagagggcctgcaaaaactcatacagcgcatgggaatttgtagccctaacaaaaatcatcaacgaaattaaaagcctcgagaaaataagcggagaaatagtcccaacgcaaaccatcaacgaggtcctaaacctaatcctcgacaagggcagcatcacctacaagaagttccggagctgcattaacctgcatgagtctatcagcttcaaatctcttaagtacgacaaagaaaatgctgaaaacgccaaactcatcgacttccgcaaactcgtagaatttaagaaagccctaggcgtacactcactctcccgccaggaactagatcaaatatcaacgcacatcacgctaatcaaagacaacgtcaagctcaaaaccgttctagaaaaatacaatctctcaaacgaacaaatcaacaacctactcgaaatagagttcaatgattacatcaacctcagcttcaaggccctcggaatgatccttcccctcatgcgagagggcaagcgctatgacgaggcttgcgaaattgcgaacctcaagcccaaaacagttgacgagaagaaagacttcctgccggcgttctgcgactcaatattcgcccatgaattatcaaacccagtcgtcaaccgggccatcagcgaatacagaaaagtacttaacgctctcctcaagaaatacggaaaagtccacaaaatacacctcgaactcgcccgcgacgtcggcctctctaagaaagcgcgtgagaaaatcgaaaaggaacaaaaggaaaaccaggctgtaaacgcgtgggccctcaaagaatgcgaaaacattggacttaaagcctcagccaaaaatattctaaaactcaagctgtggaaagaacagaaagaaatctgcatctactctggcaacaaaatctccatcgaacacctaaaagacgaaaaagcacttgaagtcgaccacatatacccctacagccgcagcttcgatgactcattcattaacaaagtcctagtattcaccaaggaaaaccaagagaaactaaacaaaacccctttcgaggcgttcgggaagaacatcgaaaagtggtccaaaattcagaccctagcccaaaacctcccctacaagaagaaaaacaaaatactcgacgaaaacttcaaagacaaacaacaagaggacttcatatcacgaaacctcaacgacacccgctatatagcgacccttatagcgaagtacactaaagaataccttaatttcttactcctctcagaaaacgagaacgccaacctaaagagcggggaaaagggttccaagatccatgtccagacaatttcgggcatgctcacatcagtcttaagacatacctggggcttcgacaagaaagaccgtaacaaccatctgcaccacgcactcgacgcgatcatcgttgcgtactccacaaactcgataataaaagccttttcggacttccggaaaaaccaggaattgctcaaagcacgattctacgcaaaagaactcaccagcgacaactataaacaccaggtgaaattctttgaacccttcaaatcattcagagagaagatcctatccaaaatcgacgaaatcttcgtctctaaacccccgcgcaaacgagcgcgccgagccctccacaaagacacattccacagcgaaaataaaatcatcgacaaatgctcctacaactcgaaagaaggcctacaaatcgccctgagttgcggccgagtacggaaaatcggcaccaaatacgtcgagaacgacaccattgtccgagtcgacatattcaagaaacaaaacaaattctacgcaatcccaatttacgctatggacttcgccctaggcatcctaccgaacaaaatcgtcatcaccggaaaagacaaaaacaacaacccaaaacagtggcaaaccatagacgaatcatacgaattttgcttttcactctataagaacgacctcatcctactccaaaagaagaacatgcaagagcccgagttcgcctactacaacgacttctccatctcgacctcctctatctgcgtagaaaaacacgataacaaatttgaaaacctaacgtccaatcaaaaactcctgttctcaaacgctaaagagggcagcgtcaaagtagagtccctgggcatccagaatctgaaagtattcgaaaaatacatcataacccctctcggcgacaagataaaagcggacttccaaccgcgcgagaacatttccctaaagacctccaagaagtacggcctgcggtga

SEQ ID NO: 6067 - RNA, 3012 nt, synthetic construct
  misc_feature 1..3012: note = Cas9 variant
  source 1..3012: mol_type = other RNA
atgatagacgagagcctcacattcggaatcgacctcggcatcggatcctgcgggtgggccgtgctcaggagacccagcgcgttcggaagaaaaggagtaatcgagggcatgggcagctggtgcttcgacgtcccagaaacctcgaaggaacgtacacccacgaaccaaataaggcgaagcaaccgactactacgacgagtcatacggcgaagacgaaacagaatggctgcgatccgacggctattacatgcagccgggcttctgccatccacagactcagacgcactcaaacgcccaggccacgacccatgggaactccgcgcgagaggactggacaagcctcttaaaccagtagagttcgcagtcgtcctcggccacatagcgaaacgacgaggtttcaagagcgccgcgaaacgaaaagcaaccaatataagtagcgacgacaagaagatgcttacagccctggaagcgacgcgggaaagactaggcagataccgcaccgtcggagaaatgttcgcgcgagaccccgacttcgccagtcgaagacgcaacagagaagggaaatacgaccgaaccacagccagagacgacctcgaacacgaagtccacgcactattcgcagcccagcgccgcctcggccaggggttcgcatcaccagaactagaagaggccttcaccgccagcgcatttcaccaacgtcccatgcaggacagcgaaagactcgtaggattctgccccttcgaacgcacggaaaaacgagcggccaaactaaccccatcgttcgagagattccgactgctggcccggctgctcaacctccgtataaccacaccagacggagaacgacccctcacagtcgacgaaatagccctagttacacgtgacctcggaaaaacagcgaaactaagcataaaacgtgtaagaacactcatagggcttgaagacaaccaaagattcaccacaataagaccagaagacgaggacagagacatcgtagcacgtaccggcggagcaatgacgggcaccgcaacactacgcaaggcactaggcgaagcactatggacagacatgcaagaaaggcccgaacaactcgacgcaatagtccaagtactgagcttcttcgaagccaacgaaacaatcaccgaaaaactccgagaaatcggcctcacacttgcagtactggacgtcctactaaccgcactggatgcaggcgtatttgcaaaattcaaaggagcagcgcacatatccaccaaagcggcacgaaacctactcccacacctcgagcagggacgcagatatgacgaagcctgcaccatggccggatacgatcatgcggcctcacggctgtcgcaccacggccaaatagtcgctaaaacgcagttcaacgccctagtaacagaaatcggagaatccatagccaaccccattgcaagaaaagccctcatcgaaggactaaaacaaatatgggcaatgcggaaccattgggggctccccggatcaatacacgtggagctagcccgagacgttggcaactccatagaaaagcgacgcgaaatagaaaaacacatagagaaaaacaccgccctcagagcccgcgaacgcagagaagtccatgacctcctggacctcgaagacgtaaacggcgacaccctccttcggtacagactgtggaaagaacaagggggcaaatgcctgtatacaggaaaagccatacatatacggcagatcgcggccacggacaacagtgtgcaagtggatcacatactaccctggagcagatttggggacgactctttcaacaacaaaacactatgcttagccagtgcgaaccaacaaaagaaacgctccacgccatacgaatggctcagcggacaaacaggggacgcatggaacgcgttcgtccaaagaatagaaacaaacaaagaactacgcgggtttaagaagagaaactacctcctaaagaacgcaaaagaagccgaggaaaaattcagatcccgaaacctaaacgacacacgctatgcggcacgactcttcgctgaagctgtcaaacttctctacgcattcggcgaaagacaagaaaaaggagggaacaggagagtcttcacaagaccaggcgcgctaacagcagccctccgccaagcctggggagtagaatcactcaagaaacaagatgggaaaagaataaatgacgaccgccaccacgcgctagacgcactcacagtagccgccgtggacgaagccgagatccagcggcttactaaatcattccacgaatgggaacaacagggcctcgggagacccctccggagagtcgaaccaccctgggagagcttcagagcagacgtggaagcgacatacccagaagtattcgtcgcacggcccgaaagaagacgagcccgcggcgagggccacgcagcgacaatcaggcaagtaaaagagcgcgaatgcaccccaatagtgttcgagcgaaaggccgtatcaagcctaaaagaggccgacctggaacgcatcaaagacggagagcgaaatgaagcaatagtagaggcaattagaagttggatcgcgaccggacggcccgccgacgcacccccgagaagcccgagaggggatatcattaccaaaatccgactagccacgacgataaaagccgcggtcccggtgagaggcggaacagcaggccgcggagaaatggtccgcgcagacgtcttcagcaaaccaaacagacgtggaaaggacgaatggtatctcgtaccagtgtatccgcaccaaatcatgaaccgaaaagcatggccaaaaccaccaatgcgaagcatcgtggccaacaaagatgaagacgaatggacagaagtaggcccagaacaccaatttcgattcagcctctaccccaggagcaacatagaaatcatccgcccgagcggagaagtaatagaaggatactttgtgggtcttcatagaaacacaggagccctcataccaacacccgtcggcccagactcatacgtgatagcgtga

SEQ ID NO: 6068 - RNA, 3024 nt, synthetic construct
  misc_feature 1..3024: note = Cas9 variant
  source 1..3024: mol_type = other RNA
atgaaagtactcggattcgacatcggaatcaacagcattggctgggccttcgtagaaaacaacgaactcaaagactgcggcgtcagacttttcacaaaagcagagaacccaaaaaccaaagagtcgcttgccctcccccgccgcaacgcgaggtcctcccgggtccgcctcagacgacgccggagcaggctactgtccctcaagcacataatcagcaaagagttcggcctgcattacgaagactacatagcactcgacggcaacttacccaaagcctacacaggcaaaatcgaaagcatctacaaactccgctacgaggccctttcacaagcgatctcgaaggaggatctggcgcgcgtaatactacacatagcaaagcatcgaggatacatgaataagaaccagaaaacaagccaagacagcgagaaaggggccatcctcagcgcgatcaaggaaaactcgaacaaaataaagcactaccaaaccgcaggcgaatacttctataaggagctattcgagaacttgcgagacggcacaaaggagtttaaaaacatccgcaataaagcaatgaaaaacgaaaagaccggaaacatggaaagcacatactacaacactatcctggcgtccgacctggaaaaggagctaaaactgatactggaaaagcaacaagcctaccacaactactccgacacgttcatcaaagaggtactagaaatagcgttctaccagcgcccgctcaaagactttagccaccttgtaggctcctgcaccttctacgaaaacgagaaacgtgcctgcaagaatagctacagcgcttgggagttcatcgccctcggcaaaatcatcaacacactcgagtcgattaagaaagacacaggcgagatattcagcaatgagatcatcacccagatactaaaagaggttttggacaaaggcagcctcagctataccaaactccgcaaaatgatcaacctcgacgaaaaagtaaagttcaaagggctcaaatatgacaaagaaggcgtagagaaaacaaacctaatcgaatttaagaaactcaaagagttcaagaaagccttgggagaacacaacctagaacgcaaaacacttgacgaaatcgccacgcacatcactctcacaaaggacgaaaatcaactgaaaaagcaactagaacaatacgccctgagccaaaatcaaatagacgcactagcagaactcgacttcaacgaccacataaacctgagcttcaaagcgctttacgaaatcctccccctaatggaaaaaggcaagcgatacgacgaagcctgcaacgaactcgggctgaaggccaaaaccagcaaccaaaaatcagagttcctacccgccttctgtgactccatcttcgctcaagagctgacaaaccccatcgtgaacagggctatatccgagtacaggaaagtcctgaatcggcttttaaagaaatacggaaaaatgcacaaaatccacatcgagctcgctcgagacgccggcctgagcaaagaagcgcgaaacaagatcgaaaaagagcaaaaggagaacaaagacattaatgacaaagcagaaaagacatgcaaggagttcggcctcaaaccgaacgccaaaaacatactaaaaatcaaactatggagggaacaaggagaaatctgcgcttactccggcaagaaaataaccatcgacgacctcaaggaagacaaagcactcgaagtcgaccacatatacccctactcccgatcatacgacgactcctacaacaacaaggtactggttttcataaaagagaatcagctcaaacttaatcaaaccccatacgaagcattcggcagcaaccaagagaaatggtcaaaaatccaggtcctcgcacagaaactaccctacaaaaagaaaaacagaatactggacgaaaacttcaaaaacaaagaccaaatcgagttcataagccgaaacctaaatgacacacgctacgccaccagcctaatagccaaatacacgaaagaatacctagagttcctcccgctaagtgacgacgaagacatatccctgaaaagcggtgaaaaagggtcaaaaacacacgtgcaaaccatgaacggaatgttgacgtcggtactacgacacgcctggggcttctcccagaaagatcgcaacaaccacctccaccacgccctcgacgccataataatcgcgtactccaccaacagcataatcaaagccttcagcgacttcaagaaaaaccaagagatcctcaaagccaaactctacgccaagaaattaacctcagaggaatacaaaaaccaaagcaaattcacaggcttcgagaaatacaggagcaaaatcctcgaaaagctcgactcgatattcgttagcaaaccacccaacaaaaacaccaaaggggccctccacgaacaaacattctactcataccaggacatcttggaggaatataagactcaagaaggcctcaaacgagccctcgaatgcggcaaagtccgcaagatcggcaccaaatacgtagtcaacgaccgcatggtgagactggacatcttcaagaaagacaataaattctacggcattcccatctacaccatggacttcgcacttggggttctgccaaacaaagtcgttaccatcggcacagacaaggacaaaattaaaaaggaatggaagaccatcgatgaaacctacgagttctgcttctcactgtacaaaggcgacttagtcctcatacaaaagaaggaaatgcaagaaagtgagttcgcctactacaacgggttcgacatctcgtcagcctccatctccctagagaaacacgacaacaaattcgagaatctcacggaaaaccaaaaactactcttccctaaggccaaagagggcgatgttgaagtccgaggaatcggtatccaaggactgaaagtcttcaagaaatacatggtaaccccgctaggcgaaatacaagagaccaggaccgaggccagacaaaacatccaacctcgaaagaaacacgggctacgatga

SEQ ID NO: 6069 - RNA, 3033 nt, synthetic construct
  misc_feature 1..3033: note = Cas9 variant
  source 1..3033: mol_type = other RNA
atgtcagactcatcctacgtgctaggcctagatttaggcactaattcgataggctgggcctgcgtccgactaaacaaaggaaaacccgacggcctcctcgcgcaaggggtcaggatattcgaagcaggactggaaattgacgcctacggcagagggacacccctaaataccgaaaggcgcaacgcaagacaacgacgacgcctacacgaccgaagaaaaagaaggatcctaaaggtacgacgcatactacaagaggcaggaatgctacccgccaacaaaccagatcacaaggacgccgaatggaagatgctcctcgccagaaacccctaccgactaagagcaaaagcgcttgatgaacaaatagacctaaaagagataggcctctgcatctaccaattcgcccatcggcgcggcttcctcagcaactccaaaatactcaaaaaggacgacgaccgtggcaaactcaaggacgcaaccaaggctttcgccgaagacatggagcaaaaaggcgcccgcacctggggagaatacctcagccacctagacccccacgagcaaagaatccggaccaattacaccttaagagaatggtacacttccgaatttgacctcatatgggaaaagcaacaatccttctacccacacgttctcaccgacgatctttacaaacgcgttaaagaagccctgttctatcaaagacccctcaaaagccaagcacacctcctaggccaatgcgaacttgaaccgggacgcaaacgagccccattcgccctgctgatggcccaagagttccgactactccaatcactcaaccacctcagagttgtcagctcaacaggcgacgagcgtcttctcacagacgaagaaagaaaacaagccctcgccctcctacgctcccggggaaaccaaaagttcacaaccttaagaaaagtactcaacctccgaggcacaaaattcaatctcgaacgcggcggagagaaaaccatccaaggcaataacaccgcggcagcgctaggaaacctctttggcgaagcctgggaccacttcagcagcgaacagaaaaaccaaatagtcgaagaccgcctaactatcggggacaccgacgcactaatacgaaggatgaagaaaacgtgggggctcgactcagtcacggccgaaatgttctccgaaactgagctagaggacggatactgcggatttagtcgcaaagccctagaaaaactgttacccttgctcgaaagggggcatgcactaatggaagcagtacaagccgcctaccccgactaccagaaaaaccttccacgcacagacacactacctcccctcgaaaacctcaggaaccctatcgtccaaagaacactatccgaactccgccgggtagtaaacgcaatcataaaagaatacggcaaatccgacaaaatccgcatagaactcgcacgagacatgaaacaaacagccaaaaacagagaaaagagctgggacagaatgcgcgtaagagagagacaacgaaaagaagcagccaaaaagatcctcgaagaaaccggaaaccccgcaccccgccgccatgaaatcgaaaaagtgctactggcagaagagtgcaattgggaatgcccgtacaccggcaaaagaatctgcatgaacacactcctcggagacgcaccacagtttgacatagagcatatcatccccttcagcagatccttcgacaactctttctccaacaaaacactctgcgacgtaaactacaacagaaacgtaaagggtaacaaaaccccctacgaatcagcaagtgaaacagaacacgaagaaatggtctgccgcgtaaaaagattcacgggagactacaaagaaataaaactcgacagattcaacacacgagagacagacagccgcgccgacttcatcgaagagttcagcacatcccaactgaacgacacacgatacgctagccgtctcgccggtgaatacttaggaaagctgtacggatcagaatggcgcaaacacatacaaatagcaaaaggaggcaccaccaaatacctacgcgatgcatgggacctgaaccgcatactaagcgacggcggaaccaagagccgcgacgaccaccggcaccacgcagtcgacgcagttgttgttgcactcacaacaccacaaacggtcaaggccttatcagacgccaaccaacgcgcgcccgagcatcgccgatacgccttctcggacatgccactaccgtgggagaccttcagacaagacgtagagcaagccataaattcaataacagtctcccacaaagtgtgccgaaaggccaacggtcagctccacaaagaaacgttttacggcctcatcaaagaccgaaaaaccggcgacacgcgaacagtcctacggaaaccgctccacgagctcaccgacaaagagattaaaagagcagaaatcgtcgacagctccataagaaaactcatagaacagaaactaaaagacctggaccaaccaccaaagaccgcattcaaagaccgcaacaaccacccgttcatcattgataaaaacggaaacaaacgcttcatccacaaagtacgggtataccaagacgcaaaaccagtaaaaatcgcagaaaaccgacacgtcaaacttggcggaaaccatcacctcgaaatattcgaagttatagacaagaagggaaaccccacatggaaatgcgaagtcatctccttattcgacacacgccaaagagttaaggagaaaagaccagtcatcgtgagacaagatcaaaacggtaacccccttaaattcagcctctccatcggggaagccgtccaactcgactggaatggaggacgagaaaccgcagtcgtgcagaaaatgagcaagacacccaacaccgttgaatacgtcttccgaaaacacaacgacgcccgtaaggccgcagacatcccatacaaggaaacaattaccgtaaaatccgactcagcccttttcgcgtccaacctacagaaaatagtcatcacaccgacaggcctaataaggcgggcaaacgattga

SEQ ID NO: 6070 - RNA, 3033 nt, synthetic construct
  misc_feature 1..3033: note = Cas9 variant
  source 1..3033: mol_type = other RNA
atgaagaaccgaaacgtgataggcatcgacgtcggcactaattcgatcggctgggcgctggtggaagaaaacgaaaacggactcccacaatcgctaaaggcagcaggcgtgcgcatcttccaggaagcggtcgaagcaaagaccaggacccccaaaaaccacaagcgacgacaggcccgcctggcacgaagagtactagctcgcagagccaggagaaaacaaagactccaaaacctactcctcaaacatggcctactcccaggaggggtaacagaccccgtacagagagaggccgcattcaccaccctgggagacccataccaactacgagcaaaggggttaaatcttccactaggactccacgagttcggtagagtcttgtttcaactaggcgcccgacgtggcttcctgagtaaccgcaaaacgagatacggacacctaaacaagctggacgagctagccgatctaatcgaagcggaagacgcggccccgaagacaggggacgcagaagaaggcatcatacgaaaggaaataggggaactccgccaggccatgagtgccgccggcagccgaacgttaggcgaatatctggccggcctcgccaaagaagaacgaaaacggtgcagacacacagaaagggcaatgctagaggaagaatttgaaagactctggatggtccaagccaggtttcatccggagctatcggacgagctcaaagtacaggtacacaccgtaatattcttccaacgcccgctcaaaagcaaccgagcaagcctgggaaagtgtagcctagaaccgtcacgcagaaaagcagcaagagcatggcccgaagcccagagattcagactactccaagacctcaacaacctagaaatactagacccgcgaaccggagagctacggcgactccgagacacagaaagagcaattctactaaacgccctcgaacaacaaaagtcaatgacctggaacgccgtacggaagaaactaggactccaccagggagaaaaattcaacctagaaaccggagccaaagccgaaacaggactcaaaggtctccaaacactagccagcctccacgccatattgcaaggctggttcgacgagctcggggacaaacgcgacctactaatcgaagacctaatcacaatagaggacagcgcaggtctgtacagaagactcagggagcactgggggttcgacagagaaactgcattccgcctggccaccctagaactcgagcctggctatgcatcgctatccctaaaagcgatacggaaactactcccccacatgggagccggccacagatactccgaagcgcgacaacaagtgggctacggctacgaaacaggccaacgcgacctacaagaaaggctaggggaaccaccggacccccggaaccctgtagtagacaaggccctacacgaactacgacgcgtaatcaatgcactaatacaccgcttcggcaggcccgacgtcgtaagagtcgagctagcgcgcgatttaaagttagccaaacgcgacaaagaaagactagaaaagcaaaacagagagaaccagcgactgaaccggaaagcagaagcagcgcttgcagaactcgggctaggacaaccaagcagagacgacctaataaagtatcgtttgtgggaagaatcaaaaggactctgcccatacactggcagagagataggtctcagcaccctctttagcccggaagtagacgtagagcacatcataccgtactcacgctgtttggacgacagttacatgaacaaaacactgtgcatgacagaggaaaaccgaatgcaaaagggaaaccgcaccccatgggaagcctacggaggcgaccccgcgcgatacgagcaaatactgcaatgcgcacggtactttccaatggcgaaacgcaaacgcttcctagaacagggctctgatttcgtagaccagttcatccagagacaactaaacgacacgaggtacatagcaaagctcgctaaagaatacctcgccgcagtctgcacgaatgttcaagtcaccaaaggcgggacaacagcaatgctacgccaccactggggactaaaccgcctcctcggagaagacgacggtcaaaaagaaagaggagaccaccggcaccatgcactcgatgcagccgtaatagccgtcacatcaagatcattataccaaagactcgcacggatcgcccaccaaagaggccacgctccaagccagcgaggcttctacatagacccaccatggcaaggataccaagcagacctcgcacaaacccttgcagggatagtagtcagccacgcgaccaaccgaaagctaacaggcgcactccatgaagagacagcctacggacacataccccacgtcgggttcgtgtaccgcaaaacactaaacaaagacttcaaactcggcgacatcgaagcaatatacgaccccagcctgcaagaattagtaaaagcacaccttgaacaccacgggaacgacccgaaacgcgcgttcgcggaaggaatacagtgctaccacaaagacggccacacgccaattaaacgcgttaggatacgggcgaaacaggtatcagagaagggaaccttcagcataagcgaccgagcaggtcgcgcctacaaacaccacaaaacagggtcaaaccaccacgtagagatcctgcgccaccgagcaaccggaaaaatagaaccggtgtacctaaccaccaaggaagccacagaacgcgcgcgaagaggaggagaaccggtcatacaacgagaccacggacccgaatgggagttcattataagcctatgcataaacgatatggtccgcctaggagaagggggccaagtggcatatttccgagtacagaaaatagaagcaaccaacaacagggttacactgagaagccacctcgctgcaaccctagacgacgaagacatgaaagtaaccacaagcgttcccaaactagcggtcatgccaggatttcaaaaggtgctcgtgaccgcggtcggcgaagtactagaactccacgactga

SEQ ID NO: 6071 - RNA, 3033 nt, synthetic construct
  misc_feature 1..3033: note = Cas9 variant
  source 1..3033: mol_type = other RNA
atgaaacgaatggcagctgtcgggctaatgccagcagaccccaccgaggccaaagcactcgaactactagacccctacgcactccgtgccgcaggactagaccaagcactccctctaactcacttcggacgcgcactgttccacctcaatcaaaggcgcggattcaagagtaacagaaaaacagacaaaggcgacaacgagtcaggcaaaattaaagacgccactaaaagactcgacgaagaaatggcaatcaaaaacgcccgaacgtacggcgaatttctccacatgcgccgcacatccgctaccgaccccaaaaacgtcccgacagtacgaactagactatcgatagcccgaagggacaatgcggaaaaagaggaagcgggctacgacttctatccagaccgacgacacctcgccgaagagttcgacaaactctggaaggcacaagcgggctactcacccgacgtcctaacagacgaactaagagacgaaataagtgtaataatcttccaccaacgacctctaaaaacgcccgaagtcggtctatgcctattcagtggctcgcacggagtgccaaagaaagacaaaagaatacccagcgcacacccccttaaccaacggaggatactatttgaaaccatcaacaacttgcgagtagcagcaagaggagaacccgcgcgcggtctaacccgcgacgaaagagacgctatagtccacgcactagacaacaaagcccacaccaaaagcctatcgggaatgtcgatgaaactaaaagccctcggtaaagtgatcaagctccgaccagaacagagcttcaccctccaaaccgcaaaccgagaaacaatcgcctgcgaccccgtacgagccagcttgagtcacccagaccgcttcggtccaagatggtcgatgctagatgccgacgcccaatgggacgtcgtacaaagaatcagagcagtccaatctgaagccgagcacgacgccttagtgaaatggctcatggcgacccacggactcgacagagaccacgccgaatcgaccgcaaaagccccactaccggaaggttacggaaggctaggcctgacagcaacaaaacgaatcctagcagccctcgaagcagacgtcataccatacagcgacgccgtcaaggcgtgcggatggcaccactccgacggacgcaccggtgaggtcctcacagagctaccctactacggccaaatactcgacagacacgtaatccccggaacctacaacgagagcgacgacgacgtcacacgatacggaaggataacgaacccgacagtacacataggattaaatcaactacgaagacttgtgaacaagatcataactgtatacggcaaaccggacgagatcgtcgtagagttagcacgcgaccttaaactctcagaagaccaaaagagggacgtacaacgcgacatcaagaaaaacactgacgcagccatagcccggggagcgaaactatcagaaatgggcgtccccgacaccggcgcgaataggatggtactgcgcctctgggagagcctgggcgacgacgtaatgacacgcaattgcccgtacagcggcaaacgaattagcgcaacaatgctattcgatggctcctgtgacgtagaccacatcctcccctactcacgcaccctcgacgacggcttcgcgaaccgaacactctgtctaaaagagttcaacagacagaaaactgacaaaaccccctgggaggcttggggagacacgcccgcatgggccaccatagaagcaaaccttaaaaatctgccagcaaacaaagcgtggcgctttgcacccgacgcaatggaaagatttgaaggagaaaacgatttcacaagccgagccttaaaagacgcccaatacctcagcagaatcgcccgcacatacctcgatgcactatatgacggagccgacgggaaatcacacgtctgggttgtgcccggaagactcacagaaatgctaaggcggcactggggactaaacagcctactaccagacaaagacggcgccgttaaagccaaaaacagaacggaccatagacaccacgcaatcgacgcagcagtggtagcagccacagaccgcagcttaatacaacgaataagcaaaatggcgagaaaggacgaagtgaacggagcagaagaagtcgcaagaagcgtaccaccaccgtgggaaggtttccgaaccgatatagaaactcaacttgaccgaatcatcataagccacagagccgaccacggacggatcgacccagcggcacgcaaagacggacacgactccacgtccggtcaacttcataacgacacagcttacggcctcggagaaggaaacagcgtagtaagcagaaagccattactctccttaaagagcaacgacattgaagtaacgaccaaaggtgcaaacatacgcgacgtagacctccaacgccacctcgaaagaatcacccgtggcctagatggaaaggctctagaagcagcactcgcggagttcgcggccacggcaaaactaccggacggaaccgacaatccatactacggactacgcagagtacgactagaggaaacgctccaacaaggggcgagggttgaggtcaaagaccgcaacggcaagccattcaaagcctacaaaggcgacagcaaccactgctacgaaatatggagaatgcccgacggcaaagtagtcccccaagtaatcacaacctacgaggcacaccaaatcgacgtagaaaagaagccacatcccgccgcaaagagactactccgcattttcaaacgggacatggtagcgatcgaacaagacgacaaagccatcattggctacgtacaaagcatgcatgtggcaaacggactctttatcgcaccacacaccgaagccaatgccgacgcaaggagccgcgacaaatcagacagcttccgtctaatccaaatgtccgcaggccccctagtcaaggcgaatgcacgtcgcgtatacgtagatgaaatgggccggctgcgcgacccaggcgccccctcctga

SEQ ID NO: 6072 - RNA, 3039 nt, synthetic construct
  misc_feature 1..3039: note = Cas9 variant
  source 1..3039: mol_type = other RNA
atggcgaacatgcgctaccgccttgcactagacctcggtagcacatcgctaggatgggccatggtccgtcttgacgcacagaacgaaacatgcgcagtcatcaaggccggcgtcagaatattctcagacggcagaaatccaaaagacggaagctcactcgccgtcagcagacgagaagcgcgcgccatgaggcggcgaagagaccgcctcctcaaacggaaaacacgaatgatggcaacgctcatgaaacacggcttctttccacaggacgaagcagctcgacaagccctagtcaacaaggaaccattcgcactacgagcaaagggactcgaccacgcgttactcccagaggagtttgcacgcgccctattccacatcaaccagcgtcgcggattcaaatccaacagaaagaccgacaagaaagaaaccgacagtagtgcgctcaagaaagcaatcggacaactccgcgaggcaatgcaggctagcggctgccgcaccgtaggcgaatggctctgcgcccgccaccagcaagggctctcagtgcgggcaagataccgcgaaaaccgcataaccaaagacgatggcaaaaccaaaatagaaaaatcatacgacctatacatagaccgcgccatgatagaggccgagttcgacgcactgtgggcaaaacaaagcgaactaaaccctgaactcttccacgaaacagcacgcgccgaactaaaagattgcctcttacaccaacgcccgctcaaaccagtcaagccgggccgatgcaccctactacccgacgaagaaagagcacccctcgcgttaccaagccaacagcgcttccggatataccaagaagtcaacaacctaagactcctgagagaaggactaaacgaggaaccattaaccctcacacaaagggaccaactgatacaagccctcgaaaccaacccaaagcgcagcttcacacagatccaaaaattactaggattcagtggacagttcaacctgcaagacgacaaacgcacggagctcaaaggcaattccacctccgccatgctaagcaagaaagaatttttcggaagtcaatggctatcctttgacgaaacacatcaggacgaaatcgtcatgcagctagtatccgaagaaaacgaggccaggctcatcgcctggctccaagcagagaccggagtcgacgaaataaccgccgaaagaatcgccaacacaccccttgctgagggatacggctcacttagcgcgaaagccctagagaaaatcctaccggccctacgagccgatgtaatcacctacgacaaggccgttctagcagccggcttcgaccaccactcccacatcagccacgctgccaccggagaaattctacccgacctaccctactacggacaatacctgcaacgacatgtgggatttggaacgggaaaacccgaagacccagcagagaagagatacgggaaaatagcaaatccaacagtgcacataggactaaaccaggtacgaacagtggtgaacgctctaatcaaaagatacggccacccatcggaagtggtagtagagctcgcccgcgatctcaagcaaagtcaagagcagcggaaagaagaacaagcgcaacaagcgaaaaaccagcgacgaaacgaaagaatgagacaggacatcgccggactcttaaacacctcaacagagagggtgcgcgcactagacctacagaaaatgatcctttgggaagaactatcattcaacgtagccgaccgaaggtgcccatactcaggcgtccaaatcagcgcgcaaatgctattcagcgaccaagtggagatcgaacacatcctcccattcagccaaactctggacgactcccttaacaataaaacggtggcaatgcggcaagccaaccgaatcaaaggcaaccgaacccccgcagaagcggcagccgacttcgcggcacaaggatggccagtggaagacatgctacaccgagcaagcctaatgcccaaaggaaagcgataccgattcgcacaagacggaatggcacagtggctgagagaagacaaaggcttcctcgcgcgcgccctaaacgacacacggcacctcagccgagtggcccgcgaatacctaagtctagtgtgcccacaaggaacccgggtcatacctgggaggatgaccgcaatgctaagggcaaaattcgggctaaacgacattctgggcctaaacggcgagaaaaacagaaacgaccaccgacatcacgcagtcgacgcctgcgtgattgccgtaactgaccagtcaatgctacaaaaattcgcaaaggcctcagcctcagccagggaaaagcaactgaacaaactcgtagaatccatgcccctaccatgggacagttaccgcgaccatgtacaacgagccgtggaacgcatctgggtaagccacaagcccgaccacggacacgaaggagcaatgcacaacgacacggcgtacggactcctgggcgggggccatgttcaggtacgcaaacgaatggacggcgtgcgcacccgcgaaaccgcagcactaaaagtgatcgagttcgcagacaggcaagcccacccaagacacggactcctcccaaatggggaacccatgccatacaaggggtacaaaggagactcaaactactgcatggaaatagtccggaacgataaaggtaaatgggaaggggaagtcgtaagcacatttgaagcctaccagctagtcagacaacatggcttggcgagactacgacacccagcactcagcgtctcaggcagaccactggtaatgcgcctattacgcaatgacacactacgtgtaatacacaacggagaacaaagaacagttcgcatttgcaaaatgaccgccgaaggagtaatagccctcgcagacaccacggaatccaatgtagacgcccgcacaaggacaaaagacctctcctacatcttcaaaactgcaggaagtctacaaaaatccaaaggacggagagtcgcgatctccccgtcaggcgagatgaaagacccaggcttctttgactga

SEQ ID NO: 6073 - RNA, 3051 nt, synthetic construct
  misc_feature 1..3051: note = Cas9 variant
  source 1..3051: mol_type = other RNA
atggaagtcttcgtcgacgtatcagctaggcaactaggcatcgacctaggcatcggcacatgcgggtgggcgctactcgccgaagactcactcatagcactaggcacaagaacattcgacgtaccagaaacggacaaggaaaggataccaaccaaccaaatacggcgacaagcacgaggaatgagaagagtaatcgaccgaaggagacaacgcatgaacgctgtaagacgtctattagcagaccacgggctgctcgcggacggaggaaaacttgggctggcaacagtcagactagacccgtggcaagcgagggcagaaggccttgacagactcctgagcgcaggggaactagcagtcgcactcgggcacatagcaaaacaccgcgggtttagaagcaactcaaagcgcgacagaggagccaacgctccaaaagaatcgagcgctatgctaggcgcgatagcacaaacaggcgaaagactacaacactggcgaacggtcggagaaatgttctggaaggacgaattttaccaaacgcgacgaaggaacagggacggagactacagccgaacagtacagcgcttagatctagaaaccgaagtacaccggctactagcagcacaaagacgactcggaaacccactagcaacgttcgacctcgaacaaagtttcatagacgtagccttcttccagagacccttagcagacagcgacgacaaagtgggcccatgcccattcgaaccctccgaaaaacgggccgccaggcactccccatcgttcgaaagatttagactgttatcgcgtctggcagcgctccgcctctcaagcggggccggagaaagaccgctaagcgatgcagagttcgccgcagcctgcgcagacttcgggagactacagggattcagctttaaaagactaagacaacacctaaaactagacccatccatacgattcgcgggaatagcacccgatgaagaaggaaaaagagacgtggtagcacgaagcggcgaagcaacgccagggtcagcagcactcagacactgcctcggtgacacagtatgggacaacatgcttgggaccaggcccgcactcctagacgcaatcgcggcaatcctcaccttcagggacgacgcggaccgaatagcagaaggactagcgggcctgggcatagaggagcccatcctggatgcactaatggacggagtccgcaacgggagcttcggcaagttcaaaggcccgggccacatttccgcgaaggcgtgcagggcgctcctaccccacctagcccgagggcgggtgtactcagacgcatgcgcggacgccggctacgaccacagcaggcaaacggaaacaaacctagatgatattcgaaaccccgtggcgcgaaaggcgctgggggaagcattgaaacaaatcaaaatcataatacacactcacggacggccaacagccatccacgtagaaatggcacgggacatagggaaaagcgcagacgaaagagacgaaattaaaaagggcatagacaaaagaaacagcgaaaaagacagagctcgccaacaatttcacgagatggtaggaacaccggcagcgggggccgaagacttactcaggttcgaactctggaaagaacaaaatggatggtgcctgtacaccggaagggaaatacccatagacgcacttgtcagctcggacaaccgtatccaagtcgaccacatattgccgtggagtcggagcggggatgatagttatataaacaaaacactctgcttcacagaagcaaaccaacataagaaaggaatgacaccctgggaatggctccacgacgaccccgaaagatgggaaaaattcgctcgcacggttgaaggatgcaaaacaatgaaaggaaggaagaaacgaaatctactgctaagagacagcagcagactcgaaaaagagttcaggagccgcaacctgaacgatacccggtacgcatgtagactccttctggggattctcaaacacacttacccggacatcgttgtcgcggccaggccaggccccctaaccgacagactgcggagagcatggggcctgcaatctctcaagaaacatgaagatggcaccagaaaagacgacgacagacaccacgcattggacgcagccgtagtcgcggccaccagccaatcaatgctccaaagactcaccacactattccaaaaagccgaacgcgaaggcggccggagagacttcgtcggacttgaaccaccatggcccggattcagagcagatctcgaagcgaaactagaaggagtcgtcgttagccgagcggagagacgccgcgcaaggggcgcagggcacaaagatacaatacgagccatcggagaaggggatgcaggcccagtggtgtacgagagaaaaccagtagcagcactgacggaaaaggatctcgaccgagtgaaagaccccgaaaggaacaaagttctaatagagaacctcagacaatggatagcggcaggcaagcccaaagacccagacaaagcccccaggtcaccgaaaggcgatccaatgaccaaagtcaaactcgtcacaacagacgatgtaaggatcctagtaaggggaggcaccgcggaccgcggagacatggcacgggtagacgtcttcaggcaagcggatccaaaggggagatggcgattcttcctcgtccccgtttatccccaccaagtattcgacccaacagactggcctcagccgcccaatagagcggtagtagcatataagcccgaaaaggaatggaccgtgatgggcccggaccacgagttcctctggagcctctacccattttcgtggatagcagtagaaaaggcagatggaacgcgaatagaaggctactttcgaggaatgcaccgctcaaccggagctataagcataagcccccaccacagcaaaagcctagcatcaacaggaatcggggccaagaccctagcgagcttcaggaaattcgccatggacagaatgggcaacttatccgaaatagaaagagaagtcaggacatggcacggcgtagcatgcacctga

SEQ ID NO: 6074 - RNA, 3054 nt, synthetic construct
  misc_feature 1..3054: note = Cas9 variant
  source 1..3054: mol_type = other RNA
atgcgggtcgacagcctaggccgatgcctcagcgacgaggaatgggcacgagtcatctaccacctgtgtaagcacagagggttccattggatctcacgagcagaggccaaacaaacggaaggcgacagtaaaagtgaaggaggtaaagtaaaacaaggcctagccggaacagcaaaactcatggacgaaaaaggataccgctcggccgccgagatggtactcgccgagtttccagaagcacaaaggaacaaacaaggcgaatacaggaaagcgctaagcagggagctattagccaaagaactggcgctcttgttcgcacgccagcgagtgttcggaaaccgacacgcaacagacactttagaaaccgccatcctcggcaactcagacaagaaatcaggtctattctggcaacagaaaccagcactggccggggccgacctcctcaaaatgctagggacctgcaccttcgagaaaaacgaataccgagcgcccaaggccagctttacggccgaacgacacgtgtggctcacaagactaaacaacctacgaatcgtaactgacggcatcacacgccaactaacagaacaagaaagacagctagtactccccctaccgtacagacaagccggagacttgacctacaagcaactagggatggcgctcacaaaagcaggactgcttgaagcgggttgcttcaagttcatcggcctagcatatcctactgaagcgcaaaaagccgaaggcaaaaccaaagaccccgagagcgccaccctcgtcaaaatccccgcatggcaggaactaagacaaaccctcaacaaggcaagccttaacgacgaatgggaaaagctctcaggcgacgccctctgtggccagccagaaatattcgacaaaatcgcctggatcctgagcgtatataaagatgacgacgaagtaagaaccgaacttgccaaactcgtactcccaaacccagagggactcacggaagccctactaaatataagatttgacaaatttcacgcattaagcctaaaggctttaagagcaatagtaccgcacatggaaaaaggactaagatacgacgaagcatgcgtacaagccggctaccaccacagccaactccacaaaatcggagaaggcgaacacaaatacctcccacccctctacgacggccgagacggagacgggagaatgatcttcgcagaagacgccgacatcccccgcaaccccgtagtactcagaagcctcaaccaagcgagaaaagtcgtaaacgccattatccggagatacggttcccccagcgccgtccacatagaaatggcccgggacctgtcacgaccattcgacgagcgaaacaaaatcaaaaaggaccaagacgaataccaggcccgaaatcaacgagaccgtgagcagttcatagaactctttggccatcccccaaagggactcgagttcgaaaagtggaggctctatagggaacaaaacggacaatgcgcctacagccaaaaacctctcgcctcatcaggcgacgtcgccgaaatcttcttagacggcagcacggaaatcgaccacgccctaccctacagcagatcctttgacgactcgaagaacaataaagtcctagtactaacccgagaaaacagggacaaaggaaaccgcacgccctatgaataccttggcggcgccgaaaacagcgaaagatggcaacgattctttagtttcgtcgaaagcaataaggcgtaccgactcgcaaaacggacaagactgttaagaaaagacttcggcgccaaagaatccgaagagttccgagaacgaaatctaaacgacacaagatacgtttgtagattcttcaaaaactacgtcgaacaacacctcaaattggccgaaggatccgaagccaaacgctgcgtcgtagtatccgggcaactcactaactttctcagaacacgctggggcctgctcaaaatccgaagcgacagcgacagacaccacgccctcgacgccgcggtcgtagcagcatgcagccactcaatggtacagcgactcagcaactacagccgaactcgagaactagaacaagttcgagacggcttcgtcaacatcgaaacgggcgaaatcgttaacccagccatgcaccagcaactccgcgaacactttccagacccatggccatacttcagacacgaactcgaagcccgactaaaaatcgactccccagcactactacgtgaagaaatggcccgactctccagttacacagaagaagaactcgccgcactcaaaccactattcgtatcccgagcaccccaaagaagaaacggcggcgccgcacacaaagacaccatatacggacagcctgaaaaacttaagaaaaatggcagcgtatcccaaaaagtagccctagcaagcctagccctcaaagacatagatctcctcgccgacccgcaccgaaacgccaaactctacggcgccatccgcgagaggctggaagcccacggtggcaaaggagacaaagcgttccccgccaccaacccgctaagaaaaccagataaagaaggcaacccaactgggccgattgtccgcacagttaccaaagtaatagacaaattatcaggcatacctgtacgcggaggtatcgccaaaaacgacacaatgctacgggtagacgtatttaccaaagcaggccgattccacctcgtaccggtctacgtccaccaccgcgtcaccgggctaccaaatcaggccataacacgaggaaaagacgaaaaccagtgggccataatcgacgatacattcgagtggcgcttctccctatacccaaatgacctagtacaaattcgacttaaagacgaaacccacctcggatactacgcctccacagaccgatcaacctccagcatctccatctgggcgcacgaccgcaaccagtccgtgggcaaagatggactcatcagaagtatcggcgtaacaaccgcgaaagatatcgaaaaattccatgtagacacgctcggaaacgtataccctgcgccccctgaaaaacgacgggggctagcgtga

SEQ ID NO: 6075 - RNA, 3066 nt, synthetic construct
  misc_feature 1..3066: note = Cas9 variant
  source 1..3066: mol_type = other RNA
atgaggaggagacgcgacagattcaagcaaagacaagcggccctactcaagcacctggccggagtcgggctatttccagcagacgaggctgcaagacgggaactggccggcctagacccctacgaactccgcgccagagcattacacgaagcactcccactcaaccacattggacgagcactattccacttaaaccaaagacgcggattcaaaagcaaccgaaagactgaccgcggaaaagccgacgacgaggggaaaatccgacttggcgtagcacgattacaagaggccatgcacgagaagggcagcgcaacacttggagagttcctacacggcagaagggcagcggcaacagaccctaaccaaataccatcagtaagaacaagactacgagcagaaagcggggaaggagccagaggagacggatacgacttttaccccgatcgaagaatgctcgaagacgagtttgaggccatctgggaatcacaacaagtacaccatccggcggtactgacagacgaaataaaacaacggtttttcgaagtcatattctaccaacgacccctaaagcaaccggaaatagggacctgcaccctagtcgcaggagaaaggcgcctccccaaagcacaccccctcttccaaaagcgtcgcctcctagaagaacttaacgccctacgaatcgtgtggccaggggtacaggccgaactcctatcaagagaacaaagagacctcgcatacctaaagctaaaggacaaaagagcagtgcgatttgaaagcctaaggaaagcactgaaactcgacccggacgcaaggtttaacaaagagagcgaaaaccggagcgagctcaagggagacgaagtggccgctgaactaggcgcaaaatctcgattcggcggacgctggggacacacagcgccagccgaccagtgggaaatcgtgagcaggattcaagcactagagtccgacgatgacgaagcccaattttgcgtctggctaagcgaaagatatgggctagacagtgaacaagcccgagccgtggcagcagcaagactcccgcaagggttcggcaggtttggcctcacagccacaaccagactgataaaagcattacaagacgaggtaatagtctatagcgaagctgttcagaaaacgggactaggacaccacagcgacttcagaaacggcgaagtcctagcggagctgccatactacggaatagcactcgaacggcatatcatgcccgggaccggtgacccgggcgacagcgacgaaatgagggtgggcagagtaacgaaccccacagtgcacatcgggctaaaccaactaagaagggtagtaaacagactaataaagagatatggaccaccaaggcaaatagccgtcgaactagcgagggagttaaaactggacgaccaacacaaacgggagataaacggccgaaaccggcagaacagagaagcagcagaaagacggagccaaaagttggtcgacataggcatagcagataagggagccaacagagcgctgttaaaactatgggaagagttgaatcccgacaacgcgctagaccgccggtgcgtctatacaggaagacaaatatccatagaaatgttattcagcggggcagtcgaagtagaccacatcctacccttcgccgcaactctcgacgacagcaacgctaacaaactgctatgcctaagagaggcgaatcggaacaaacgaagaagatccccgttcgaagcattcggacaaggggccgactgggaagaaatagccgcgagggcggcgagactcccgagggaaaaacgatggcgattcgaacccgacgcaatggcccgcttcgatacagaagaaaaattcctagcacggcagctagtagacacgcaatacttaagcagactcgccagagagtacctcggagtactgttcccggacaagggagaaggcagcgggagagtatgggtctcccccggcagactgacggaaatgctaagacgatcatggggactaaaccacctactacccgaccacaacctcggaggcggggcggaccaaccgaaaaacaggagggaccaccgacaccacgccatagacgcgatagtagtggctgtaacggacaggcacctactacaagccatagcaagagaagcaggccaacgaggacacgaagccgccaacagaatgacagcggatttaccagtaccatggccggacttcgacagggacgtggggcaagtaatacgacaagtcgtagtatcgcaccgcgcagaccacggcaccgtaagcaaagccggggcagcaaaaggacaagacagtacagcaggaagactacacaacgatacagcctacggcctgacaggacagacagacgaaaagggaaatacaatagtggtacgacgagtaccgctaacagctctcaagaaaccaaccagtattgaagcggtacgagacgacgaactgcgtaaagcactttcagtctggacaagaggctacgacggaaaagccttcgaagcaaggctctcccgattcccggaactcggacccctacaattcagggggatacgacgagtgagggtcgtggaaccgctaacagtgatacccataagggacagtagcggaagggtgtacaaagggtacaaaggtgactcgaactacaggtacgatgtgtgggaattaaaagacggcaaatgggtcgcggaagtagtgagcatgttcgacgcgcatcaatcaagctggaccagcccagtaaggagggaaaacccgacggcacgaaaggtactaagcctacaacagaacgacatcgtggcaatagagccagagggaaaagaaagagagctcatgcgagtagcccagctcagacaaggcgggcagatcaccctagcagcatgccatgaggccggagacttaaaaaggcgcgacgcggaatcaaacgaagtcgacccattcaaatatttctcacccaccgcgggagggctcaaaagggtacgggcgcgacaggtaagagttgacgagctcggcagggtattagacccgggcagtcgagatcgagaaagaggggcagcgtga

SEQ ID NO: 6076 - RNA, 3066 nt, synthetic construct
  misc_feature 1..3066: note = Cas9 variant
  source 1..3066: mol_type = other RNA
atgaaatatactctaggcctggacgtaggaatcgcatcagtggggtgggcagtcatcgacaaggacaacaataaaatcattgacctaggcgtacgatgctttgacaaggccgaagaaagtaaaacaggagagtctctcgctaccgcccgcaggatcgcacggggaatgaggcggcgaataagccgccgatcgcaaagactcagattagtaaagaaacttttcgtccagtacgaaataatcaaagattcatctgagttcaaccgcatattcgacacatcgcgcgacggctggaaagacccctgggaacttcgctacaacgccctttcccgaatcctcaaaccgtacgaactcgtccaagtgctcactcacataaccaaacgtcgaggctttaaaagcaaccgcaaagaagacctctcaaccaccaaagaaggcgtagttatcacctccatcaaaaataacagcgaaatgctccggaccaaaaactaccgtaccatcggcgagatgatctttatggaaacccctgaaaattctaacaagcgcaacaaagtcgacgaatacatccacaccatcgcccgcgaggacctcctcaatgagatcaaatacatattcagcatccaaagaaaactcggctccccattcgtcaccgaaaaactcgagcacgactttctaaacatctgggaatttcagaggccattcgcctcgggagacagcatcctcagcaaggtcggaaaatgcacacttctgaaagaagaactacgcgccccgacgtcctgctataccagcgagtactttgggctcctccaatccatcaataatctcgtcctggtagaagacaacaacacacttaccctcaacaacgatcaacgggcaaagataatagaatacgcgcactttaaaaacgaaataaaatactcggaaatacgaaaactcctcgacatcgagccggagatactattcaaagcccacaacctcacacacaagaatccctccggaaacaacgaatcaaagaaattttacgagatgaaaagctaccacaaactcaaatccaccctacccacagacatatggggcaaactccacagcaacaaagaatctctggataacctgttctactgcctaacagtatacaaaaacgacaacgagatcaaagactacctacaagccaacaacctagactacctcatcgagtacatagccaaactacccaccttcaacaaattcaaacacctctccctcgtcgccatgaaacggatcatcccattcatggaaaaaggctacaagtacagcgacgcatgcaacatggccgagctcgacttcaccggctcgtcaaaactagaaaaatgtaataaacttacagtcgaacccatcattgaaaacgtgaccaaccccgtagttatccgagcacttacacaagcccgaaaagtcattaacgccatcatccagaaatacggtctgccctacatggtcaacattgaactcgccagggaagccggcatgactcggcaagaccgcgacaacctgaaaaaggagcatgaaaacaacagaaaagcacgcgagaaaatatcagacctcatccgacaaaacggtagggtagccagcggactagacatcctcaagtggcgactgtgggaagaccaaggaggacgctgtgcctactccggcaaacccatacccgtctgcgacctactaaacgacagcctgacacagatagaccacatctatccctactcgcgctctatggacgactcctacatgaataaggtcctcgttctcacagacgaaaaccaaaataagcgcagttacactccgtacgaagtatggggatcaacagaaaaatgggaagatttcgaagcccgaatctacagtatgcaccttccacaatcaaaagaaaaacgcctcctcaaccgcaacttcatcaccaaagacctcgactcattcatctcacggaacctcaacgacacgcgctacataagccgatttctcaaaaactacatagagtcttacctccaattttccaacgactccccaaaatcatgcgtcgtatgcgtgaacggccaatgtacggctcaactacgcagccgctgggggctcaacaagaacagagaggaatccgacctgcaccacgcactagacgccgcagtgatagcctgcgcagaccgcaagatcatcaaagagatcacgaactattacaacgaaagagaaaaccacaactacaaagtaaaataccctctcccgtggcatagtttccggcaagacctaatggaaacactagccggcgtgttcataagccgcgcgccccgccgaaaaatcacgggcccggcccacgatgaaaccatccgctcgccaaaacacttcaacaaaggcctgacctcggttaagatacccctaaccaccgtaaccctagaaaaactcgagactatggtcaaaaacacaaagggcggcatttccgacaaggcagtctacaacgtactgaaaaatcggttaatagaacacaacaacaagcccctcaaggcgttcgccgagaaaatctacaaaccccttaaaaatggcaccaacggagcaataatccgctccatccgcgtcgaaacgccctcttacaccggggtcttccgcaacgaaggcaaaggcatcagcgacaactccctaatggtacgcgtcgacgtattcaaaaagaaagacaaatactacctcgtgcccatctacgtcgcccacatgatcaagaaagaactaccctcaaaagcaatcgtgccgctaaaacccgaaagccaatgggaactgatagacagcacgcatgaatttctgttctcactctaccagaacgactacctcgtcataaaaaccaagaaaggcattactgaaggatactaccgttcgtgccaccggggcaccggaagtctgagcctaatgcctcacttcgccaacaacaaaaacgtcaaaattgacataggcgtccgcaccgccattagcattgaaaaatacaacgtcgacatacttgggaacaaatccatagtcaaaggcgaaccccgacgaggaatggaaaaatacaactcttttaagtcaaactga

SEQ ID NO: 6077 - RNA, 3072 nt, synthetic construct
  misc_feature 1..3072: note = Cas9 variant
  source 1..3072: mol_type = other RNA
atgaaaatcctgggcttcgacatcggcgtcgcatccatcggctgggcattcgtcgaaggcgacgaaatacgagactgcggcgtccgcatcttcacaaaagcagaaaaccccaaaacgggcgaatccttagcgctaccccgccgcgaagcgagaggggtaaggcgccgcctggcccgccggagagtacgactcaacacgattaaaaagataatatgcaaagagttcgaccttcgactttccgattacatcgccgacgacggggaattaccaaaggcctaccaaaccaacaaggacaccaaatcaccgtacgaactccgctacaaagcccttaacgaacgcctatcaaaagaggaactggcacgagtcatcctccacatagccaaacaccgaggatacgggaataagcacgccaaggacggagacgacaaagacagcggcaaagtcaagaaagccattggagaaaacaaaaccctactcgaacagaagggatacgaatccgtcggagaatactgcttcagggagttcttcaaatccataaaagacaaagacggcgaaacgcacaacatcccatcacagaacataaggaacaaaaaggggaactacgaccgctgcgtaagccagaaacaactcgaagacgaactaaaactcatattcgcaaaacaacgcaaactgggcttcaacaaagagttcgaagacgcgatcctcgaagtagcattctaccagcgaccactaaaagactttgacgacaaaatcggagactgcatcttcttcgataacgaaaagcgagccccaaaagagtccatctccgccatagagttcgtcgccctcactcggataatcaacaccctaaaatacctctcaaaaaccacgggcgaggtctacgagaaggaaattatcaacaagatatggcagaaaatcctcgaaaacggcaagatgacctacgccgaactacggaaaatcctcgccctcgacagcagcgtgttcttcaaagacaaggatctcgactacacgctaggaataaaagaggccgagaaaatcaagttcatcgaatttaagaaattaataaaattcaagaaagctctaggcagcttcgacggactatcacgcgaaatacttgacaacatcgcaatgcaaatagcaattaccaaagacaggcaacgcctactcgagaagctggaagtgttcccactaaacaaagaacaaaaagaaaacctgagtcagctaaacttcagcaaatacatcgacctctcactgaaagccctgaaccaaatcctcccattcatgagagaaggccgccgctacgacgaggcgaaggacgacgcgaaactccaagaaaaagctaaaaacaccaaaaaggaagagttcctgcctccccttaaagagttcgacctcaacctcacaaacccagtcgtcgcacgcgccctcgctgagttcaggaaagtactcaacgccctactcaagaaatatggcaaagtccacaaaatacacctagaatttgccagggacatgcgtctcgacttcgacgaacgcgaaagactcatctcaattcaaaacgacaacttcaataaaaggcaacttgcggaagacttctgcaaagaacacggactggagccaagcaacgcaaacatcctcaaaatcaagctgtggcaagaacagcaatggcactgcatgtacagcggggaactgatcggcatcccagacctcaaggacccaacgaagctccaagtagaccacatctacccctactcccgatcgttcgacgattcatacacaaacaaggtcctagtacgagcagaatggaaccaagagaaaggaaaccacactccttttgaagccttcggcggagacaaaaacaagtgggacaaaatcgtagctctcgcggaaaaactacccccgtccaaaaagctaaaccgatcggagaaaagcaagaaagacaagctcctcgacgaaaaattcaacgacaaagagctaggtttcctcgcgcggaacatagtggatacaggctacatagcccgcctcgtagccaagtacatcgatatgtacctcgagttcctcccgctggaagaaaacgaaaacacgagtctcgccaggggcgaaaaggggagcaagaaacacatcggcatagtaaacggccgactgacctccgaagtccgccacaactgggggctagacccgaaggaccgcgacaaccatctgcaccacgcaatcgacgcaatagtgatcgcatatatgaacgacaaacgcatcaaagccttcgctgactttcgaaggctgaaggaactaaaaatcaaaaggtacggacgagaaatcacagaagacgaataccaggaaaagaagaaagaactatcatgcgcacccttcgatgacttccgaaacagaaccctcgaaaacatagacaaaatcttcgtttcaaggccaccacggaaacgggcacgcggaaccttgcacgaggaaaccttctacagcatcgacgacaaaaagctactgaaggcctacggaggaaaagaaggaatgcagcgggccctaagcctcggcaagatacggcaaatcggaacgaaaatcgtcaaaaacggaacaatggtacgagttgacatattcaaagacaaaaggggccgcttctacggagtcccaatctacacgatggatttcgcactcggggtactacccaacaaagcagccgtctcaggtaaggacaaaaacggtctaataaaagaatgggccgaaatggattcgggatacgagttctgcttttcgcttttcaaagacgacctcatcctagttcagcgaaaagaaatgcaagagcccgaactctgctacttcgtcagcttcgatagcagcaacgcccagatcgacgtacgcagtcacaataaccacttttccgtcctaaacgagaaccaaaaactactattcaagtccgcgactcaagccgaagtcataggcgaaagcatcggaatccaaaacttaaaagtattcgaaaagtggcacgtctcaccactcggtgaagtacgcaaagccgagttctccccgagaggcgaagcaaagctaaaaacgagcaaaaagcgcaagaaatga

SEQ ID NO: 6078 - RNA, 3072 nt, synthetic construct
  misc_feature 1..3072: note = Cas9 variant
  source 1..3072: mol_type = other RNA
atgaaaatctattcctttgacataggcgtcgcatccatcggttgggccttcatcgaaaacgaagtcctccaagattgtggcatccgaatcttcaccaaagccgaaaaccctaaaaacggggcctccctcgcactcccacgcagggaagcccgaggggtacgaaaacggctagcccgtcggcgcggacggctcaacaccattaaacagctgctatgcaaggagttcggcctccagctggaagactacctctccaacgacggagaactacccaaagcatacaccgcgtcaaaagcgaaccccctaaaatccccatacgaactcagaacattagctctctcgcaaaaactagactccaaagacctcgtacgagtgatactacacatagccaaacaccgcggttacggaaacaaacacgccaaagacagcaaggacacagaaagcgggaaagtcaagaaagccatagagttcaaccgtaaaacactagccgaaaaaggctacaggtccgtcggcgaatacttataccgcgagttcttccaacagtcccgcatttcgcaaaacaacggggccacggagttcattaacgttcgaaataaagcaggtaattacgaacactgcgtcgcgcaagatatgctcaaagaggaactcgaaagcatcctaaacgcccaacgccagttcggtttctctctaaaacaagacttcgaaagcaaactcctcaccaaaatatttgaacaaagacccctaaaatcatttgcagacaaagtcgggaactgctgcttcatcgccggagaaaaacgcgcaccaaaagacagcccatcagcgatagagtttattgcactctcccgcacaatcaacactctaatcaatctcagcaaagaatccggagaaatctacaatagagcaatcattctacagatagtcgaatcgaccctcaagaaaggagaaataagctacaaagaactccgcgaaataatccgactagacgaacgcctcagattcaaagacccccgcctcgactacagtcgcgagataaaagaggcggaaaaagtcaaattcctcgagttcaaacagctaaaaggatttaaaaaggcacttggggaatccttcacaaccctggccatctcacagctagatgaaatcgctgagcacatcgcgctaatcaaagacagagtaaaattgaacgagaaactcgaaagctatgctctcaccaaagaacaacgtgaagccctatcgaacctgtcattctccgctcacatcaatctgtcactgcaggcgctcaaacaaatcttgccgttcatgcgcggagacaacggggaacagtgccttgactacgacgaatcagtagaaaaggccggcctcaaggcgctatcaaaagataccctcaagggccaaatgcttccacccctcaacgagttcgaaccatacctatcaaaccccgtcgttgcgcgggccctagccgaataccgcaaagtccttaacgtcctcctcaaacaatacggcagcccccacaaaatccacatagagtacgcacgcgaagcaaaactatccagtacagaaaggcaaaaatacgagaaagagcaaaaagataactacgcggctaaccaagcagcccacaagaagtgccaagagctcggactagagccctcaagcacaaacctactaaaactcaaactttggcaagaacaaggaggcctctgcctatacagcggcgcaaaaataaccatttcctacctccaagatccaacagccctccaggtcgatcacatctacccctactcgcgctcctttgacgattcctacatgaacaagtgcctagttctcaccaaagccaaccaagagaagggcaaccggacacccttcgaggcattcggcaccgactcagcaaagtggggcgtaattacgacgctagcccagaaactcccacacaagaaacgccgtcgcatcctcaacaccgcattcaacgacaaagaagccggattcaaactgcgcaacctgaacgacacctcctacatagccagacttgtcgcagactacacagaaacgtacctagagttcttacccctcgtcgaatcagaaaacacaacactctccaaaggacagaaaggctctaagaagcacatcgccatagtgaacggtgtactaacatccaccatgcgctactatctcggcttcgcgagtaaggaccgggacaaccatctgcaccatgcattggacgccgtcatcatcggtttcatgaacgactcagtgatcaaggccttctccgacttcaagaagacacaagaaacctcaaaggccgcatactacgcgcacaccttaagcaaacaggaatacaagaaacagcgcgccttcatacaactcccgtccggagaaaacttcagggtatcagtcttggagaaagtagagagcgtcttcgtgtccaaacctccaagaaaacgagtacgcggcgcccttcatgaagccacattctactcccccaacgatcccaaactactaaagaactacggcggcacaaaaggcgtcgaacgagccctcgctttaggcaaaatgcgtaaagtcggggcgaaaatcgtcagcaacggcgccatggttcgcgtcgacatatttaggcacaaaagtagcggcaaattctacggcgtcccggtctacaccatggacttcgccctcggcatactcccaaataaagccgtagtagtcggaaaagaccaaaacggcgtcatcaaagactggctagagatggacagctcgtatgagttcatcttctcgctctacaaggacgatgtgatcctagtacagaagaaagaaatgcaacgccccgaactttgctatttcgtcagcttcgatacatcaggagcctccattaaagtggccaaacacgacaacaacttctcaaccctaaccgaaaaccaaaaactcctgttcagcaacgccaccaaagaagaagtcgtcggtaaatccataggaatccagaacctaaaagtcttcgaaaaatggcaagtcagcgtactaggagaagtaaaacgaacacaatcgtacccaagagaaaacatctcgctcgcttccaaggcaaagaaatga

SEQ ID NO: 6079 - RNA, 3075 nt, synthetic construct
  misc_feature 1..3075: note = Cas9 variant
  source 1..3075: mol_type = other RNA
atgatacgcaccctgggcattgacattggcatcgcgtcgattggatgggccgtcatcgagggcgagtacaccgacaaaggtctagagaacaaagaaatagtagcctccggcgtgcgcgtgttcactaaagccgaaaatccaaagaataaggaaagcctagcgcttccccgcacactcgcccgctccgcaagacggcgcaacgcccgcaagaaaggccgaatccaacaggttaaacactacctatccaaagccctaggcctggatctagaatgtttcgtccaaggggaaaaactcgctacactattccagacaagcaaagacttcttatcaccctgggagctaagagaacgcgctctctaccgagtactcgacaaagaggaactggcccgagttatcctacacattgccaaacgaagaggatacgatgacatcacatacggtgtcgaagacaatgacagcggcaagatcaagaaagccatagcggaaaacagcaaaaggatcaaagaggaacaatgcaaaaccatcggagagatgatgtacaaactctacttccaaaagtcactaaacgtccgaaacaagaaagagagctacaatcgctgcgtcggacgaagtgaactaagagaggaactaaaaacaatattccaaattcagcaagaactcaaaagcccatgggtaaacgaagaactaatctacaaactcctgggaaacccagacgctcaatccaaacaagaacgagaaggcctgatcttctatcagagacccctaaaaggcttcggcgataaaatcggcaaatgctcacacatcaagaaaggggaaaactccccataccgcgcctgcaaacatgccccaagcgccgaggagttcgtcgccctcaccaaatcgattaacttcctcaaaaacctcacgaacagacacggcctgtgcttctcccaagaagacatgtgtgtatacctaggcaaaatactccaagaagcccagaaaaacgaaaaaggacttacatacagcaaactcaaactactactcgacctaccttcagacttcgaatttctaggcctcgactactcaggcaaaaacccagaaaaagcagtcttcctcagcctcccttcaacattcaagctcaacaaaataacccaagaccgaaaaacccaagacaaaatcgccaacatcctaggcgcaaacaaagactgggaagcgattctgaaggagctcgaaagtctccaactatccaaggaacaaatccaaaccatcaaagacgcaaagctcaacttctccaagcacataaacctaagcctagaagccctctaccaccttctgcccctcatgagagagggcaaacgatacgacgagggcgtggaaatcctccaagaacgcggaatcttctcgaagccacaacccaaaaatcgccaactactcccacccctttcggaactcgcaaaggaagaatcatattttgacatacccaaccccgtcctacggcgcgccctatcagaatttcggaaagtagtgaatgccctcttggaaaagtacggaggcttccactatttccacatagaactcacccgagacgtctgcaaagcaaaaagcgccagaatgcaacttgagaaaatcaacaagaaaaataaatcggaaaacgacgcagcgagccaactcctcgaagtcctcgggctacccaatacatacaacaaccggctgaaatgtaaactctggaaacaacaagaagagtactgtctctatagcggagagaaaatcaccatagaccacctcaaagaccaaagagcgctccaaatcgatcatgccttcccactatcgcgaagcctggacgattcccagtcaaacaaagtactctgcctaacctccagcaatcaggaaaagtcaaacaaaaccccctacgaatggctcggatccgacgaaaagaaatgggacatgtacgtcggccgagtctactcctcaaacttctcgccatccaagaaacgcaaactcacgcagaaaaacttcaaagaacgaaacgaagaagacttcctggcgcggaaccttgtagacaccggctacatcggaagagtcaccaaagaatatatcaagcactcattgagcttcctacctctacccgacggcaagaaagaacacataaggatcatcagcggttcaatgacctccacaatgcgtagcttctggggcgtccaagagaaaaatcgagaccaccacctacaccacgcacaagacgcaataatcatcgcctgcatcgagccatccatgatccaaaaatacaccacctacctaaaagacaaagagacacaccgcttgaaaagccaccaaaaagcccaaatcctgagagaaggagaccacaaactatcgctccgatggcccatgtctaacttcaaggacaagatccaagaatccatccagaacatcatacctagccaccacgtctcccacaaggtcaccggagaactacaccaggagacggtccgcacaaaagagttctactaccaagcattcggaggggaagaaggagtaaagaaagccctaaagttcggcaaaatccgagaaattaaccaaggaatcgtcgacaacggagccatggtaagagtcgacatctttaagtccaaagacaaaggcaaattctacgccgtccccatctacacatacgacttcgccataggcaaactgccaaacaaagccatcgtccaaggaaagaaaaacggaatcatcaaagactggcttgaaatggacgaaaactacgagttctgcttcagcctcttcaaaaacgactgcataaaaatccaaactaaagaaatgcaagaagcagtcctggcaatctacaagagcaccaactccgcgaaggccacaatcgaactcgaacacctctccaagtacgcactcaaaaacgaagacgaagagaaaatgttcaccgataccgacaaagagaaaaacaaaaccatgacccgagaaagctgcggcatccaaggcctcaaggtcttccaaaaagtcaagctgagcgtactaggcgaagtcctcgaacacaaaccacgcaacagacaaaacatagccctcaaaacgactccgaaacacgtctga

SEQ ID NO: 6080 - RNA, 3078 nt, synthetic construct
  misc_feature 1..3078: note = Cas9 variant
  source 1..3078: mol_type = other RNA
atgggtggctacatgccacaacttatgcgataccgcctcgccctggacataggcagcacgagcatcggatgggccatgatacgactatccatgcaaaacgaacccatagcaattatccgcatgggggtacggattttctccgatggccgcaacccgaaagatggctcgagcctcgccgttacgcgccgagtagcccggcaaatgcgccgtagacgtgaccgtctcctcaaacgcaagacccgactcctgaacgcgctagtgcaaaagaaattcttcccagaggacgcagacgcacgcaaagcactcgtagtccttaacccctacgaactacgcaaagaaggactatacaggcaattatcgggcccagagttcggcagagcactcttccacatctcacagcgccgcggattcctatccaaccgcaaaaccgacaagaaagataacgacagctccgtccttaagaaagcaatagtggacctacgtcagcaactcgaagttgaaaattgccagaccatcggagaatggctgttcaaacagcaacaaagtggaaaaagcgtccgagcacgcctacgagggaaaacacaaaaagacaaagcatacgacttctacatagaccgagccatgatcgcccacgagttcgacactctctgggtgtcccaagcaaaatacgacccgctcctcttcaacgaagacgcaagggctatccttagagacatcctactctaccaacggccactaaaaccagtcaaaccaggtcgatgtaccctgataccagatgaaagccgggctccactcgccctaccactcacgcaacaagcccggatctaccaagaactaaaccacctacgcatcacaacaccagccctaggggcacaagcactcacagtcgcccaacggaacacaatcgccgcactcctagaaaagagcgacgtgacattcgtaaaaatagccaaagcactgggcctcacatccacaacagagttcaacctgcaggacatcaaacgcgacagactaaaaggaaatgcaaccgcaataatcctggcgcggaaccaatatttcggccgacgatggcacgatttcaacgcagacctacaaaacctgatcgtagacaagctcgtcaatgaagggagcgaaacagcactcatcgaatggctaaaagccaacacagacgtagacgaatccgccgcagaaagggtatcgggagtcacccttcccgaagggtacgggagcctaagcgtcgccgccctacgaaggctactacccgccctaaaagaagacgtagtcgtctactccgaagccgtcaaaagagctggcttcgattcgcactccgcactcagcctaatcgaacagaccggcgaactataccaagaactcccctactacggagaggtcctgcaaagacacgtaggcttcggaagcggcgacccaaacgacagcccggagcgcaggttcggcaaaatagccaacccgaccgtccacataggactaaacgaactccgaaagatcataaacgccctcattaaacgctacggcaacccggcagaagtagtggtcgagctcgcccgcgacctcaaactctcaagagagaaaaggaaggaaatacaagaagaacaaaaacaaagacaagaccgaaacgaaaagagaatcaaagacgcatgcgaaatactgggcatcgacccattagtaatcgaccgaggtaagcgacgcgaaatctcccagaaaatgcaactatgggacgaactgaaccccaaggacgcggccaaccgccgatgcccatacacaggggaccagatcagcattgaaaaactgctcagcgcagaagtcgaaatagaacacatcctcccattctcgaaaacactcgacgactcgctaaacaacaaaacagtagccatgcgacgcgcgaaccgagataagggcaacagaaccccctacgaagcattcggagaaagtctaaatccagactatgactacgacgcaatcctccaacgcgcctcactgatgccccgagaaaaacgcaaaaggttcgcgtcggacggctatcagcaatggctcagggacgacaaggacttcctatcaagagccctaaacgacacggcttacctgagccgcatagccaaggaatacctgacactcatatgccctccaaactcggtccgcgccattccggggcgaatgacagcacaactacgcgccatgttcggccttaacagactccttagcgaaggcggaatcaaaaacagagaagaccacagacaccacgccatcgacgccgccgtcataggagtaaccgaccaaggccttctacaaaaattcagccgagcctccgcccggaccagagaactacagctctcacgcctagtcgatgacatgccactcccgtgggacacataccgagaacacgtcacccgagccctagaacacctcgtcgtgagccacaaaccagaccacgggtaccaaggcaaaatgcatgaggacacagcctggggactaagagacaatgggcaagtaacccgccgcgtacgctcagaagacggcggcccacgccaacgcctcttagagaataagaacgttgtcaagatcaacagcacgcgagactttagcaggcacgggatagacgagcagggacaggtaaacgcctataaaggatacgtcgggggaagcaactactgcatcgaaatatggatcgacgaaaagggaaaatggaatagcgacgtggtgtcaacattccaagcataccaaattgtaagagagctaggagaaaaagcagcctggcaaaaactccgaaatccacttctgtccctcagcgcaaagccgcttgtaatgcgactaatcattgacgacgtagtaaagatgcaaatagcagggcaaaacaaaattatgcgagttgtaaagatcgcccaaaacggacagatcttcttcgcagaacacaacgaagccaacgtggacgccagagacaaagacaaaaacaaccccttcaagtacatcagcaagaccgcaggctcactccagaaagccggcggaatacacatggccatatcgcccatcggcgacgcacgaccggtacgctacggacgctga

SEQ ID NO: 6081 - RNA, 3084 nt, synthetic construct
  misc_feature 1..3084: note = Cas9 variant
  source 1..3084: mol_type = other RNA
atgaaatacaccttaggcctagatgtcggaaccaactctataggctgggcggtcctagagctaaacaccaacggggaaccgcaacgaatcgagaaactcggatcccggatattcaccgacggccggcaccccaaagacggaacaaccctagccagcaagcgaagacagaaacgccacgaacgacggcgacgggacagactacaccaacgcaagaaactcgtgctcaaccaacttgtgagcatgggactgtttccgcagtccgaacaagaacagcaagacctaaaaagcctcgatgtactcacgctacgcgccaacggtgtctccaaacaactaagcgcctacgagctcggccgcgtattttactacctcaacctcaaacgcggttttaaaagcaaccgcaaaggtggatcggaggaagataaagccaacaaaatctccgaacgaatcaagaaactccaggaacagctcaaagaaaacgacttcaaaacggtcggacaatacctgcacgaccgatacatcaagggactatcaacaaaggcaacaatcgagaacgacttccacttactccgccaactcatcgaagacgagttcgacttcatcgtagaaacccaaagtaaattcttccccgaaatatccgacgaacaatggaacaccttacgaaatcgaatgttccaccaacgacccctaaaaccagtcgaaacaggcacgtgctccctattcgaagacaagaaacgcacatacaaatacatgccttctttcgaagagtaccggttcctaaccgagcttttcaacctgtcctatcaagacgaaaacttccactcccactcgctgagctcggaacaaattttcaaagtcttccacgaacttaaaaacacccgggaagctacctacaccaaaatcaagaaactcctcaaactcccctcagacctcagcttctccatcgaacgatcgaaatccaaagacaaaatcaaaatatcaaccaccaaccacttcttcagtaaatccctgctctttgccgaagagtgggcctctctagacctaaaactgaaagacgaagtagccgagatctacttcagcgacatgtccgtcgaagaaattaagaaaggcctcctccaactcaaaatcgactccgagatcatagagaacctgctcgaagaaaaagtcccaaacgtacaagaggctacctgcagctactccaaagaagccctacagaaaatcgtatcactcatattagaagaggaacgccatccgacgcttatcgtagacgacctcttcaaaaacgaaaaagaagagacatccctcatcgaccggctagactactacggagcttccatccctgactccatgcaacccataccacaacacatcaaagacaacaacctgacgctcaacgaggacgaaaaacgctacggcaaaatcgccaatcccaccgtccacgcagctctaaaccaaatccgccaggtagtcaacgacctcatcgaacaatacggcaaacctacgaacatccacatcgagttcgcgcgagatctcaagaaatcgaaagaagaaagagacttcgacaaccgcaagaaaaagaaaaacgaagaactgaacgaacaagtccgcgacttcatagaaaaacacaaccaaaagcctagcgccttcaacttcgaacgagtcaaactctggttcgaactcgacgctatgaataatcaggtatgcgcctacagcggcaagaccatctcagcccggatggtcctctcggacgaagtgcaagtagaccacatactccctttctcccgaaccctagacgactcactcgccaacaaagtactcgtcctcgcatcagagaacgttaaaaagcggaaccgtaccccctacgaagcgtttggccaggacaccgagaaatgggcctccatccaggaactagcaaaacgactcccgtaccacaaacaatggagattcgccgaggacgccatcaagaaattcgaagaaaaagaccaattcctacaacggcacctcaacgacacaagatacatctccaaaatcgccaagaaatacctcggatccataaccgacccctataaaatcgtagcgtcccgcgggcagatgacttcgattataagaggtaaactcggcctaaaccaattcattcagaaacccgacggtaccaaaaaccgcgaggaccacagacaccacgccatcgacgctttgacagttgccctcacatcccgctcatacctaaaacgaatatccgacgcctcggccagaaaccaagatcctaacagaatccccatccctgagccatggaaggggtttatcaaggacgcagacgtcaagttcaacgaaatcattgtttcccacaaagtcgaccatggtaaaaacggccccttcatggaagagacatgcttcggcctcatcaaaaaccccaacaaatacgaagaagaaaacgacttcaaactcataacaaccaaaagcctggactcagtcaaggacccaagcacaatacgaagccaatcgctgcaaaacctcgcagagaaaagcggcgtaatatccctcgccaaaagcggcgtgaagaaactacgcgtgtatgacgtcactaaagaaaacccagccgacataggcctaatcgaatcaggccttgccaaaataacccacggcaaagacaaacaacacgtcaaacactaccaaaagggcgacatcaactacctcgcaatctggtgcctaccccaaaacatcactctcaaatcagacaaccacaagaaacgcaaaaccgattacatattcaccgccattaaaacattcgacctcaacagcaaaaaccccaacgacctacgcccccaccccgccgccaagctagtaacgaaagtatacaaaggcgacaccgtggccctcgaagtaaacaaccagctgaattactacatcgttaaatcaatacgggctgctaacaagaaactctacttcttaaaaatcaaccagagctccgaactagccaacgaaacgcaattcattcccgcctacactaaactggtcgattacaaattccgaaaagtaagcgtctcacccaccggcgtcataactgataacggtcccctcctcaaatga

SEQ ID NO: 6082 - RNA, 3090 nt, synthetic construct
  misc_feature 1..3090: note = Cas9 variant
  source 1..3090: mol_type = other RNA
atgaggagcctaaggtaccggctcgcactcgacctaggctccacgtcgctgggatgggcgctattcagattagatgcctgcaacagacccaccgccgtgataaaggccggagtcaggattttctcggatggcagaaacccaaaagacggatcaagcctggcagtgacaagacgggcagccagagccatgcgcagaagaagagatagactcctcaaaaggaaaacacgcatgcaagcgaaacttgtcgagcatgggttcttcccggctgacgccggcaagcggaaggccctagaacaactaaacccatatgcactacgcgccaaaggactccaagaagctctactacccggagagttcgcaagagcactattccacataaaccagaggagaggcttcaaatcgaaccgaaaaaccgacaagaaagacaacgactcgggcgtgctgaagaaggcgatcggacagctgcgccaacaaatggcagaacaaggaagtcgaacagtgggagaatacttatggacacgactacaacaaggacagggagtaagggcgagatacagagagaagccatacaccaccgaagaaggaaagaagagaatcgacaaaagctacgacctgtacatagaccgggcaatgatagaacaagagttcgacgcattatgggcagcgcaagcagcgttcaatcccaccctcttccacgaagcagcacgagccgacctgaaggacacgctactccaccaaagacctctaagaccagtaaaaccaggaagatgcacattgctcccagaagaggaacgcgcacccctcgcactaccctccacgcaacgattccggatacaccaggaagtaaaccacctaaggctcctcgacgaaaacctaagagaagtcgccctaaccctggcacaaagagacgcggtagtgacggccctagaaaccaaagcaaaactatccttcgaacaaatacgcaaacttctaaagctgtccggaagtgtacagtttaacctagaggacgccaagcgcactgagctcaaaggcaacgcaacaagcgccgcgctcgcccgaaaggaactcttcggggcagcatggagtggcttcgacgaggcactccaggacgagatcgtctggcaactggtcaccgaagaaggagaaggcgctcttatagcgtggctacaaacacacacaggagtagacgaagcccgggcacaagcaatagtcgacgtctcactacccgaaggctacggcaatctaagcaggaaggcattagcccgaatagtccccgccctaagagcggcggtcattacatacgacaaagctgtccaggccgcaggattcgaccaccacagccagctcggattcgaatacgacgcatcagaagtcgaggacctagtacatcccgagacgggcgaaatcagaagcgtatttaaacagctaccgtactacggaaaagcactccagaggcatgtcgcattcggaagcggcaaaccagaagaccccgacgagaaaagatacggaaagatagccaaccccaccgtacacatcggactaaatcaggtcagaatggtagtaaacgcactcataaggcgatacggacgcccaaccgaagtagtgatagaattggccagagacctgaagcaatcgcgagaacaaaaagtagaagcacaacgaaggcaggcggataaccaacggcgtaacgcgagaatacgacgctccatagccgaagtgttaggcataggagaagaacgcgtcagagggagcgacatacaaaaatggatttgttgggaggaactctccttcgacgcagcagaccgccgatgcccatactcgggagtgcagatcagcgcagcaatgctactaagcgacgaagtagaagtagagcacatactaccattcagcaaaacgctagacgacagccttaacaatcggacagtcgccatgaggcaagcaaacaggatcaaacgaaaccgaaccccctgggacgccagggccgagttcgaagcacaaggatggagctatgaggacatactacaacgcgccgaacggatgccactaagaaaaagataccggttcgcacccgacggctacgaaaggtggctaggagacgacaaggacttcctggcccgagccctgaacgacacccggtacctctcgcgagtagcggcagagtacctcaggcttgtatgcccaggaacgagagtaattcccggacaactaactgccctactcagagggaaattcggattaaacgacgtgctagggctagacggagagaaaaatcgaaatgaccaccgacaccacgccgttgacgcctgcgtcataggtgtaactgaccaagggcttatgcaaagattcgccaccgcaagcgcccaagcacgcggagacgggctcacacgcctagtcgacggtatgcccatgccatggccgacctacagagaccacgtagaacgcgccgtaaggcacatctgggtcagccaccgcccggaccacgggttcgaaggcgcaatgatggaagaaacgagctacggaatacgaaaagacggatcaataaaacaacgaagaaaagccgatgggagtgcgggacgagaaataagcaacttaataagaatccatgaggcaacccaaccattaaggcacggagtgagcgcggacgggcagcccctggcatacaaaggctacgtgggaggcagcaactactgcatagaaatcacagtaaatgacaaggggaaatgggagggagaagtcataagcacattccgagcgtacggtgtagtcagagccggcggaatgggccgactaagaaacccacacgaaggacaaaacggccgcaagttaataatgagactcgtaatcggcgacagcgttagactagaagtagacggagcagaacgcacaatgcgcatcgtcaagatatcaggcagtaacggccaaatcttcatggcaccaatacacgaggcgaacgtggatgcacgcaacacagacaaacaagacgcattcacatacacaagcaaatacgccggctcactacaaaaagcgaaaacacgccgggtaaccatctcaccgataggagaagtcagagatccgggattcaaaggatga

SEQ ID NO: 6083 - RNA, 3090 nt, synthetic construct
  misc_feature 1..3090: note = Cas9 variant
  source 1..3090: mol_type = other RNA
atgaaataccgcctagccctagacctaggcagtaccagcttaggttgggccatcgtacaactgaacgcaaaagacgaaccctgcgcaatcgtccgtgcaggagtaagaatctttccagacggccgaaaccctaaagacggcagcagcctagccgtaacaaggcgcaacgcaagagccatgcgaagaagaagagaccggctgctaaaaaggaaagcacgaatgcaaagactcttaatcgaacacgacctgttccccgcagacgaagcagcaagaaaagcccttgaaacattaaacccctatgagctcagggcgaaaggactagacgcagctctaacaccagctgaatttgcgagagccctcttccaccttaaccaacgtcgaggattcaaatcaaaccgacgaactgaccgcaaggacaacgacagtggtgcactaaaagcagcaataggcggacttagagcacaactagacacagccggggcagatggtcgcgcgcgaaccgtaggcgaactgctatggaggcgaatgagcgaccccaacgttctcacagtacgcgcacggtaccgcgaacaaaggatcaccaaggacgacggcaaaacccgcgtggacaagtcatacgatctctacgtggacagagcaatggtagaagcggagttcgacgcattatgggcaaaacaggcggaactctcgcccacacaattcggcgaagcagcaagagcaacactaaaagactgtctgcttcaccaacgaaacctgcgcccagtcaggccggggagatgcacactcgagccagatgaaccgcgagccccactcgcactacccagtcagcaaagatttcgaatcctacaggaagtcaaccatctaagactcctaggaggacgacttttagaagaaagcctatcggtcgaacaacgagacaaactggtggccgcattagaagacggctccaagtcattcaaaacagctataccgaaactactgggcctcccaggaaccgtacaattcaacctcgcggacgccaaaagaaccgaactcaaaggaaacgcaacatcaatgctgctgggaaagaaggacttcttcggcccggcctggcacggcttcagcgaagcacgacaagacgaaatcgtaatgcgaatacaagaagaagaaagcgaagcccgcctcgtagactggctggcaacatcaaccggtgtagacgaggctcacgccctaaaaatcgccaacgccgccctcccggaaggctacggatccctgagcgcaaaagcactagccaaaatcctccccgcaatgagagccgaagtgattacgtacgacaaagcggtcctagcggcaggctacgaccaccacagccacatctcacacgccgcctccacaggcgaaatactgcccgaactcccctattatggcgaatacctccaaaggcacgtgggcttcggcacgggagaactcaacgacacaccagaaaagcgattcggccgcatcgcaaaccccaccgtccacataggactaaaccaagtgcgcgttgtcgtaaacgcgctcataaaaagatacggccaccccaccgaagtcatagtcgaggtggctcgcgacctcaagcagtcacaagaccagagaagagagacccaagaacagcaggccaaaaaccagaaaagaaacgaaaggctgcgcaaggatgccgctgcaatcctcggaatagctgacgaacgagtacgactagccgacatccaaaagctaatcctgtgggaggaattatcattcgacatagctgaccgaagatgcccatacagcggagttcaactaagcgccgctatggtcttatcagagcaagtggaaatcgaacacatcctgccattttcaatgacgctcgacgacagcctaaacaataaaacagtcgcaatgaggctagtcaaccggctgaaaggcaaccgcacaccgtgggacgcccgcgaagccttcgcaggacaaggatgggactatgacggcattttaatgcgcgcagagcgaatgccaagagcaaaaagacaacgattcgctccagatggactagaaaaatggcttaaagaagacaaagacttcctcgcaagagcactaaatgacacccgacatctctcgagagttgcccgagaatacttatccctagtatgcccagcctctacaagggtaatcccaggacaaatgacagccatgctccgagcaaagttcggactcaacgacatactaggattgaacggtgagaaaaacagaaacgaccacagacaccacgcagtcgacgcatgcgtcgtcgcggtaacagaccaagggctgctacaaaggttcgcccaagcatccgctgacgcgagggggaaaggcctggaccgactcgtcgaaaccatgccggacccatgggactcgtaccgagagcacgtccagagagccgtcaacagcatctgggtctcccacaagcccgaccatggattcgaaggcgcaatgcacgaggacaccacgtacagacctccccacctagacccgaagaacatgtggcgcacaagaggcataggcggtgggaagcccaacgagaaagaagcagacagcaaggcaatggtcggattcactgggccggaacacctacaacgccaccatcgagacaaagccggccaacaactaccatacaaaggatatgtcgcgtccccaaaattctgtatggacatagtaagaaacgacaaaggccgatgggaaggggaagtagtatcaaccttcgaagcctacagactggtgagcgagttcggccgagacgccgcactcgcgcacatacaaagcaaaagccgctcgatctccggaaagcccctcgtaatgagactccaaggaggcgacatggtcagatttgacgacgatgaaggacgcccagtagtcttgcgagtagtaaacatgacgggcaacggacaaatattcttcgcaccccacaacgaagcgaacggcgatgcaagaaaccgtgacaagcaagaccaattcgtatacttaagtaaatacgcgggcagtctacagaaagcccgaggtcgacgagtcacagtgagccccgccggggaactgcgggacccaggatttaaagaatga

SEQ ID NO: 6084 - RNA, 3090 nt, synthetic construct
  misc_feature 1..3090: note = Cas9 variant
  source 1..3090: mol_type = other RNA
atgcgatcactaagatatagactcgcgctggacctgggatcaacaagcctgggatgggctctattccggctagacgcctgcaacagaccaacagccgtgatcaaagcaggcgtaagaatattctcagatggccgaaacccgaaagatgggagcagcttagctgtgactaggagagcagcacgagccatgaggagaagaagggaccgactactgaagagaaaaacacgaatgcaagccaagctagtagagcacggattcttcccagcggacgcaggcaagagaaaagcactggaacagctcaacccatacgcactaagggcgaaaggactccaagaagcactcctgcccggagagttcgcaagggccctcttccacataaaccaaaggcgagggtttaagtcaaaccgaaagacggacaagaaagacaacgacagcggcgcgctcaagaaagcaataggacaactgcggcaacaaatggcagaacaaggaagccgaacagtgggggaatatctatggacccgcctgcaacaagggcaaggagtacgggctcgctaccgagaaaagccgtacacaacggaagaagggaaaaagcgaattgacaagtcatacgatttgtacatcgacagggcaatgattgagcaagaatttgacgcgctatgggcggcccaggccgcgttcaacccaacactattccacgaggcagcgcgagcagacctaaaagacactctgctccaccaaagacccctgcgacccgtaaagccaggacgatgcacactcctaccggaagaggaaagagcgcctctagcgcttccgagcacacaaagattccggatacaccaagaagtaaatcatctgcgcctcctagacgaaaacctaagggaagtggcactaaccttggcccagcgagacgcagtagtaacagccctggaaaccaaagcgaaactgagcttcgaacagatacggaaactactgaaactatcagggtcggtccaattcaacctagaggacgcgaagaggacggagctaaaaggcaacgccacgagcgcggcgctagcaaggaaagaactattcggagcagcatggagcgggttcgacgaagcactccaggacgagatagtgtggcagctagtgacagaagagggggaaggcgcgctaatcgcctggttacaaacgcacaccggagttgacgaagccagagcccaggcgatagtagatgtaagcctcccagaaggctacggaaacctgagccgaaaagcactcgcacgcatcgtccccgcactacgagcagccgtgataacgtacgacaaagcagtacaagccgccggctttgaccaccactcacagttaggattcgaatacgacgcgagcgaagtagaagacctagtacaccccgagacgggggagatacgaagcgtctttaaacagctcccatattacggaaaagccctacaacgacacgtagcattcggaagcggcaagcccgaagacccagacgagaaaaggtacggaaaaattgccaacccgaccgtacacatcgggctaaatcaggtacgaatggtcgtgaacgcgcttataagaagatacggacgaccaacagaagtcgtcatcgagctagcccgcgacctcaagcagtcacgcgagcaaaaggttgaggcacagcgacggcaagccgacaaccaaagacgaaacgctaggataaggcgcagcatagccgaagtactcggcatcggcgaagaacgagtacggggatcagacatccaaaaatggatatgctgggaagagttgagcttcgacgcggccgatcgcagatgcccgtactccggagtacagataagcgcagccatgctcctaagtgacgaagtagaggtcgaacacattttaccattcagcaaaacgctcgatgacagcctaaacaataggacggtagcgatgcggcaagcaaacaggattaaaagaaacagaacgccatgggacgccagagccgagttcgaagcacaaggctggtcatacgaagacatcctacaaagagcggaaagaatgccacttaggaaacgatataggttcgcgccggacggatacgaaaggtggttgggcgacgacaaggacttcttagctcgagcactcaacgacacccgctatctatcaagagtagccgcagagtatctacgcctagtgtgcccgggaacaagagtgatacccggacaactgaccgcactgctgaggggaaaattcggacttaacgacgtgctgggcctggatggcgagaaaaacagaaatgaccaccgccaccacgccgtcgacgcatgcgtaataggagtcaccgaccaaggcctaatgcaaaggttcgcaacagcgagcgcacaagcgcgcggagacggactaacgcgcctagtagacggaatgcccatgccgtggccaacgtaccgcgaccacgtcgaaagagcggtacggcacatttgggtaagccacagaccagatcacggatttgaaggcgcaatgatggaagaaacaagctacgggattcgcaaagatgggagcatcaaacagcgaaggaaggcagacggcagcgccggtcgggaaataagcaacctaattcgcattcacgaagcgacgcaacccctcagacacggagtgtcagccgacggccaaccactcgcatataagggatacgtgggaggaagcaactattgcatagaaataacagtaaacgacaaaggcaaatgggaaggagaagtcataagtacgttccgagcctacggcatcgtgcgggcgggaggcatgggccggcttcgaaacccgcacgaagggcagaacggacggaaactaatcatgagactcgtgataggagactccgtgagactagaggtcgacggagcagaacggacaatgcgcatagtcaaaatatcgggctccaacggacagatatttatggcacctatccacgaggcaaatgtcgacgcaaggaacaccgacaaacaagacgcgttcacgtacaccagtaagtacgccggatcactgcaaaaagcgaaaacgagaagagtgacgatcagccccataggcgaggtcagagatccgggcttcaagggatga

SEQ ID NO: 6085 - RNA, 3096 nt, synthetic construct
  misc_feature 1..3096: note = Cas9 variant
  source 1..3096: mol_type = other RNA
atgccagcaatatatagactggcactagacttagggtcaacaagccttggctgggcggtactacgactagaacccgccgccctagaaccaatagcaataatcaaagcaggggtcagaatattcagcgacggacgtaacccgaaggacggagcaagtttggcagtaaccaggagagcggcacgagccatgcgaaggagacgggacagactcctgaaaaggaaagcaagaatgcaagacaaactcgtgaaacacggcttcttccccagcgacatggacgaacgcaaggcgctggagcgactcgacccctacgctctacgagcaaagggactcagggaagcacttacacccggggaatttgcaagggccctcttccacatcaaccaaagacgaggattcaaatcaaacagaaagacggataagaaagacaacgactcaggagcgctcaagaaagcaatatcgcacctacgacagcaaatggaagctggcggacacaggaccgtgggagaccacctctggtcacgtctacaacagggactaggagtgcgagcacgctaccgcgaaaccccattcacgaacgacgaaggaaagaagcgaatagacaaatcatacgacctatacatagacagggcaatgatagaacaggaatttgacgcattgtgggcggcgcaagcagccttcaacccagcactcttccacgaagtggcacgggctgacctcaaggacacactcctccaccaacggagactaagaccagtaaaaccgggccggtgtaccctactaccggaggaagaaagagctcccttggcgctcccctcaacacaaagatttagaatctaccaagaggtaaatcatctgcgcctactgggtgaagatctccgagaagttgcactaaccctagcgcagagggacgcagtcgccaacgcactagaatcgaaagcgcgcctaacattcgaacaaatacgaaaactactcaagctctccggatcagtgcagttcaacctcgaagacgcaaaaagaaccgaactcaaaggcaacgcaacaagcgcagccctggcacgaaaagaactcttcggagcggcatggggcgggttcggcgaggcactacaagacgaaatagtatggcaattagtaacggaagaaggcgaaggcgcgttgatagcctggctgcaagcgcacacgggagtagacgaagcccgagctcaggccatagcagacgcaagcctacccgagggctacggaagcctaagcagaaaagcgctggcccgaatcgtaccagcactaagagcaggcgtagtgacatacgataaagccgtccaagccgcaggattcgatcaccactctcagcttgggttcgaatatgacgcgggcgaagttgaggactgggtccaccccgacacgggggaaattcggccagtcttcaaacaactcccctactatggcaaaccactgcaacgccacgtagcattcgggagcggaaaaccagaagacccggacgagcgcagatacggcaaaatagccaacccgacagtccacatcggcctgaaccaagtacggacggtcgtgaacgcactcataagacgatacggcagaccgaccgaggtcgtaatagaactagcaagagacctcaaacaatccagagaacagaaagtggaggctcaacgaaagcaagcggaaaaccaacggcgaaacgcccgaatccgcaaatcaatcgcagaagtactaggtatcggggaagaacaagtgaggggcgccgacatccagaaatggatctgctgggaagaactgagcttcgacgtggccgaaagacgttgcccctactcaggggtacaaatatccgcacgaatgctcctgagcgacgaggtggaagtagaacacatactaccattcagcaaaaccctagacgacagtctgaacaaccgaacagtggcgatgagacaagcaaaccgaatcaaaagaaacagaacgccgtggaccgcacgagacgacttcgaagcgcaaggatggtcatacgaaggaatactccaaagagcagaacgaatgccactcagaaaaagatataggttcgcgcccgatggttacgaaagatggctgggcgacgacaaagacttcctggcacgggcactaaacgacacccgatacctcagccgcgtcgcagcggagtacctccggctcgtgtgcccagggagtggcacccgagtaatcccgggccagatgacggccagacttcgcggaaaattcggtctcaatggagtactcggacccgacggagagaaaaacagaaatgatcatagacaccacgcggtcgacgcatgtgtgataggagttacggatcagggactaatgcaaagattcgccaatgcaagcgcccaagcgagagaagacggcctaacgagattagtcgacgacatgcctaggccatggccaacgtacagagcacacgtcgaaagggcagtgaggcacatctgggtaagccatcggccagaccacggattcgaaggggccatgatggaagagacgagctacggcatcggaaaggacggaagcataaaacagagaagaaaagccgacgggtcaccgggcagggaaataacaaacttaatcagaatacacgaggccacccaacctcaaagacacggcgcaggacccgacgggcaacctctcccatacaaaggatacgtaggagggagcaactactgcatcgagattacaagaaacgacaaaggcaagtgggagggagaagtcataagcaccttccgcgcctacggcatagtaaggaccagcggcctagggcagttacgacacccgagggtcggccaaaatggacgcgaactggtgatgcgactggtcatcggcgactcagtccgattagaaatagatggtatagaaagaacgatgaggatagtaaaaatatcaggatcaaacggacagatattcatggcaccaatccacgaagcaaacgtagacgcgcgcaacagcgacaaacaggacgcattcgcatatacaagtaaatacgcgggatcactacagaaaacgaaagcgagatttgtcacgatctcgcctatcggagaagtaagggacctaggattcaagggctga

SEQ ID NO: 6086 - RNA, 3099 nt, synthetic construct
  misc_feature 1..3099: note = Cas9 variant
  source 1..3099: mol_type = other RNA
atgaagaaacgaatactggggctggacatcggaatcgccagcgtgggctgggcccttgtagaatttgacgacgagttccaagacaataaaaagaaaggcaccataatcaaaagcggagtaagaatattcacaagagcagaaacgccaaaagaaagagagtcactggcaaaacccagacgcgaggcgcggagccagagaagacgcatccgcaggcgcgtggagcgcctcaactcaatacgcgagcttttcgtgaaaaacggagtagtagaggaatggagcgtaagcaaaaagaacccgaataacatctacataaccctaaatcagatcaaaacaccctggcaactccgcatggaaagcctggacagaaagctgacgaacgagcaattcgcggtagtactaacacacctcgccaaacacagagggtacaaaagcctgcgcaaagacgataaagcaggcaaggtgctcgaagccatcagccaaaacaagaaaaggctaaacgacagcgactacaggacgctaggcgaaatgttctgcaaaaacgagagctataaagaacacaaaagaaacaaaggaggggagtacatcaacagcgtagcacgcgaactaatcgaagaagaagtagagaaaatcttcgtaaagcaaagggaaaaagggaacaacttcgcggacgtgaacacagaacgcgagtacctgaaaatcgccttcagccaaaaaccagccgggagcataagcaaaatggtaggattctgcaccttcgagaacggtgaaaagcgggcaccacgcgattcttacagcgcggagctattcaaagtcctatgcacaatcaacaacaccaccttcacagacatgaagacgggagaaatacggagcttcagtaaggaagaaatcggcaaaacactagagaccgtcaaaaatgtgaaagacgtaaagtacgccaaaatccgaaaagacctggggctggaggactcagtcaagttcagcggcgtggactaccgagaaaacgcaaaatcaaaaggggaaggcgaaattttcgtaagcatgaaaacgtaccacgagatcaaatccaaaatcgagaaactaagcaaggaaaagtgggacaacctcaaggggaacacggagctcctagactccatagtaaacataatcgcaaacctaaaggacgacgagagtatcaagaaagagttccagaaactaaaaatagacgaggacatcatagacgtactcctaaacttcgaatttaagaaatttataaacctctccttcaaagcgctccgaaaaataataccgttccagttccagggccaaaaatacataacggcaagcacgtccgcagggtactccctaaaacaagagggaatcaaaaacaaactggtaccgcccgcgaaagaaaacattaacgtagccgtagtagcgcgagccttcgcacagacgagaaaagtgataaacgccgtcatacgaaaatacggtcagtttgatcaaataaacatcgaactagccaccgagctcaaaaattcgaaattcgatcgaagcaaaatagaggaaggacaaaagaagttccagagccagaaggacaaaatctttaaggaggtccaggaactacgaggaggcatgacccccagcagcagtctccttctgaaatacagactgtggcgcgagcaagacgagagatgcgtatacagcggcaggaaaatcagcttcgaggacctactagacaccggcttcctagacatagaccacatcataccctacagcaagagcatggacgacagcttcaacaacaaagtactatgcttagcggaggagaacagaaacaagaaaaatgatatacccttcaactactaccaacgaatcgaccgggactggaacctcctgatcagtataataaccagcatgaaaaacatgaagatagccaagaaaagcagactactgaaacaggaactaagtgacatcgagggtttcatcgaacgaaacatcaacgacacacgctacgccacgcgatacatcaaagacttcctcgagaacaatctagagttcaaagaaaacgagttcatcaaagtgaaagtccaggccagaagcggaggcctgacgagcgtgctgagttacaattggggcatgagcaaggacagggaagaatcatacttccaccacgcgaaagacgcgataatagtagcttgcagcacgcaaggaatggtacagtatatatcgaaaatatcacagcaatacgaaaacgacaaagacaaaatgaagaaaataaaagacaaaacagagaactgcataccgaaaccgtgggactcgttcagagcggacgtcgaggaaagcatcgaaggaatattcgtgtccttcgccccgcgacacaaggtaacaggcagcgcacacaaagaaaccatatacagcaagaagcacctagaaaaagaaagatacgtcacggtgaaaaagagtctagacaaaataaagctaagcgacctagaaaacataccgtgcaacgagaactgtggcataatcagagtactaaaagagcgccttgagaagttcaaaaacgacagcctaaaagcgttcgcagacccggtccacatgcccacgaaatgcccgaacaagaaaggcccggtgatccggagcgtaaaaatcaaagaaagcaacaaaaccggcatagaagtacgtaagggcctggccgagcgcggggaaatggtcagagtcgacgtattcataaaagacaaaaagtactacttggtccctatctacgtatccgactttaaaaacaaagacctacccaacaaggccatcgccgcgctaaagctcgaaaacgaatggatcatgatcgataagacatacagcttcaagttctcactattcaaggacgacctcataaaaatcaagaagaagaaggaagagatattcggatacttcggtggggtacacaggagcacgggcacaatcaagatcaaatcccggcacaagcccaaagagatagacgagggcatcggctcccgctgtctcctggacttccgaaagttccaagtcgacgtcctaggcaactacacagaagtcaagcacgagaaaagaatgccggcatatataaccaggaaagacaagaaacattga

SEQ ID NO: 6087 - RNA, 3105 nt, synthetic construct
  misc_feature 1..3105: note = Cas9 variant
  source 1..3105: mol_type = other RNA
atgaaaatactgggattcgacataggcatcgcaagcatcggctgggccttcgtagaaaacggagaactccgggactgcggcgtccggatcttcaccaaggcggagaacccaaaaacaggagactccctcgcaatgccccgcagagaagccagatcagtgaggcggcgcttggcccgcagaaaaggccgcctagaaacactcaaaagactactagccaaggaatgggacctctgctacgaagactacatcgccgcagacggagaactgcccaaagccttcatgggcaaaaacctaacaaacccctacgtactccgatacgaggcactccaacgcctcctcggaaaggaagaactagcacgggtgatactgcacatagctaaacaccgcggatacggtaacaagaacgcaaaaatcaccaaatccgaggaatccaagcgcgaacaagggaagatactaagcgcactggcgaccaacgcgagcgtaatcgcgaggtaccgcaccgtcggagaatacttctacaaagaattttgcgaagtaatcaaaaatccacaaggcctaaacaccaacgagaactgcacccaaccaaaagtcagagtcctcaagcctatacgcaacaaaggaggagaatacacaaactgcatcctacaagaggacctgcaacgcgagctgaggtgcatcttcgagcaccagaaagggttcgggttccccataacacaggagttccaagacaaaatattgaaaatcgcattttaccaacgatcactcaaagatttctcccacctcgtcggcaagtgcacattttacccagacgaaccacgggccccaaaattctccctctcagcaatagagttcataacgaaagctaaaacaatcaacctcctcgtcggcatcgtcaaggaatccggcgaagtctgggacaaagaacaatggcgagaacgactggactcggtcttcagcgccgtgtgtgaacgcggcaatctaaccttcgcacagatgcgcaaaatactcaaaatcgacgaacggatccagttcaaagaagtagactacaccgcgaaaaacccggagaacaagaaattcgtggagttcaaaaacctgaaaaagttctgcgaaatattaggcgccatagtaggcgatcgggcactggccgacagcatcgcccgcgacatgaccctgatcaaggacgaagaggaactagcacaaaaactccgcggatacggtaaatttagccaggagcagatcacccaactaggggctctaaacttcagccaccacatcaacctatccctcaaggccctttctgagatcctacccttcatgcgcgaaggcatgcgctacgacgaggcatgccaggaagccaaactacaggcaaaacacaacgacaagaaatcaaaattcctgccacccttctgcggcagcatatacgcagacgagctaacaaatcccgtagtccaccgggccatagcagaataccgcaaaatcctaaacgcactgatcgcaaaatatggaaacgtacacaaaatccacatcgaattaacaagagacgtcggcaaaaacttccaggaaagggagaaatacaagaaagaaatcgagtcaaactacaaggcccgggtacaggccatgcaagaatgcgaaaaacttggactcacactttccgagggaaatattctgaaactaagactattcatggagcagaacgaacgctgcgtctactccggacgaaaaatcacgctagcaaacctgaaggaacaaggagctcttgaaatcgaccacatactaccctactcacggtcatcagacgacagctacatgaacaaagtcctggtcttcacaaacgaaaaccaaaataagggtaacaagaccccatatgaagccttcggaggagacagccaaaaatggggagaaatcgaaagcctcgccctccgcagcggctaccccaaaaagaaagccaagcgcatcctggataagggattcggcgatcgcgaagccggattcaagagccgaaacatagtagacagcgggtacatcgcccgactcatagcaaactataccaaagagtacctgaaattcctacccctagattcccacgaaaacaccgcactcatcgcaggagaaaaggacagtaaaatccacgtcgaagcagtaaaaggcatgctcaccgccaccatgagacatttctggggactcggcagcaaaaaccgctacgaacacacgcaccacgccatagacgcaatcatcatcgcttacatcaacgcagccatgatccagcgattcagccaattccgccaaaaccaggaaagcctgaaggccagattctacgcaaaagagctagccaaggaggagttcaaaacccaaagagcattcttcgaacccttctccggattccgcgaacaagtgcttgcaaaggtcggccaaatattcgtctcgagacccccgcgcaaacgcgctaggggcgccctacacgaagagacattctactcaatcgacgacaagaaactcagcgagacctacggaggcaaagagggcgtacagcgcgcactaagccttggcaaaatacgacaaatcgggacaaaaattgtcgccaacggaccaatggtccgggtcgacatattcaagcacaaaaagagcgggagattctacgcagtgccaatttatacaatggacttcgccctaggcatcctcccaaacaaagcagtggtcagcgggaaagacaacgatcgcatcatcaaagactggctagagatggactcaaactacgaattttgcttcagcctattcaaagacgatgtcatcgaagtccagaagaaagacatggaaaaaccggaacttgcatactttgtcagcctaaacacatcaagcgcaagtatagccctggtcaaacacgacaacaaattcgagacactcacctcgaaccaagctaaactgttttccaatgccaaagaaaacaacgtaatcgcagaaagtcttgggatacaaaacctcaaggtattcaagaagtacaaagtcagcccactaggcgaaatcaaagaagcaaaatacgagccacgccaaccaatcgccctcaagacgagcccaaagaaacaccgcaaacagaacaatgcccaatga

SEQ ID NO: 6088 - RNA, 3108 nt, synthetic construct
  misc_feature 1..3108: note = Cas9 variant
  source 1..3108: mol_type = other RNA
atgcgccgcctcgggctcgacctcggaaccaactctataggatggtgcctgcttgatttaggagacgacggcgaaccggtctcaatcttccgcacaggcgcacgaattttctcagacgggcgcgacccgaagtccctaggaagcctgaaagcaacccggcgagaagcacgactcacaagacgccgacgggaccgcttcatccagcggcaaaagaacctcataaacgcactcgtcaagtacggcctaatgcccgcggacgaaatccaacgacaggcgctcgcctacaaagacccctacccaataagaaagaaagccctcgatgaagccatcgacccgtacgaaatgggcagagccatcttccacataaaccaacgaagaggcttcaaatcaaacagaaaatcagctgacaacgaagccggtgtcgtcaaacaaagcatagcagatctagagatgaaactcggcgaagcaggcgcacgcacaataggagagttcctcgctgacagacaggccaccaacgacacagtccgcgcgcgccgtctaagcggtaccaacgccctgtacgaattttacccggaccggtacatgctagaacaggagttcgacaccttatgggccaaacaagcagccttcaacccatcgctatacattgaagccgcgcgcgaacgtctaaaagaaattgtcttctttcaacggaaacttaaaccccaggaagtcgggcgatgcatctttctctccgacgaagaccgcatatccaaagcgctcccatcattccaacgcttccggatctaccaggaactatccaacctcgcctggattgaccatgacggggtcgcccaccgcatcaccgcatcactcgcgttacgagaccacctattcgacgaactggaacacaaaaagaaactcaccttcaaagccatgagagcaatacttagaaaacaaggcgtagtagactacccagtcggcttcaacctagagtccgacaacagagaccatctaatagggaacctgacctcatgtataatgagagacgcaaagaaaatgattggatccgcatgggatagactagacgaagaagaacaagactcattcatactgatgctgcaagacgatcaaaaaggcgatgacgaggtcagatcaatactaacccaacaatacggcctaagtgacgacgtcgccgaggattgccttgacgtaaggctcccggacggccacggatccctaagcaagaaagccatagacagaatactacccgtcctaagagaccaaggcctcatctactacgacgccgtcaaagaagctggactcggtgaggcaaacctctacgacccatacgcagccctcagcgataaactggactactacgggaaagcactggcaggccacgtcatgggcgcatcaggcaaattcgaagacagcgacgaaaaacgctacggcaccatatcgaatcccacggtccacatcgccctgaaccaggtcagagcagtagtcaacgagctcatccggctccacggcaaacctgacgaagtagtaatagaaattggcagggacctccccatgggcgccgacggaaaacgcgaactagaaaggttccaaaaagagggcagagccaagaacgaacgtgctcgcgacgagttaaagaaactcggacacatcgactcccgcgagagccgccagaaattccaattatgggaacaactcgctaaagagccagtagaccgatgctgccccttcaccggaaaaatgatgagcattagcgacctgttctccgataaagtcgagatagaacatctgctccccttcagcctcacgctcgacgacagcatggccaacaaaacagtctgcttccgacaagccaatagagacaagggaaatcgagcaccattcgacgcattcggaaattccccagcaggatacgactggcaagaaattctcgggcgatcccaaaacctgccctatgccaaaagatggagattcctgcctgacgcaatgaaacgattcgaggccgacggaggcttcctagaaaggcaacttaacgacaccagatacataagtcgctacaccaccgaatacatctccacaatcatccccaagaacaagatctgggtagtcacgggaagactaacctcactcctccgcggattctgggggctaaatagcatactccgggggcacaacactgacgacggcactccggcaaagaaaagccgcgacgaccaccgacatcacgccatcgacgcaatcgtcgtcgggatgactagcagagggcttctacaaaaagtctcaaaagcagccaggcgcagcgaagacttagacctaacacgcctattcgaaggcagaatagacccatgggacggattccgcgacgaagtaaagaaacacatcgacgcaattatcgtcagccaccgccctagaaagaaatcacaaggagcactccacaacgacaccgcctacggcatagtcgagcacgcagagaacggcgcaagcaccgtcgtgcatcgagtccccatcactagcctgggaaaacagtcggacatcgaaaaagtcagagacccactcatcaaatcagcactcctcaacgagacagccggactctcagggaaatccttcgaaaacgccgtacaaaaatggtgcgccgacaacagcatcaagagtctccgaatcgtagagaccgtatcaatcatacctataaccgacaaagaaggagtcgcgtacaaaggatacaagggagacgggaacgcttacatggacatataccaggaccccacctcctccaaatggaaaggcgaaatcgtctcacgattcgacgcaaaccaaaagggcttcatacctagctggcaatcacaattccccacagccaggctgattatgagactccggatcaacgacctactaaaactgcaagacggcgagatcgaggagatataccgcgtccaacgcctctccggctcaaaaatcttgatggccccacacaccgaagcgaacgtcgacgcccgggacagagacaaaaacgacacattcaaactaacgtccaaaagccctgggaaattacaatccgccagtgccaggaaagtacatatcagcccaacaggcctaatacgggaaggatga

SEQ ID NO: 6089 - RNA, 3108 nt, synthetic construct
  misc_feature 1..3108: note = Cas9 variant
  source 1..3108: mol_type = other RNA
atggagcagctaaactacatactcggactggacataggaatagcaagcgtgggatgggccgtcgtcgaaatcgaccacaacgaagaccccatacggcttatagacgtcggggtgcgcacgttcaacaaagcggaagtcgcaaaaacgggagagtccctgagcctcatacgccgtctcgcacgaggctcccgcagactcgtacgaagaaagaaaatgcggctcctcacagccaaacgtctactcaaatcagagggaatcctcagcgatctagacttcaacaagggcgccatactgaacctcccaaacaactgctgggagttacgcgttaagggcctcgacaagaaactaagtgacaaagaatgggccgccgtattactccacataataaaacatagagggtatctgagccagcgaaaacacgaccgcaaaacagacgacaaagaactgggagcactcctttcgggcgtatctaagaaccatagccttttagaagagggcgaatttcgcacagccgcagagctcgccatcaacgtattctgcaacagtaagggccacatcaggaaccaatggggcgattactcacacaccttctcacgactggacctccaaaaagaaataaaacaactattcgtaagccagagagaactgggaaacccctacacatcatcctccttcgaagagaacataatcagcctcctcatgaaacaaaaagaagccatctccgggaatgacattctaaaaatgctcggaaaatgcacctacgagaaaaacgaatataaagcggcgaagaacacgtacagcgctgaaaggtttgtatggttaaccaaactcaacaacctccgtatcgtcgacgacggagtcgaacgagcactaaactccagcgagcgaaaactcctcatcgatgagccttacaagaaagccaagctcacgtacgcccaagtccgaaagatactcgaactaccagactcagcggttttcaagggggtgcgttacttcgctgacaatgccgagtcatcaaccctaatggagatgaaattctggcactccatccggaaagcactcgaaagcaacaacctaaaagacgagtggctggtcctaaaaacaaaaccagagctactcgacgaaatcggcaccggcttcagcatctacaaaacagacgacgatatcacaagctacctcagcaacaaactggacaagaaagtactcgacatactgctcgtcgaggtcagctttgacaagttcatagagctaagcctaaaatgcctccgaaagatcatacccctcatggaaaaaggataccggtacgacgaagcatacaagtacatttacggcgaagtaaacatcgagtacaacctgaacgacatcaaaaacccggtcgtcctcagaagtttcagccaatcccgaaaagtaataaacgccgtcattcgcctgtacgggtcccctgcccgcatacatatcgaaacggcacgcgacataggcaaatccttcaaggagcgtaaagcgatagaaaaacaacaggaaaagaatcgcctagagaaagtacgcgccgcggaacacttcaagcagctgttccccaactacgtcggggagccaaaggccaaggacatactcaaagtacgcctctacgaacaacagcaaggcaaatgcctatacagcggcaaaatactagacataaaacgactaatggagcacggctacgtcgagatagaccacgcactaccattctcacgcacatgggacgattcattcaacaacaaagtactggtcctagcgaacgaaaaccagaacaaaggaaataaaacaccgtacgaatggtttaacgggaaagacaactccgattcctggaagaggttcctggcgctagtcaacaactcgggcttctccgcagtaaagaaacaacacatactgatgaaagaaatagacgaggagggatttaaacaacgaaacctgaacgacacccgctacataacgaggttcctatgcaactgggtagaaaacaacatccctctcctcggcaaaggcgtgaaacgcgtcttcgcaccacaaggcaagatcaccgccctactacgaagcaactgggggattcgcaaagtaagagaggataacgaccggcatcacgcgatcgacgcaatcgtggtagcgtgtaccacggtcagcatacaacaaagaataaccaactacgtcaagaacagcgaaataaaccgtaaaataaaacgacaaaactacttgaagttcccggagccatggaaattctttcgcgaagacatttccattcgagtcttcagcaacaacccaatcgaggaactaaagcaacaactgagcgaccgaccagaagcaaaccaccagttcgtcaccccactattcgtaagccgagccccagtcaggaaaatgaccgggcaagggcacgaggacacgatccgcagcgcaaagcgcatatccgaaggaatatcagtgctacgagtgccactcaccaagctcaacgacaaaagcctcgaactgatggtcaacagagaacgagagaaggagctatacgacgccctgaaacaacggctcctcgagttcaaaaacgaccccgaaaaggccttcgcagaaccattctacaagaagggaggacagcaagtaaaaacagtacggatagagcgcgtccaaaagaatggcgtcctggtcaacaacaacacggggatcgccgacaacgggaacatagtccgcgtagatgtgtttctaaagaaaaagaagtactttctagtaccaatctacagctggcaagtagccaagggaatactgcccaacaaagcaatcgtagcccacaaaaacgaatgcgactgggcagacatggacggctccgcccaattcctattctcgctgtacaccaacgacctgatagaagtagttctcaaggacagcaccatcctaggatacttcagctcaatcgatagggcgaccgcagccatcataataaaggagccagacatggaaaaatcgaaaggcaaagaaggcatccacagagtgggcgtaaagacagcacggtcgttcataaaatacaacgtagacgtactgggcaaaaacataagccgatgccgcaaagcgaaacggctcccagtacgctga

SEQ ID NO: 6090 - RNA, 3108 nt, synthetic construct
  misc_feature 1..3108: note = Cas9 variant
  source 1..3108: mol_type = other RNA
atgctacgaaaaatgcattaccgtttagcactagacctgggctcgacatccctgggctgggctatgatccgcctaaacgccggaaacgaaccctgcgcagtcataaaggcgggagtccgaatattctccaacgggcgtaaccccaaagacggcagcagcttagccgtgactcgacgcgaggcgcgcgccatgcgacgcaggagggaccgattgctaaaacgcaaagccagaatgatacaaacactcatagaatatggcttcttccctgccaaagaggaccaaagaaaagcactagaaataatgaacccattcgcactgagagcaaaaggcctcaacgaagctctaacaccggccgagttcgcaagagcattattccacatcaaccaacgacgaggcttcaaaagcaacaggaagacagacaagaaagacaacgacagcggggctctcaaaacagcgataaataaactgcgcgaaaccctaaaaacagaaaattgtcgtaccgttggagaatggctgaacaaaagagacgtggcaggcctaacagtccgcgcaagataccaccaagacaagacgataaaagaggatggcaaatctaaaataaacaaatactacgacctatacatagaccgagccatgatagagcacgagttcgacgaactatggaagaaacaagcggaactaaaccccaccctctttacggaagcagcaagagcagacctaaaagacgtgctcctacaccaacgcgccctaaaaccagtaaaaccaggcagatgcaccttcatgcccgacgaggaacgagcaccactagcccttccaagcacccaacgcttccgcatgtaccaggaagtcaacaatctaagaatactacgggacggactaaaagaggaatcgttgaccctaaaccaacgagacgacctcatcgcagcgctggaagagaacaacaaacgcacattcacacaaatcaagaaactactcggtcttggaggggtcgtcaaattcaacttcgaagaccccaaacgcgaagaactgaaaggcaacaccacaagcgccattcttggcaaagacgaacatttcggttccgtttggttcaaattcgacgaagcaaaacaagacgcaatcgtaatgcagctattcaaagaagaaaacgaagcgaaattactacgctggctccaaaacgagaccgggatcgacgaaaaacgcgcggagaccatcgcaaacgtggggctcccagaaggctatggcagtctctgcgccctagcacttgcaaggattctgccagaactaaggcgcgatgtcgtcccatacagtgacgcagcgaaagccgcaggattccaccacagcgacacgagcaacaaccaggaagtgccaggtttaacattccccatagagcttgtcgtcacggaaaccggcgagataaaaaccaaacacatattccacgaactaccctactacggcgaatacttacaacggcacgtggggttcgggagcggcaaaccagaagactccgcggaaaagcggtacggaaaaatcgcgaacccaaccgtacacataggactgaaccaagtccgactcgtagtgaacaccctaatcaaacgctacgggcacccaagcgaagtcattgtagaagtagcaagagacctcaagcagagcaaagacctacgcgacgaggaggggaaacgccaggcagaaaatcagaaaagaaacaaacggatacgcacagctatagcaggagtactgcaaacaagtgaagaaagagtccgacgagacgacatcgaaaagatgatactgtgggaagaactgagcttcgacccagcagaccgacgctgcccctactcaggagtacaaatctccgcggcgatgctactatcagacgaagtcgaaatcgaacacatactaccattcagtcaaacactggacgacagcctgaacaacaaaacagtcgccttacgacaagcaaacagggtgaagggaaaccgcaccccgtgggaagcattcggcgctcaaagcacagcgggattcgactacgccacaatactcgcccgagcagagcacatgcccaaaggaaaacgataccgattcgcggaggacggataccaaagatggcttaaagacgacgccgggttcctaccaagagcactcaacgacaccagacatatgtcaaaggtagcacgggagtacatgtccctcatctgccccaacacccgagtaatccccggacgaatgaccgcgatgcttcgaggaaaattcggcctaaacgacgtcctcggattaaacggagagaagaaccgtaacgaccacagacaccatgcagtcgacgcctgcgttatagcggtcacggaccaaggactactacaacgcttcgcaaaagcctcagcctcggcccgcgaacagcaactgaacagattagtggagaacatgcccttaccctgggagagttaccgcgaacacgtcgaaagagcgatcgacgcgatttgggtaagccacaagccggaccactcacacgaaggagcaatgcacaacgacacagcatacggactcctcggcgacgggaaagtgtccattcacaaaatggtcgagggaaaaagagaaaggatcgaagagagcctcaaagtgatagcattcaccaacgcaaaggcaaacgacagacacggactgctagacaacggcgaacctcgcccatacaagggctacaaaggagacagcaactactgcatcgaaataatccgcaacgagaaaggcaaatgggaaggtgaagtcatctccacattcgacgcatatcagctagtccgcgaacacggggtagcacgtctccgccatcctacactgtctgtctccggaaagcccctcgtgatgagactaatgaaagacgagaccatacgtatggtaacgaacgaaaaaccaataacagcccgagtatgctgggtacgctccgacaccaggatcgcatttgccagcacaagcgaagcaaacgttgacgcacgcgacagagacaaaaacgactcattctcgtacatagtgaaaacagcgtcagtcctacaaaaactgcaagcgcgaagaatctcaatatcacctaccggagagctcagagacccgggattcaaagagtga

SEQ ID NO: 6091 - RNA, 3108 nt, synthetic construct
  misc_feature 1..3108: note = Cas9 variant
  source 1..3108: mol_type = other RNA
atggaacagctgaactatatcctcggattggatatagggatagcatcagtcggatgggcggtagtcgaaatcgaccacaacgaagacccaatccgtctcatcgacgtgggagtccggaccttcaacaaagcagaagtcgccaagacgggagaatcactgtccctaataagacgactcgcccgggggagccggcggctcgttcgacgcaagaaaatgagactgctgacagcaaaaagactcctcaaaagcgaggggatcctctccgacctggacttcaacaagggcgcaatactgaacctaccaaacaactgttgggagctgcgcgtaaagggcctggacaagaaactaagcgacaaagaatgggccgccgtactcctacacattataaaacaccgcggatacctatcgcaacggaagcacgaccgcaagaccgacgacaaggaactgggcgccctactctcgggagtgagcaagaaccactcactgctcgaagagggagagttccgtaccgccgccgaactcgccatcaacgtattttgcaacagcaaaggacacatacgaaaccagtggggcgattacagccacacattctcgcgactcgacctgcaaaaggaaatcaaacaactcttcgtctcacagcgcgaactcggaaacccctatacaagtagcagcttcgaagaaaatatcatcagcctccttatgaagcaaaaagaagcaataagcggaaacgacatactaaagatgctcggcaaatgtacctacgagaaaaacgaatacaaggccgccaaaaatacctactccgcagaaaggttcgtatggctaacaaagctgaacaatctgagaatagtcgacgacggagtcgaacgagcactcaactcatcggaaagaaagctgctcatcgacgagccctacaagaaagctaaactcacatacgcccaagtcagaaaaatactcgaactacccgactccgcggtatttaaaggcgttcgctacttcgcagacaacgccgaatcaagtacacttatggaaatgaaattctggcactccatcagaaaagccctggagagcaacaacctcaaggacgagtggctcgtcctcaaaaccaaaccggagttgctcgacgagataggcaccggattcagcatctacaaaaccgacgacgacattacctcatacctatcaaacaagctagacaagaaggtcttagacatcctattagtggaagtctccttcgacaagtttatagagctatcactaaagtgcttacgaaagatcatacccctaatggaaaaaggctatcgatacgacgaggcgtacaagtacatttacggcgaagtgaacattgagtacaacctaaacgacatcaagaatccagtcgtcctgagatcattcagccagagcagaaaagtaatcaacgccgtgatccgactctacggatcgcccgcacgcatacatatagagaccgcaagagacatcggcaagtcattcaaagagcgcaaggccatcgaaaaacaacaagagaaaaatcgactagaaaaggtccgcgccgcagaacacttcaagcaactcttccccaactacgtgggcgaaccgaaagccaaagacattctcaaggtaagactatatgagcaacaacagggcaagtgcctttactcgggcaagattctagacatcaagcgcttaatggaacacggctacgtggaaatcgaccacgcgctccccttcagccgcacgtgggacgactcattcaacaacaaggtcctagtactcgccaatgagaaccaaaacaaaggaaataaaaccccctatgaatggttcaatgggaaagacaactcagactcgtggaaacgattcctcgccctcgtaaataacagcggattctccgccgtcaaaaagcaacacatcctcatgaaggagatcgacgaagaggggttcaaacaacgaaacctcaacgacacgaggtacatcacccgctttctgtgcaactgggtagaaaacaacatacctctgcttggcaaaggtgtcaaaagagtgttcgcaccccaaggaaagataaccgcactactgcggagcaactggggcatacgcaaagtacgagaagacaacgaccgacaccacgccatagacgcaatcgtagtcgcctgcacaaccgtctcgatacaacaaagaattacaaactacgtgaagaacagcgaaatcaacagaaagattaaacggcagaactacctcaagttccccgagccctggaaattcttccgagaggatataagcatcagagtcttctccaacaacccaatcgaggaactcaagcaacaactctcggatcgaccagaagccaaccaccagttcgtgacgcctctgttcgtcagccgagcgcccgtacggaagatgacgggccaaggtcacgaggacacgatccgctccgccaagcgcatctccgaaggcatatcggtcctccgtgtcccattaacgaaactaaacgacaaatcgctagaactgatggtcaatcgagagagagaaaaagaactctatgacgcactcaaacaaagactactagagttcaaaaacgaccccgaaaaggccttcgcagaaccgttttacaagaaaggaggacagcaagtcaaaacagtccgaatagaaagggtacagaaaaacggtgtcctagtgaacaacaacaccggcatcgcagacaacgggaacatagtacgagtcgacgtattcctgaagaagaagaaatacttcctggtacccatttacagctggcaagtcgccaaaggcatcctccccaacaaagcgatcgtagcccacaaaaacgaatgcgactgggccgacatggacggctccgcccaattcctctttagcctatacacaaacgacctcatagaagtcgtcctcaaagattcaaccatcctcggctacttctcctcaatcgacagagccaccgcagccctaattatcaaagagcccgatatggagaaatcgaaaggcaaagagggaatccacagagtcggtgtaaaaacggcacgcagcttcattaaatacaacgttgacgtactcggcaaaaacatcagcagatgtcgcaaagccaaacgactgcccgtccgctga

SEQ ID NO: 6092 - RNA, 3111 nt, synthetic construct
  misc_feature 1..3111: note = Cas9 variant
  source 1..3111: mol_type = other RNA
atgagaatcttcggcttcgacatcgggatcacatcgatcgggtgggcctacgtcgagtctaacgaactaaaggactgcggcgtacgcatattcaccaaggcagaaaaccccaaaaacggcaaatccctcgccctaccacgacgagaggcccgcggggcacgacgccgactggccaggcgcaaggcccgcttgaacgctatcaaacgactactatgcaaggagttcgggctcaacgtcagtgactacttcgcaaacgacggggaactaccaaaagcgtacgaaacaacgaaggacacaaaaagcccatacgaactgcgtagcctagctctcgaacaaaaactcgagccgaaagagctagcacgcgtaatactccatatcgcaaaacaccgcggctacggaaacaaacacgcgaaaacgggcagcgacaaggactccggcaaggtcctctcagccataaaggtcaacgaaacagcgatgaaagacaaataccaaagcgtcggggagtatctctacaaagagttctaccagaaactccgcctcgaaagcgagaagaaaggcaacaatataaccaaagagttcaaaaacgtccgcaacaaaggagaaaactacgaacattgcgtcgcccaagaacaggtccgtgctgaactggaactaatcttcgcgaaacaaaaggacttcggcgcaacgttctcagaaaacttcgaatcacaaataatcgaaaccgcattctaccaacgagacctcaagagctttgaagataaggtcggcaagtgcgtcttctacgaaaacgaaaacagggccccaaaagactcactctcagccatggaatttgtagccctcacgcgcataataaacaccctgaaaaacctcgaggaaaaatccaaaaacctaggtatcggcgaggtctacgggaaggacaagatccaagaaatcctcaaaatagtcctcgacaaaggcgaaatgagctacaagaaactacgcgagatactccacttagacgaacacattctcttcgccaaagactcaaaactggactacacacagggagtgcaagaggccgagaaagcaaagttcattgagctgaaaaacctcaaggcattcaagaaagccatgggcggcgacttcagtaacttcgcaagagaggaactagacaagatagccaccgacatcaccctggtaaaaagcaaagaaaacctggccaaaaagctccaaaactacagtgccttgtcgaaagaacaggtagaagccctcagcaacctaagttttgcaaaacacatcgacctctctctgaaagcgctcgaacaaatcctacccttcatgcgaggcgacaaaaccggcaagtgcctgcgatatgacgaggcagtaaagaaagccgaactccaagaacaccgaaaacacaaacagaaaggcgagttcctaatcccactaaaagactacgaaccgtacctcgcgaaccccgtagtcgcaagggcgctctcagagtaccggaaagtactcaacgccctactgcggaaatacggcaaagtccacaaaatacacttggagtttacccgcgaagcaaaacttagcgcaaaggaacggcaaaagtacgaaaaagaacagaaagagcacttcgaagctaaccaacgcgccattcagcaatgcgaaatcctagggctaccgatcaacggtaccaacatcctaaagatgaaactctggctcgaacaaggcgaatgctgcgcatactccggagagaaaatcacccgagaacacctcctcgacagcaacgcgctccaggtcgaccacatatacccctactccagaagtttcgatgacagctacatgaacaaggtgctcgtcttcgcaaaagaaaaccaagataaaggcaacaaaaccccatttgaagcattcggaggcgacaaagagaagtgggaccgaatcctgagtctgtcggccaaacttccgaaacaaaagcaacgccgcatctcaaacacaaacttcaaggacaaagagggcggattcctcgcacgaaacctcaacgacacaggatacatagcaaaattggccagccagtggaccaaagattgcctcgagttcgaggacctaagggaaaacgaggtcacgatagcaggcgagaaaggaagctcagtacatattgaggtggtttcagggcagcttaccagcatgctgcggcactactggggcctcggaaacaaggaccggaacaaccatctccaccacgcagtcgacgcagtcatactggcgtacacaaacaacgccatgataaaggcgttcgctaatttccgcaagaaccaagaagaaaacaaaaagaaattctacgccaaacaaatcgccgagtccgaatacaaagcaaagaaagcctttttcgaaccctgcaaaaacttccgccagcgagtcgaagagaaaataaaagagatcttcgtcagcaaacccccacgcaaacgggtaagaggcgcactccatcaggaaacgttttacccgttcgagaaactatgcaacgacaaggagtactcagaaaaactcaaaatggactacgggggcgagaagggcatgcagaaagctatcgccctaggaaaaataaggcagatcggaacaaaaatagtaagcaacggtgccatggtgcgcgtagacatcttcaaggacaagaaagggaaattctacgcagtacctatatatactatggactttgcactcggaatcctccccaacaaagcggtggcgatagggaaagacaaggacggtgtaataaaggactggatagaaatggactcgaactacgatttctgtttcagcctattcaaagacgacctcatcctggtacagaaaaaggaaatggaacgggcggaactatgctatttcgtcagcttcggcagtaccaacgcacaaatcaacgtagagaaacacaacaacaaatttgaagggctatccgaaaacgaaaagatactctacagcaacgccacgcaaaaagaggtcgccggcaagagcatcggaatacaaaacctaaagacattcgaaaagtaccaagtcagcccgctaggagaagtccaaaaagccgagttcgaaccccaccaagaaataaaactaaagagcagccccaagagaaaagattga

SEQ ID NO: 6093 - RNA, 3111 nt, synthetic construct
  misc_feature 1..3111: note = Cas9 variant
  source 1..3111: mol_type = other RNA
atgctccacaaaatgcactatagattggccctcgacctaggctccacaagcctaggatgggcgatgatacgcctcgacgccgacaaccaaccctgcgcagttatcaaagcaggagtccgcatcttctccaacggacgcaaccccaaagacggctcaagcctcgcagtaacccgaagagaggcaagagcaatgaggcgccgacgagaccgacttctcaaaagaaaagcgagaatgatgcgcacgctcattgaatacggattcttccccgccgaagcagcgcaacgtaaagcactagagaccattaaccccttcgcactccgcgccaaaggactagacgaggcgctcaccccagccgagttcggccgagccctcttccacataaaccaacgaagagggttcaaaagcaaccgtaagaccgacaagaaagacaacgactcaggagcactaaaaaccgcaatcggcaaagtaagagccacaatagaagcagaaggctgcagaaccgttggagaatggctccacaaacgcgacgtcgcaggactgaccgtaagagcccgctaccaccaagataaggtcatcaaagaagacggcaaaacaaagatcgacaaatactacgacttgtacattgaccgggcgatgatcgaacaagagttcgacgaactctggaagaaacaggcagaactcaacccagccctattcaccgaagcggcacgcgcggacctcaaagacgtgctcctacaccaacgcccactaaaacctgtgaaaagcggtcgatgcacattcatgcccgacgaagaacgagccccactcgcactaccatcaacccagcgcttccgcatgtaccaggaagtgaataacctacgcatactaagagacggcctcaaagaagaaccactcaccctcaaacaaagagacgacctcatcgcggccctggagaaaaatagcaaacacagcttcacgcaaataaaaaccctactaggcgttgggggcgcagtccaattcaatttcgaagacctcaaaagacaagaactcaaaggtaacaccacatccgcgatcctcagcaacgacaaacacttcggcaaagcctggtttaccttcgacgaagccaaacaagacgccatcgtcctccaactggtaaaagaagaaaacgaggcaaaactcgtaagatggctacaagacgaaaccggcatcgatgagaagcgcgcggaagctatagcgaacgtcggcctcccggaaggatacggctcactctgcgcaaaagcactcgcgagaatactgccggagctacgccgcgacgtcatgacatacgacaaagcggtacaagcggcaggattcgagcatcactcgcgcctaggatcgaataccgaaataccgggcctaaccttcaaaatcgaatccatagaccaagattcaggagaagtgaagcaattccacatccacaaagtactcccatactacggcgaatatctccagagacacgtaggatttggtagcggcgagcccgaggaccccgcagaaaagagatacggcaagatcgcaaacccgacagtccacatcggtctgaaccaaatacggctagttgtcaacgccctgctcaaacgatacggacacccatccgaagtaatcgttgagctcgcccgggacctgaaacagtcaaaggaccaacgcgacgaagaatcaaaacgacaagccgaaaaccagaaacgcaacaaacgcctaagagacgccattgcagggaccctcaaaatctcagaggaacgagtaaggagggacgacatacaaaagatgattctatgggaggaactcagcttcgacccggccgacaggaggtgcccctactctggagcgcaaatatccgcgaccatgctcctaagcgacgaagtcgaagtcgaacatatcctaccgttcagccaaaccctggacgacagcttaaacaacaaaacagtagccctcagacaagcgaaccgcatcaaaggcaatcgaaccccgtgggacgcattcggcgcacaggcagtagcaggattcgactacgaaagcatacttgtccgagcagaaggaatgccaaaagcaaagagataccgcttcgcagaaaatggataccaacgctggctaaaagatgacgcgagcttcttagcacgcgcgctcaacgacacacggcacatgagcaaagtggccttcgaatacctcaagctgatctgtccaaacacccgcgtcataccagggcgcatgacagcaatgctcagagctaagttcggactcaatgacgtattaggcctcaatggcgagaaaaaccgcaacgaccaccgccaccacgcggtagacgcatgcgtcatcgccgtcaccgaccaaggactactgcagcgattcgcaaaagcctcagcaagcgcacgtgaacaacaactaaacagattagtggaaaacatgcccctcccatggggatcctacagagaacacgtccaacgagccattaacgcaatatggataagccacaaacccgaccacagccacgaaggagccatgcacaacgacacggcatatggactacgaggtgacggcaaagtctccttccacaaaatggtcgaaggagtacgaactcactccgaagacaacctaaaagtcatcgagatcagcaacgccaaagcaacggaccgacacggcctactccccaatggcgaaccacgcccatacaaaggatacaaaggggactctaattactgcatcgaaatagtcagaaacgagaaaggaaaatgggaaggcgaagtcataagcacattcgaggcataccaactggtcagagaacacggaatagcccgtcttagacacagcacgctcagcgtcagcggaaaactcttagtcatgcgactcatgatagacgacgtcgtccgactaatcatcgacgaacagacaagaaccatgcgaatagcgaccctgtccgggaacggccaaatcttcatggccgacacgagcgaagcaaacgtcgacgcgaggaaccggtcgaaagaggaaaccttcgcctacgtgagcaaaatggcagggtcactccaaaaggccaacgcgcgaaggatcaacatatcaccgataggagaactgcgggaccccggattcaaggaatga

SEQ ID NO: 6094 - RNA, 3114 nt, synthetic construct
  misc_feature 1..3114: note = Cas9 variant
  source 1..3114: mol_type = other RNA
atggaacgaatcttcgggttcgatataggaaccaccagcatagggttcagcgtgatagactacagctcaacacaatccgcaggaaatatccaaagactaggagtgcgaatattccccgaagcaagagacccggacggaacacccctgaaccaacaaagacggcaaaaacgaatgatgaggagacagctccgacgccgacgaataaggaggaaagccctgaacgaaacgctccacgaagcgggatttctacccgcctatggaagcgccgactggccagtcgtgatggccgacgaaccctatgagctccggagaagggggctagaggaaggcctctcggcctacgaatttggcagagccatctaccatctagcccaacacagacacttcaaaggcagggagctcgaagagtcggatacacctgacccagacgtagacgacgaaaaagaagcagcaaacgagcgcgcggccacactcaaggcgctcaaaaacgaacaaacaaccctaggagcctggctcgcccgaagaccacccagcgaccgaaaacgaggaatacacgcacaccgaaacgtggtcgctgaagagttcgagcggctatgggaagtacaaagtaaattccacccggcactaaaaagtgaggaaatgagagcaagaatttccgacacaatattcgcccaacggcccgtattctggaggaaaaacactctcggcgagtgccgatttatgcccggagagccactctgcccaaaaggaagctggctaagccaacaaagaagaatgctagaaaagctaaacaacctagccatagcagggggcaacgcccgcccgctggacgcagaagaaagggacgcgatcctatcaaagctccaacaacaagccagcatgtcgtggccaggcgtccgatccgcactaaaagcactttacaaacaacgcggagagccaggagccgagaaaagtttgaaattcaacctagagctgggaggcgaatccaaattactcggcaacgcactcgaagcaaaactagcagacatgttcggccccgattggccagcacaccccagaaaacaggagatccgacacgcagtacacgaaaggctatgggccgcagactacggagagacaccggacaagaaaagagtaataatactctccgaaaaagaccgcaaagcgcaccgcgaagcagcagctaacagcttcgtagccgacttcggcatcacgggagaacaagccgcgcaactccaagcactcaagctacccacgggatgggaaccatattccatcccagcactaaacttattcctagccgaactcgaaaaaggggaaagattcggcgcccttgtaaacgggccagattgggaagggtggcgccgcacaaacttcccacacaggaaccagcccactggcgagatattagacaagttaccaagccccgcctcgaaagaagaaagagaaaggataagtcaattacgaaaccccacagtggtgcgcacccagaacgagttaaggaaagtcgtgaacaacctgataggcctgtatggcaaaccagacagaatccggatagaggtaggcagagacgtaggcaaatcgaaaagggaacgagaagaaatacaatcaggaataagacgcaacgaaaaacaacggaagaaagcgacagaagacctaatcaaaaatggaatagcaaacccaagcagagacgacgtcgaaaaatggatcctctggaaggaaggacaagaaagatgcccatacaccggggaccaaataggattcaacgccctcttccgcgaaggaagatacgaagtcgaacacatctggcctagaagtcggtcattcgacaacagcccacgaaacaaaacactctgccgaaaggacgtaaacatcgagaaaggcaaccgcatgccattcgaggcgttcggccacgacgaagaccgatggtctgccatacaaatacgactacaaggaatggtatcggcaaaaggaggaacaggcatgtcacctggcaaagtcaagcgatttctagctaaaacgatgcccgaagatttcgccgcaagacagctaaacgacacccggtacgcagcaaagcaaatactcgcacaactaaaacgcctatggccagacatgggtccagaagccccggtaaaagtggaggcggtaaccggccaagtaacggcgcagctgcgcaaactatggacactcaacaacatactagcagacgacggagagaagacacgcgcagaccaccggcaccacgccatagacgccctcaccgtagcatgtacccaccccggaatgaccaacaaactcagccgctactggcaacttagagacgatccaagggccgaaaaaccagccctgacgcccccatgggacaccatccgagcagacgcggaaaaggccgtcagtgaaatagtcgtgagccaccgcgtcagaaagaaagtcagcggacccctacataaagaaacaacctacggggacaccggaacggacataaaaaccaaatccggaacataccggcagtttgtaacgcgcaagaaaatcgagagcctctcaaaaggcgaactagacgagatcagggacccaagaataaaagaaatagtcgcagcccacgtagcaggtcgcggaggagaccccaagaaagcattcccaccctacccttgcgtgagtccgggaggaccagaaatccgaaaagtacgactaacgagcaaacaacaactaaacctaatggcccagacaggtaacggatacgccgacctcggaagcaatcaccacatcgcgatatacagactgcccgacggcaaagccgacttcgaaatagtatccctattcgatgctagccgccggctcgcgcaaagaaatccgatagtgcaaagaacacgagcagacggagcaagtttcgtaatgagcctagccgcaggcgaagctataatgataccagagggaagcaagaaaggaatctggatagtacaaggggtatgggcatcaggacaagtggtcctagaaagagacacagacgccgaccacagcacaaccacaaggccgatgccaaacccaattcttaaagacgacgcgaagaaagtcagcatcgaccccatcggacgcgttcgaccatcaaacgattga

SEQ ID NO: 6095 - RNA, 3117 nt, synthetic construct
  misc_feature 1..3117: note = Cas9 variant
  source 1..3117: mol_type = other RNA
atggccaagcaagttaggtacagactcagcctcgacctaggcagcacatccctaggctgggccatatttcgactagacgccgacgcgcacccaacagctataatcaaagcaggagtcagaatattctctgatgggcggaacgcaaaagatggatcaagcctagccgtgaccagacgcgccgcccgcagtatgagaagaagaagagacagactactacgaaggaaaacccgaatgttagacgcactgctagaatatggattcttccctcaagacgcagcccagcgcaaagcgctagaacgcctcaacccctacgcactgagagccgaaggactagcccgcccactaacgcccggagagttcgcaagagctatcttccatctgaaccaaagaagaggattcaaaagcaatcgcaaaacagacaaaaacgacaatgactcaggagcgctcaagaccgcaacaagccaactccgccaagacatacaagcaagcggctgccgaacagtcggcgaatggctttggactcaacgactccagaagaaaccagagggagtaccacaccaaggcgtacgagcgcggtaccgcgaaacgccacacataaacagcgaagggaagaaaagaatagagaagaaatacgacctctacatagaccgatccatgatagaggcggagttcgacgccctgtggagtgcccaagcgaccttcaaccccgtagtcttccatgcaacagcacacgaaaaactaaaagacatcctgctctaccagcgcccattacgacccgtgaaacccggaagatgcaccctcctgcccgaggaggaacgagccccactagctctaccctcgacacaaagattccgtatataccaggaactaaacaacctccgactgctagtggatcaactaaacgaacagccactcaccctcgcccaacgagacacaatcgccacactaatggagggcagagccaagatcagcttcgaccagattagaaaagcactcaaattaggatcaatgaccaaatttaatctcgaggacgataagcggaatgagctcaagggcaacgcgacaggcagccaacttgccaagaaggaatttttcgggcccgcatggcaccaattcgacgaagcactccaagacgacatagtctggcacctactatcagaggagaacgagagcgcactcatatcttggctccaagacaggacaggcatagacgctgcgactgcacaagccgtcagcaacgctagcctaccagaaggctacggatcgctatcccgcaaagccctcgaggtaatacttccccgactaagaagcgaagtaatcacctacgacaaagcagtacaagccgctggattctcacaccacagccaactgggcttcgaatacgaccccgacgacgtagaagactggatagaccacgcgacaggtgaagtgaaaccaatattcaaaagacttccttattacggaaaggcgctccaacgccacgttgcattcggatcaggtaaacccgaagattcacaggagaaaagatacggcaaaatcgcaaacccgaccgtgcatatcggactcaaccaagtaagggtcgtagccaacgccctcatagcgcgttacgggcggccaaccgaaatcatcatagaacttgcacgagacctcaaacaaagcagagaacaacgacaacaggaccaacggcgacaggcggacaatcagaaacggaacgcccggatacgcaatagcatagcccaggccttgggcatcgcagaggccagagtcagacgcgaagacatccaaaaatggatcctatgggaagaactggacccgggagacgccatgcacaggtgttgcccttacagcggagtaccaatctcggcgtccatgctactatcagaacaagtcgagatcgagcatatcctacccttcagcatgaccctagacgactctctgaacaaccgcaccgtaagcctaaggcaagcgaaccggatcaagcgaaaccgctcaccgtgggacgcacgtgaagacttcgaagcacaggggtggcactacgacggaatcctacagcgcgccgggctgatgcccgtccaaaagagatacagattcgcagcagacggctaccaaagatggctcagggacgaccaagacttcctcgcacgagcactcaacgacacacggtacctaagcagaatagccgccgaatatctacgcctagtctgtccccaaggaaccagagtcataccaggacagctgacagccctactgcgtcgacgattcggactaaacgacatcctaggactcgaaggagagaaaaaccgaaacgaccacagacaccacgcagtagacgcgtgcgttatcggaatcacagaccacggcctaatgcaacgattcgcacgcgcaagcgcccaagccagagaacagggcctaacacggctcgccgaagaaatgccgctcccgtggccgacctaccgagaccatgtcgatagagcggtgtcactaatctgggtaagccacaagcccgaccatggacacgaaggagcaatgatggaagagacagcatacgggctcatgaaagacggcaccattagacaacgccacaaagccgacggcacaaaaggccgagaagtagcaaacgtaatccgaatcgctgaacccgcacaacctacgcgccacggcgtggacgaccaaggacgacccctgccgtacaagggatacataggaggctcgaactactgcatagaaatcacacgcggagcacaggggaaatgggaggggacggtaatcagcaccagcgacgcatacgggatcgtcagggcacgcggaatcgctggtctgagaaacacctcacaaggccaaaacggacacccgctagttatgcgattagtcataggagacagtctacggctacgtataaacgacgcactgcaaacaatgcgagtaaccaaaataagcggcaacggacaagtattcatggccggcgtccatgaagcaaacgtagacgcaagaaaccgggataaatcgcaagcgttcgcgctagtgagcaaaatggcgggatcactccaagcagcacaagcacgacaggccaccattagcccaataggagaaatacgcgacccagggtttccggggtga

SEQ ID NO: 6096 - RNA, 3120 nt, synthetic construct
  misc_feature 1..3120: note = Cas9 variant
  source 1..3120: mol_type = other RNA
atgaagaaaagaatcctaggccttgacatcggcatcgcctccgtcggctgggccctaattgagttcgacgacgagttccaagacaacaagaagaaaggtacaatcattaaatccggcgtacgaatcttcaccagagcagaaaccccaaaagaacgcgaaccacttgccaaaccccgccgagaggcacgctcccaacgccgccgcataagctgccgcgtcgaacgccttaactttgtgagagaactcttcgtcaaaaacggcctagtcgcaaaagaatccgtcaataaaaacaacccgaacaacatctacataacactaaaccaaatcaaaaccccctggcaactaagaatggaagcactggaccgcaaactaacgaacgaagagttcgccgtggtcctaacccaccttgcaaagcacaggggatataagtcgctccgcaaaacggactccaaagacaataagacgggagaaatgctcaaggccataaatcagaacaaagaacgcctggacaacagcgactaccgcacactcggcgagatgttctgcaaacacgaatcctacaaggaacataaacggaacaaagacggcgaatacatcaactccgtcacccgcgaactaatagaagaggaggccgagaaaatcttcgctaagcaacgcaaggaaggcaacaactttgccgacgtggacatagaacgagaatacctaaaaatcgcattttcacaaaaacctaccggaagcataaacaaaatggtcggcttttgcaccttcgaaaacggggagaagcgggcaccccgagactcatatagcgctgaactgttcaaagtcttaaacacgataaacaacacaaccataacggacatgaaaacaggagaaacgcgaaacttcacaggcgcggaaatcaagaaaataatagagatcatcaaagacacgaaaggaatcacatacgtaaaaataaagaaagaactcaaactagggtcatcgcagttctccggggtcgactaccgggagaacgcaaaatctaaaggagagggcgagatcttcgtcagcatgaagacgtaccacgagatcaagtccaaaatagaaaaactcagcaaagaaaagtggaataaactcaaggaaaacaccgaactcctcgatagcatcgtcaacataatcgcaaacttcaaggacgacgaaagcatcaagaaagagttccaaaaactcaaaatcgacgaagatatcatcgacgtcctgctcaacttcgagttcaagaaattcatcaacctctcgttcaaagccctgcgaaaaataatccctttccagttccaaggccagaaatacatcactgcatcgatgtcagtcggctactcattgaaacaagaaggcatcaaaaacaaattcctccgcgtcccgagccaggaagaaaacgtgaacgtgccggtcgtcgccagggccttcgcacagacgcgaaaagtcataaacgcagtcatacgagaatacggacaattcgatcagataaacatagagctcgcgaccgacctcaaaaacagcaaattcgaccgcagcaaaatcgagaaagggcaaaaagagttccagtcgcaaaaagacaaagtctttcaggaagtacaagaccttacaggggaaatcatcccttcgtcgtcgctactactcaaatacaggctatggcgcgaacaggacgaaaggtgcatatactcagggcgcaaaatctcaagaaaggaccttctggacacgggcttcttggacatcgaccacataatcccctactcgaagtcgatggacgacggattcaacaacaaagtactatgcctagcagaagaaaaccgcaacaaaaagaacgatatcccgttcaactactaccagcgaataggccgcgactggaactttctcattagcatcatcgccagtatgaaaaacatgaagtacgtcaagaagaaaagacttctcaaacaggaactcagtgacatcgaaatagaatccttcattgaaagaaacatcaacgacacccgctacgccacaaggtatatcaaaaacttccttgaaaacaacctcgagttcaaggaaaacgagttcataaaggcaaaagtgcaggcaagacacgggggtctaaccagcgtactccgctacaactggggtatcagcaaaaaccgtgaagaatcctacctacaccacgccaaagacgctataaccgtagcctgctcaacccaggggatggtccaatacatctccaacatatcacaaaaatacgaaaacggaaaatacaaaatgaaacaaatcaaagaacgcaccgaaaatcggataccgaaaccatgggattcgttcaaggacgacgtggaacgatccatcaacgatatcttcgtgagcttcgcaccccgacacaaggtcaccggatctgcccacaaagaaaccatctacagcaagaaacacctcgaaaaaggatatgtaaccataaagaaaagcctcgacaaaatcaaactgtccgacctcaaaaacattccatgcgatgaaaactgcgacataattcgagtcctcaaagaacgcctcgaaaaattcaacgacgactccctcaaagccttcgctgacccagttcacatgccaactaaatgctccaacaaaaagggccccatcatccgcagcgttaaaataaaagagaacaacaaaacaggtatcgaagtccggaagggactcgtagagcgaggcgacatggtacgcgtggacgtctttatcaaagacaagaagtactacctagtacccatctacgtgagcgactttaagaacaaagacctgcccaacaaagcaatcgtcagcagcaagtcggaaaacgaatggataatgatcgacaaaacgtacagctttaagttcagcctcttcaaagatgacttaatcaaaatcaaaaacaagaaaggcgagatattcggctacctaggaggggtccatcggctaacaggcgggatcaatatcaaatcctgttacaaacccaaagagaaagacggaaacataggcagcaaatgtctgctcgactttcggaaatttcaggtgggaatcctcggcgactacaacgaggtaaagcacgaaaaacggatgccagcctacataaacaccaagaaggacaaggaacactga

SEQ ID NO: 6097 - RNA, 3123 nt, synthetic construct
  misc_feature 1..3123: note = Cas9 variant
  source 1..3123: mol_type = other RNA
atggaccggcgcgatgcgagagcaatgaggcgccgacgggaccgcttccaacaaagacagagagccctactaaaatatctagtcgccgacggactattccccgaagacgaaggcgagagaaaagccctcgcagccctggacccatacgccctcagggcaagggccctagatgaagccctaagcctacacgagctcggccgcgccttattccacctcaaccaaagacgcggattcaaaagcaacagaaaggccgaccgcaaggcagacgacgacgcaggaaaaatagcgatcggcgttgacagagcccgtgaggcaatggccgaaaacggagcacgaacgtacggagaatggctccacagacgcagagccagcgcgaccgacgcaaacgcaatcccacccgtgagaacccgattacgaccggagagtggagaagacgcaaaaggagacggatacgatttctaccccggaagagacctactagaagaggagttcgccgccatatgggaggcgcaagccgcacatcaccccgacgtgctgaccgacgacgtgtatgagcgcctcttcgaaatagtcttctatcaacgcccgcttaaagccccacagatcggaatgtgcaccctcatcgcaggcgatcgcagactacccaaagcacacccactcttccaacgccgacgactgctagaagaactaaacgcactaatgatagtaaggccgggagaagtcgcacagagactaacacgggaagaaagggacacactcttcttaaaactgaaagaccgaaacaaagtatcattcgaaagcctaaggaagacgctcaaactcgatccagacgcacgattcaacaaggaatccgagaacagaaccgaactgaagggcgacgaggtagcagcagcgatgggcagtaagacaagattcggaaacagatgggtccacttaagcatcgaggaacagtgggcagtgatcgaacggctaggagatgtcgaaagtgatgcagaagacgcagcattcagggcttggctcgcagaacgctatgagcttacaccagagcaaacaagggcagtaacaaatgcacccctaccacagggctacggcagattcggagaaaccgcgacaaggaaactcatagatgcgctccgagatggcgaaaaagacggacgagtcctggtgtacagcgaagccgtaaccgcagcaggtctcggccaccactcggacagacgcaccggagaagtattcgaagacgaagagggccgcccacaacttccctactacggagtcgcacttgagagacacataatgcccggcacaggagacccaagcgactcggacgaaatgagagtaggcagattaacaaatccgacagtccacatcggactgaaccaactcaggcgcatagtaaacagactgataagagcatacggaccgcccgcagaaatcgcaatagaactcgcaagggagctaaaactaacagacgaggacaaaaagcggatcaacaaggagaacaacagcaacagacttgacgcagaaagacgtagcgaaaaactcctagccataggcaaaccggacacaggagcgaacagagcactcctaaaactatgggaagaattaaacccagcaaacgtactggacagacgttgcatatactcaggagtacaaataagcatcgacatgctatttagcgcagcagtcgaagtagaccatatactgccattcacagccacattagatgacagcaacgggaacaaaatagtctgcacgcgtgaagccaaccgggaaaagcgtaagcgcagcccgtacgaggcctggggacatagcgccagatgggaagaaatcgcggctcgtgcagcccagctaccacgaaacaaacgatggagattcgaaccagacgccatggaaaagttcaaagatgacggcggattccaagccaggcacctcatagacacccaatacctagcgagattaagccgggaatacctagcaaccctctaccccgacaaaggcgaaggaagcggacacatatgggtgtcgccaggcagactaacggaaatggtacgacgcaaactagggctcaacgacctactgcccgaccacaacttcggcggaggggcagaccaggcgaaaaaccgcctcgaccaccggcatcacgcaatagacgcagtcgtcgtcgccatagtcgaccgaggcatgcttaacagaatagcaagggcttcaggacaagagggagctgaaggaagagaacgaataataataccggaaccatgggaaggcttcagagacgacttaagaaccgcagtcaacgctataacggtcagccacaggacagaccacggcaccgcgagcaaagcaggactgccaaaaggcaaggacgcgactgccggacgattacacaacgacaccgcctacggcttcaccggggaaagcgacgctaaaggaaactcgatagtagtgagaagagtgcccctcagctcgttcaagaaactagccgacatcgatcgggtgcgagaccccgagctaaaagcggcactgtaccagcacctcgacggattagagggcaaagcattcgaaaaagcaatcggcgaatttggctcaagggaatggcacccgtatggcggggttcgcagagtaagggttacggaaccacttagcgtgatcccaataagagaccggaacgggcacatctacaaaggatacaaaggagactccaactaccgctacgacgtatgggaactccctggagggaagtgggtaaacgaagtagtaagcatgttcgacgcacatcaaccagggtggcagagcgcaatacgagctgcaaacccaaccgcacgaaaagtacttagcttgcacagggacgacgtcctagccatagaacgaaacggggccgaaagggagctcgtacgggtggtaaaattcagcgagaagcaattcgcagtagcaccgcccaacgaaggaggcgcactgaaagcccgagacgcagacaaaggggatccattcaaatactcatacccaagtcccaacaccctcaaagccctacgagccaggcaggtacggatagacgaactagggcgagtgcttgacccaggatttcccgcccggacaaaacaacgaaaaacgagaaaaccaaactga

SEQ ID NO: 6098 - RNA, 3132 nt, synthetic construct
  misc_feature 1..3132: note = Cas9 variant
  source 1..3132: mol_type = other RNA
atgcaaagagacaaccctctggtgtaccgtctagcactcgacctcggcagcaccagcctgggctgggcagtcttccgactagacgcagaaggaagcccgctcgcgataataaaagctggcgcacgtatattctcagacggccgaaaccccaaagacgggagctcactagcagtcacgcgcagggcagcccgcgcaatgcgacgccgacgcgaccgcctactcaaacgaaaagctagaatgctaggcgcactcgaaaggcacggctttttccctcaagacgaaagcgctaggaaagtactagaaacactcaaccccttcttactgcgggcccagggcttagaagtcgctctaaaaccagaagagttcggacgagccctcttccacctgaaccaacgaagaggcttccaatccaaccggaaaacggatagaaaagactctgacagtggagcgctgaaacaagccatcgggacgctaagagcccaaatgcacgaatcgggctgccgaaccgtgggcgaatggttttggaaagtcaggatggaacataaaccagaaggtgtgaaaggccaaggagtccgagcccggtacagagaaaccccgtttacgacagacgaaggcaaaaagcgaatcgacaagagatatgacttatacgtcgaccgggcaatggtggcccaagaatttgatgccctctgggctgcccaagccgcatttaaccccgcactctttaacgaagccgcaagagcggaactgcgagacatcttgctccaccaaaggaaactacgaccagtacaacccggacgctgcaccctagtacccgaagaacccagggccttgctagccctgagctccacgcaacggttcaggatctaccaagaagtaaaccatctgcgagtactacacgacgaactcagggaagaaaccctgaccttggcgcaacgcgaccaaatagtcgccctcctggaaaaacaagccaaagtaacattcaccgcaatgagaaaagcactcgggttctcggccttattcaacctcgaggatgccaaaagggacggacttaagggaaacgcaacagcagcggcactaagcaagaaagacctgttcggcccgctttgggccggcttcggcacggcgctccaggacgagattgtcacccaactaatgaccgaggaaagcgaaccacgcttaatcgcctggctgcaagaacacacaggagtagacgaggcgagagcccaagccatcgccaataccgggcttcccgaaggatacggcagcctggggagaacagcgctcgcgagaattgtcccagaactacaacgggacgtaataacttacgataaagcggtgcaggccgcaggattcgcacaccatagcgacctgggattctccttcgagcacggcgccgacgaagtcgagcgtataggcgaacgaacgatcgccagcacaggagagatcaaaccagtgttcgcattcaagcaattaccctactacgggcgagcgctccaacgtcacgtggcattcgcaaaagacaacccacgaaacgacgaagaacgatacgggaaaatagcaaaccccaccgtacacatagggctaaaccaagtacgagtcgtagtaaacgcactaatgagaaggtacgggcgaccagcagaagtcgtcatagaactagctagagatctgaaacagtcacgcgaacagaaacttgaagcccaacaaagacaagcggacaaccaaaagcgaaacgcaagaatcagaagatcgatagccgaagtgctcggaatctccgaagaaagggtcagaacattagacatacaaaagtggatcctatgggaagaactgagccatgatgctgccgaccgaaggtgcccgtactcgggcgtacagataagcgcaagcatgctcctgggcgagagagtagaaatagaacacattctcccgttctcaatgacactagacgacagcctgaacaaccggaccgtagcactcagggaggcaaacagaatcaaaagaaacagagcaccatgggaagcgcgagcggacttcgaagctcaagggtggtcctacgacggcatactccagcgagcagaaaggatgccactacgaaaaagataccgattcgcccccgatggatacgaacgttggctaggtgaggataaagacttcctcgcacgagcactcaacgatacaagatacctaagtagagtggccgctgaatatctaagactcgtgtgtcccggatccgccacaagggtgatcccaggtcagatgacagcactactacgggggaaattcgggctaaacgacgtactgggcctagacggtgagaaaaaccgaaacgaccaccgccatcacgcagtcgacgcatgcgtcataggtgtgaccgaccaaagaatgatgcagcggttcgcgcaagcaaacgcacaggcacgcgaagacggactcacgcggttagtcgaagacatgccactaccctggccaacgtatagagaccatgtcgaacgcgccgtacaccacatatgggtcagccataaaccggaccacggcttcgaaggggccatgatggaggaaacgagctacggcatactcagggacggcagcatcaaacaacgccgcaaagcagacggaagcgcaggcagagaaataagcaacctaatccgaatagccgaaccaggccaaccacaacgccacggcgtcgatgcagaaggaagaccactaccctacaaagggtacgtgggaggaagcaactactgcattgaaattacagtcaacgacaagggaaaatgggaaggccaggtaatcagcacttttgacgcctaccgtatagtccgtgagggcggactgagacaactcagacacccgacacaaggacaaaacggccgagcactcgctatgcgcctggtcatcggtgactcagtcagactggaggcaggggaaggaagcctgcaaacgttaagagtcgcgaagatgagcgcagccgggcaagtattcatgtcagaagtaaaccaagcaaacgtggacgcacgcaaccgaaacggagacctgccatacgtctccaaaatggcaggaagtttccaaaaagcaagagcgagacaagtgaccataagccctataggagaactgagggacccaggattcaaaggatga

SEQ ID NO: 6099 - RNA, 3135 nt, synthetic construct
  misc_feature 1..3135: note = Cas9 variant
  source 1..3135: mol_type = other RNA
atgaaatacaccctcggactagacctgggatacaactctataggatgggcgatattagaaaacgacgaaaatgggagcccgataaaactcttcaacgcgggagtacacatcttcgaaccgtcaatcgaagacatcgaaatcgacggcaaaggaaaaaccaaaaacgtcaaacgccgcgaagcccgcctacgccgccgccagctattccgcaaaacgaaacgcctcgaaaaactacttaacttcttcatccaagaaggattcttccaaaaccaaaaagtcctcataaacgacccgttcgaacgcgccgagttcttataccaactagacaagaaaagccggaacccttacatcctccgccgcgaagcacttgacaaccgactcagtctagaagaaatcgcaagaatcttctaccacatagcccaacaccggggcttcaaatcaacaaaacgagaattagctgaaatgaataaagacgagaagaaaaagaaagaagacggcataatacaatccgaaataaacacactaaaagaagaaatcaagaaaaacagctgcagaaccctgggagaatatttcgccaaacttttcgaaaatggagagaaaatacgcggccggcatactgaccgaaaaatgtacgaagaagaatttcagaaaatcttcaacaaacaaaaagagttctaccccaacatcttcactgacgagttcaagaaaaagctctacaaactaatattccaccaacgggaactgaaatcccaaaaggacaaggtcggattttgcagtctcgagagaggaaagaagcgggccccattggccctccttgtatcacaacgctatcgctatatgtgcaaagtgaacaacctaaatgtcatagacaccgaaacaggcgagaacagagaattgacggtagacgagaaaaagaaactctatgaaaaactagaaaacagcgaaaaactgagcttcaaagaaatcaagaaaatccttaatctatctgaaaaacgatacatcttcaacctcgaaaagagcgagaaatacatcatcggaaataaaacaaacgtaaagatgaaaaacatcatcaaagattgggataacttcgacgaagacaagaagaacttcttcatcaacgaagcccgcacggtagtgaagattgaaacactcgaacgccggggcaagaaactagggctgtcagacgaagaaagcaaggagttcagcaaagtcgtattcgaagacggctacctaaacttcagcaagaaagccgtggagaaactcctgccatacctcaaggagggcaagaaagaatacgaggccatcaagctcgcctaccccgagaactcggtacaaaacgacaacctcaaggagctcgacttcctgcccccaataaagagcaaggaactaaagaagtacttcgaagtgcgcaaccccatcgtagagaaagccctcacagaaacgcggtacctggtgaacttcctaatcaagaaatacggcaagccggaaacgatcaaaatcgaactcgcaagagaactcaagctatcaaacaaacaaaaagaacgaaaacacaaagaaaaccaagaaaaccgcaagaaacgggaggaagtaatcgaaaaactgaaaaacgatctaaaaatctcagaacccacagaaacacaaatccagaagtacctactggccgaagaatgcgactgtaaatgcccctacacagggcggtcgatctccatggacagcctattcggcgagcacccactgtttgacatcgagcacatcataccgttcgaccgctcgctggacaactccttcctgaacaaaaccctatgctacagcgaagaaaaccgcaaggtcaagcacaacaaaacaccctacgaagcatattacggaactgaaaaatgggaggcaatcatcgaacgcgtcaagaaattcaagagcaacgtaagaaacgaaaagctacgacgattccaaatgacgaaagaagacgtcgaaaactatatccagaacttctcaacccaaaacctaaacgacaccaaatacgcctcaaagctcgccaaaaagtacctcggactactatacggaagcatcaacgaggacggaattgacaagaaccgcaaacgccgaatctttgcttcatcgggaaaagtcacatccacactccgatatgcacttgggctcaacaccatccttaacgacgagaacataaaaacacgcgaagaccaccgccaccacgcaatagacgccatcaccattgctctcacggatagcagcatgatcaagaaaatatcagacgcaagcaagcgcgagaagaacatcaactccctcttcaaagacttccaagcgccttgggagaacttccgcaaggaagtggaagaaattatcgcaaagatgaacatcagtatacgcataaacaaaaaggtgagcggccaaatccacgacgagacgttctacaagaaaccatttaaggaggaagaaaaatcctacacgcaccagagaataaacttagaagaactcacaattaaagacgaagataagaagaaacaatcctcaaagctaatagacaacatcgtggacagcaaaatccgcaatatcatcatcaactccctgaacggagagaaacccaaaatacggttcaaggacccaaaagaccacccatacataatccagaaaaacggcaagaaaatacaaatccacaaagtcaccatcaagaccaaacttgagacctacaacgagataggcccagaaaaggccaaaagatacgtcaaatccagcgacagccaccacatagagatcttcgaggacttaaaaacaaagaaatgggacggctacgttgtgagcctgctagaggcatacgaaaggaaaaagaagaaactaccaatcgtcaacaaaaacttaggcgagggcaagaaattcctcttcagcctggccaaaggagaaatcatcgagctcgacaccgaaaatggcaaaagagagctattcgtagtgcgtatcatatcggcatccaacaaccaaatcaaattcacgaggataaacgactcacgcaaaatcactgacatacctgcaaccggcctgacagcctgcccctcaagtctaaagaaacgtaactgcaagaaagtagttatcaacatcctgggcgaaaaacactacagcaacgactga

SEQ ID NO: 6100 - RNA, 3135 nt, synthetic construct
  misc_feature 1..3135: note = Cas9 variant
  source 1..3135: mol_type = other RNA
atggccgaaaagaaattcaaataccgactaggactggacctcggcaccaacagcattggctggtgcatgctgagactgaacaaagacaacgaacccgcggcagtcatcaaatcgggagttcgaatcttccacgatggccgcaatgagaagacgaaagaaccactagctgtggtccgcagaaacgcacgatctatcagacgcaacctcgaccggaaaatctcgcgccgaaaccacctactcaacaccctagtcaaatacttcctcctaccatccaacgagatagagcgcaaggcactcgcagtgctcaacccctacgagttacgcagccgagccgtcaacgagcgcctcgaactgttcgaactcggaagactcctcatgcacctttccaagcgacgaggcttcaagagcaataggaaagtagacaaagaagacagctccgggaaaataaaacctgcgatagagcgcctaaagaacaagatgcaagaaacaaacaaaaagacggcgggcgaatatctatacagcctaatgcagaacgggaagcccgttcgggcccgattaggacggatcgacggctctaacggctacgaaatctacctcgaccgagcactgatcgaggaagaatacaacctgatcatgaacgagcaaaagaaacaccacaaagaactaaccgacgatataatcaacgaaatattcaacataatattctaccaacgacccctcaagaaacaaatcatcggcaaatgctcgctaacgggcgaagacacaaaactaaagaaagcgcacgtattagcacaggacttcatcctactacagaaagtacaagacctcagagtcttcgacgacaaccagctagagttcagaccactaagcaatgacgagaaagatatcataaaacgtgaactaaggaaaaagaaagaagtatcttacgaaaacatacgtaaactcctaaagaaatactacgagaacgttaaatacggcatgttctcacacgagaccctttacaagaaactccagggaaacaaaaccaacgccctaatgagtgacaaagaaatcataggggacagctggtacagcctctcgccagaagtccagtacgatatcatcgaggagctctactccgataaagacaacgacgagctgagcaaactatactcagagaaattcaacctaaatgagtctcagatcaacggcctcctcaacaaagccatatacagactcgattcagggtacatacgctacggcaaaaccgccgtcacaaacctaaatagcatcatggacaaagacaacctcaacctccacgatgcgcgggaagaggcggggtacgaaaaagaaaataaacaggacgcctcggaatacctggaatattacggtaaggtcctcccggactccgtggtcgacccgcaaatcgaaaaccccaaaaacgacgaggagagatacgggaagatagccaacccaaccgtccacgcggcactcaaccaattacgcaaactggtgaacgagctcataaagctatacgggaaaccagagcaaattgtaatcgaactagcccgcgacctgaaaaactcgcgaaaagctaaggacgtcatcaacaagaagatcgccgaaaacaggaaactcaacgaagaggtagacaagacactccaagagtactccgagaaatacaacacacacatcgtcaaaaacaaactaaaccgagataaagtaaagctctggcgcgaactgggcaaggatccactcgaacgaaaatgcatatacacgggggaacaaatcaacatagcaaagttattcagcgacgaagtgcaaatcgaacacatcgtcccctacagcaaaacgctcgatgatagcttcaacaacaaaacactctcaatgaaacaggcaaactactacaaaggcaacaagaccccctacgaagcattcaaagacagcaaggacggatacaactacgacgacatcatagcgcgagccaaactactcaacaacgacaacaaatttaaacgcttcaccaaagacgccatggacatatacaatagagacggcaaagacttcatagcacggcagctcagcgacacacaatacctgagcacccgtgccctaatctatctacagtccctctacgaaaaagcgcaccacagttcaatatggacaatacccggtcaactaaccgccctaatacggaactacctaggcctaaacacactcatcagcaacgacaaaaacaaaaatcggaatgatcaccgccaccacgcagtcgacgccttcgtcgtcgcagttacctcgcgcagtctcctccagaaaatatcctacgcagcctcgctccaagaggacctcgacaaccgaaacgtgagcagttacaggaacaaactactcgaaaagatgccggaaccattccccaattatcgaaaaagtctcgagctagccatagacaacatcaagacaagccataaagcagaccgcagcatcagcggcaagctacacgaggacacagcatacggcatcgtcgaaaacgacgacaagtacaacgtggtcacaaggtggacagtggacaaatttaaagaacaaaaacacttcgagacaatcagagacaatgaattaaaagaaatcgcgtgcagtgacaaagagctgtttgccaagatcgtagaaacccggaagataaaaagcatccgaaaactagcgaaagagaaccccgtaatcaaaatcaaagacaaatcgggccgcgactacaaggccttcgcgggcggtaacaacatatgcgtggaaatatacgaagtggacggcgtgcggaaaagcgaagtgatccaactgttcgacgccgcacaaaagggcttcatgcccgagtggatgaagaagtatccaaacggcaagctccttatgcgcctcttcaaaggggatgtcatcggcttcatagagaaccgaaagtacaactactacaccatcaaaggcatatccatagcggaccaaaacctaaaactcctcgccattaacaaagcagaaggaatcttcaagaaaggacttaacatcctcttcgactctaacaacaaaaacagcctcaatgcaaagcaattcaacatcagtgtcacaggaatcgtcacaaagaagaaaaccgcagatgttaacttctggaaaaaccggaaatga

SEQ ID NO: 6101 - RNA, 3135 nt, synthetic construct
  misc_feature 1..3135: note = Cas9 variant
  source 1..3135: mol_type = other RNA
atgctccacaaaatgcgctaccggctagccctcgacctggggagcacaagtctcggctgggccatggtaagactaaacgcaaaccaacaaccatgcgcagtcataaaagcaggagtgcgaatattctcaaacggccgaaaccctaaagacgggtcaagtctagcagttacacgacgagaagcacgatccatgcgacgcagacgcgacagactcctgaaacgaaaggcccgaatgatgcgaacccttatcgaatacggctttttcccagctaacgaaacccaaaggaaggcactggagaacctgaacccctacgcactccgagcaaaaggactcgacgaggcactaaccccctccgaatttgcacgggcgctatttcacatcaatcagcgaaggggattcaaatctaacagaaaaaccgacaagaaggacagcgacagcggagccctaaaaaccgcaataaaacagttacactccgtcctcgatccacaaggcaatgacgggaaaccacgaacagtcggcgaactcctatacaagcgcttcacggacttatcaaaactccccaaagacagaaccgtccgcgcgaggtaccgccaggacaaaatagtgaaggatgacggcaaaaccaagatcgacaagtactacgatctctacatcgaccgagcgatgatcgaacaagagttcgacgcgctatggaaaaagcaaagcgaactcaacccgatactcttcacggaaaatgcaagagcggacctaaaagacgtactcctgtaccagagatcactaaaacccgtaaaacccggccggtgcaccttcatgagtgaagaagaaagagcacccctcgcactcccctcaacccaacgcttccggatgtaccaagaagtgaacaatctacgaatactgcgcgaagggctaaaagaagaatccctcacactccaacaacgggatgacctgataaacgcattagaaaagaataacaggcgcacttttacgcaaataaagaaactgctgggagtcggcggctcagttcagttcaacttcgaagaccccaaacgcgaagaactcaaaggaaacacaacctcagcaatcctcggtaaatccgaacacttcggagaggcttggttcgccttcaacgaagccaaacaagacgccatcgtcctacaactaataaaagaagagaacgaagcgaaactcgtaaggtggctccaagacgagacagggatagacgaaaaacgcgctgaggtaatcgcgaacgcaggcctgcccgaaggatacgggtccctctgcatcgaagccctagcaagaatactgcccgaactccgtcgagacgtcgtgacctatgataaggcagttcaagcagcaggattcgaacaccacagcaaactcaaccgcaatgaggaaatacccgacatcaccttcaaaatagaatcaatcgaccgcaacagcggagaaataaaacaattccatctgcacaaggaactaccttactacggtgaataccttcaacggcacgtcggcttcggcagcggaaaaccagaagactcaatcgagaaacgatacggcaaaatagccaacccaacggtccacatcggtctaaaccaagtccgcgtagtagtaaacgccctcataaagcggtacgggcacccaagcgaaatcatcgtagaggtcgctagagatctaaaacagagcaaggacagacgagacgaagaaaataaacggcaggccgaaaaccaaaaacgcaacgaaagactccgaaaagacatcgccgatatcctgggtatcagcgaggaaagggtccgcagagacgacatcgagaaaatgatcctctgggaagaactcagctttgacccagccgatcggcgctgcccatacagcggagtccaagtatccacggtcatgctgctgtctgacgaagtcgaggtagaacacatcctaccattcagccagacgttagacgactccctcaacaacaagacagtcgcactccggcaggccaaccggatcaaaggtaaccgaacaccctgggaagcattcggcacgtcaaacatatccgggtttgactacagcggaatactaacccgcgcagaactgatgccgaaagcaaagcgatacaggttcgcagaagacggctaccaacggtggctaaaggacgacgcaggcttcctcgcacgggcactcaatgacacacgacacctaagtaaaatcgcacgcgaatacatgtcgctcatatgcccaaacacccgtgtcatcccgggacaaatgacggccatgctcagacgcaacttcgggctcaacgacgtcctaggcctcaacggagagaaaaaccgcaatgaccaccgccatcacgccgtagacgcctgcgtcatagccgtaacggaccagggcctgctgcagagattcgcggcagccagcgccagcgcacgggaacgccaacttaatcgtctagtcgaaaacatgccactcccatgggaatcgtatagggaacacgtgcgcagagcaatcgacggaatctgggtgtctcacagaccggaccacagccacgaaggagccatgcataacgacaccgcatacggcctaagaggaaacggacgtgtctccttccacaaaatggtagaaggcaaaagagaatacatagaagacaatctgaaggtaattgaaataacagatactaaagccattgaccgacatggcctcctaccaactggcaaaccgcgtccatataaaggctacaaaggcgactccaactactgcatcgaaatagtccggaatgaaaaaggcagatgggaaggcgaaatcatctcaacattcgacgcctaccaactcgtccgaaaatacggaatcgtccaactccgctaccccgtcctctcggtaagcggcaagccgctagtgatgcgcctaatacgcaacgacttcgtacgactcgagcacgagggaataaccagaaccctccgagtatgcaagatgcgggaggacggccaagtcgccctagccgacgtcactgaagccaacgtcgacgcacggacccggacaaaggaaatatgctacgtttttaaaaccggaggcagcctccaaaaagccaaagccagacgcataaccatcagcccaatcggcgaacttcgcgatcccggattcaaagagtga

SEQ ID NO: 6102 - RNA, 3138 nt, synthetic construct
  misc_feature 1..3138: note = Cas9 variant
  source 1..3138: mol_type = other RNA
atgcaaaaagaaaagccactcgcctaccggctcgccctggacttgggatcaacatcgcttggatgggccgtcctgagactcagtgcaccaggggaaccgagcgcagtaatcagagcgggcagccgcatcttttcggacggcagaaatcctaaggacgggagctcactagcagtaacccgcagagccgccagagcaatgcgacgaagacgagaccgattgttgaagagaaaggcgagaatgctagcagcactagaaaggcacggattctttccgcaagatgaagcagccagaaaagccctcgaaaaactaaacccatacggactaagagcccggggactagagagcgcgctaaagcccgaagaatttggccgggcactcttccacctaaaccaacgacgaggatttcaatcgaacagaaaaacagacagaaaagacagcgacagcggagcactcaaacaagccatcggaacactacgcgcccagatgcacgaaagcggatgccgcacggtaggagaatggttctggaaagtgcgaatggagcgaaaaccggaaggagtaaaaggacagggagtacgggcccgctaccgcgagactccattcacaacagacgaggggaagaaaagaatagacaaacgatacgacctatacgtagatcgggccatggtagcccaagagttcgatgcactgtgggcggctcaggccacctttgcgccagcgctattcaacgaagcagcacgagcagaacttcgcgatatcctgctccatcaaaggaaattgagaccggtccaacccgggagatgcacgctagttccagaagaaccccgagccctactcgcactaccaagcacacaacggttcagaatctatcaagaagtaaaccacctacgcgtcctccacgacgaacttagggaagaggcccttacactagcacagcgcgaccaaattgttgcactattagaaagacaggcaaaagtaacattcacggcgatgagaaaagcgctcggattctcggcgttgttcaacctcgaggacgcgaaacgggacggcttaaaaggcaacgcgacgacagccgccctcggcaagaaagacctattcggaccactgtgggccgggttcgatacagcactccaggacgaaatagtaacacagttaatgactgaagaaagcgaacccagactaatagcctggctacaagagcacacgggagtggacgaagcaagggcacaggcaatagcgaacgccggactcccggaaggatacggaagcctagggaggaccgcgctagcgcggatagtaccggaactgcaaagggacgtgattacatacgacaaagcggtccaggcagcgggcttcgcccaccactcggatctcgggttcagcttcgagcacgacgcagatgaagtagaaagaataggggaaagaacaatagcaagcacgggagaaataaaaccagtcttcgcatttaaacaactcccatactacggccgcgcgctccagcgacacgtagcattcgccaaagaaaacccccgcaacgacgaagagagatacggaaaaatcgccaaccccaccgtacatataggtctaaaccaagtgagagtagtagtaaacgccctaatgtgtaggtacgggagaccaaccgaggtcgtaatcgagctagcgagagacctcaagcaatcccgagaacaaaaactggaagcacaacaaagacaagcagacaaccaaaaacgcaacgccagaatcagacgatctatagcggaagtactaggaatatcagaggaacgcgtcagaacactagacatacaaaaatggatcctatgggaagaactgagccacgacgcagcagacagaagatgcccatactccggagtgcaaataagcgcaagcatgctactgggggaacgcgtggaaatcgaacacatattgccatttagcatgacattagacgatagcctaaacaaccggacggtagcgctcagagaagcaaatcgaatcaagcgcaatcggacaccgtgggacgcgagaacagacttcgaggcccatggatggtcatacgacggaatacttcagagagccgagaggatgccacaacgaaaaagacacaggttcgcacccgacggctacgaaaggtggctaggagaagacaaggacttcctcgcacgggcgctcaacgacacgagatacctcagccgggtggccgctgaatacctcaggctcgtatgtcccgggagtgcaacgcgggtgatcccgggacaaatgaccgccctcctgagggggaagttcggactgaatgatgtcctcgggctcgacggagagaagaacagaaacgatcatcgacaccacgccgtggatgcatgcgtcatcggagtgactgaccaacgaatgatgcaaaggttcgcacaagccaacgcacaggcgcgcgaagacggactcacgcgcctagtagaagatatgccactgccatggcccacctacagagcccacgtcgagcgcgcggtacgacatatctgggtaagccacaaaccggaccacggattcgaaggggccatgatggaagaaacaagctacggtatactcagagacgggacgataaaacagcgccggaaggcggacggatcagcgggcagggaaataagtcggctcatacgaataacagagccctcacaaccccagcgacatggagtagacgccgaaggcagaccactaccctacaaaggctacgtaggaggaagcaattactgcctcgagattaccgtaaacgacaaaggaaagtgggagggccaagtcatctctaccttcgacgcataccgaatcgttagggaaggcggcctacgacagctcagacactcaacccagggacaaaacggccaagcactggcgatgaggctcgtaatcggcgactcggtaagactagaggtagacgaacaagaaagggtcatgcgcatagtaaagattaatggcaacaacggacaagtattcatggcccccgtacacgaagcaaacgtagacgcgcgaaacagcgacaaaaacgaagcattcgcgtacaccagcaagatcgccggctcattccagaaaacaaaggccagacaagtcacaatatccccaatcggagagctaagagacccggggttcaagggatga

SEQ ID NO: 6103 - RNA, 3138 nt, synthetic construct
  misc_feature 1..3138: note = Cas9 variant
  source 1..3138: mol_type = other RNA
atgaaaccacgaaacctgaactacatcctaggcctagacctgggcatagcgtcggtcgggtggtccgtcgtggaaatcgacgaaaacgaatatcccataagactgatcgacgtcggcgtacgcacgttcgagagagccgaagtacctaaaaccggggaatccctagcactagcacgccgtctagcacgctcaacaaggcgcctgattcgccgacgcgccttcaggttactaaaggccaaacgcctcctcaagcatcatcaaatcgtcaacgccgaagaactcacccagctacctaaccagtgctgggaactcagagtaaagggcctcgacagcctcctctccaacaccgagtgggcagcggtcctactccatctcctcaaacacagggggtacctgtcacaacgaaagaacgaggcacaaaacgcggacaaagaactgggaaaactccgggaaggcatggacaacaatagcaagctcctgctagaaaacaactaccggactcccgcagatatcgcagtcaagaaattcgcggtagaagaaggccacatgagaaatcaacgaggagcatacacccacacctttaacagactcgacatcctcgcggaaatgcaactactcttcaaaactcaacgagagctcggatccacctacgccaacggcgaactcgaacaggcattttgcgagctactactatggcaaaaacaagcgctaaaccgctcccaaatgctctccctcgtaggaaagtgcactttcgaaaaagaagaaaaacgcgccgcaaaggcctcatacagcgcagagcgcttcgtagcgatacaaaaactccagaacctccgcattctagaaaatggcgaagaaaggggcctcttcgacagcgagttctccctcctgctagaaaacgcgtacaatctgaaatccggcctcacgtacaaacaagtacgcaagatcctgtcactaagcgaaaatgcaatattcaaaggtctcccctacctgagcgacgacctggaaaaacccgaaaagacgcaattcctcgcgttcaagttctaccaccagctggccgacatcctgaagaacaacggcttcagcgacgaatggcagaaactctcccaagaacccaccctcctagacaaactcgggactgaactctccctctgcaaagaggaaaacgagtttatcgcgcagttcaacggagaattaccggaagccatgttatctaccctgttcaaccacaccaacttcgacaaattcatccacatatcacttaaggccctcaacaacatcctaccactcatggaacagggaaacgattacactaaagcatggcgcaaagtctacccagagcccacaaagaaagacgagaaaactctacccccaatcccagcggacgaaatccgcaaccctgtagtccttagatccctgagccaggcccgcaaagttatcaacgccgtcatacgactctacgggagccccgcacgcatccacatagaaacagcaagagaactcggaaaatcctacgacgaccgtcagaaaatcaagaaacaacaagacaaaaactccgatgaacgcgaccaagcggtaaagaaatttttagaggagtgccccaactttgccaacaaagtcaaaggaaaagacatcctgaaaatacgactatacatcaaccaagacggtaaatgcctatactccggcaaacccctagacccacaccgcctcctcgaaatcggctacgtagagattgaccatgccctaccgttcagccgaacgtgggacgactcacagaacaacaaagtcctggtcctcgcaaacgagaaccagaacaaaggcaaccagacgccgttcgaatggctcggcaaagacgagcaccagtgggcactatttgtagcgcgcgtaaacggatgcagattcccatatgccaagaaacaaagaatcttgactaagaaactcgacgagcaagggttcctaaaacgaaacctgaacgacacaagatatgtgtccgcctacctgatgaaacatatcaaagaaaacctgcacctcgtcggaaaaggatccgacaaagtgttcgcctccaacggccaggtaacgaacttcctaagacgctgctggggtctcgagaaaaagcgcgaagaaggagaccgacaccacgccctagacgctatagtcgtggcctgttccaccgcatcaatgcgccagaaaataacgctattcaaaaagtaccaacggtggaatctaaaaacaggcaaacacatagaccaagaaacaggcgaaatcattccgctacacttccccgccccctgggacttcttccgccaagaagtgatgatccgcatcttctcagaaatgccgcaggaagacttaataatgcaattacccgaccgcccccaagcaaaccacgagttcgtacaacccctgttcgtttcccgcgcgccatcccgaaagatgagcggacagggccacgaagctaaactccgcagcgcacggatgctagaagcaacaggaaaaagcatcaaaaaggagttcctaacagacctaacgattaaaaacttggaacacatggtgaacaaggaacgcgaaccggagctataccaagcactcgtagaacacttcaagaaatatggcgacaaacccaaagaaaaattcttcaagaagggcggggtggaagttaaaagcatacgaatttccaaaacccaaaacaaaagcgtcaacctcggcaacaaaacaattgcagacaatggcgacatcgtacgaacagacctctttctgaaaaacaagaaatactacttcgtgaacatatacgcgtggcaagtcagtaaaggaatactgccaaaagaaacgacaacgggaaacatactagacaactcctatgagttccaatttagccttttcaaaaacgacctcctcgaaatcccgcatcccaaaaacgaaaacgacagcatccttgcatacttcatcaggcccgacgacgaaaggcgctggatactaaaattccacgacaacgccaaaatcccagacatctatggcaaaaaggacgaaacctcaataaggctttcaatacaaggacaaaaattcatcaagaaataccaggtcgacgagcttggcaaaaacatcagaccctgccgtcccaccaagcgacaaggagtacgctga

SEQ ID NO: 6104 - RNA, 3141 nt, synthetic construct
  misc_feature 1..3141: note = Cas9 variant
  source 1..3141: mol_type = other RNA
atgaaaatatactccttcgacatcggagtcgccagcatagggtgggccttcatcgaaaatgaagtcctgcaggactgcggaatacggatattcaccaaggccgaaaatcccaaaaacggggccagcctagctttaccaagacgcgaagcacgcggcgtacgcaaacgcctagcacgccgccgcggccgactaaacaccataaaacaactactgtgcaaagagttcggccttcaactagaagactacctctccaacgacggcgagcttccgaaagcgtacaccgcctcaaaggccaacccgctaaagtctccatacgaactcagaactttagcactttcgcagaaactcgactccaaagacctagtccgcgttatactacacatcgcaaaacaccgcggctacggcaacaaacacgcgaaagactccaaagacaccgaatccggcaaggtcaagaaagcgatcgagttcaatcgaaaaacactcgcggaaaaaggctaccgctcagttggagaatacctctaccgcgaatttttccaacaatcgcgcatatcacaaaacaacggcgctaccgagttcgtaaacgtccgaaacaaaacgggcaactacgagcactgtgttgcccaagacatgctcaaagatgagctcgagctcatattccgcaaacagaaagagctcggccttcacctaagcgacggcttcgaaaaacagctgcttgacaaaatcttcgaacaacgcccactcaaatccttcgcagataaagttggaaaatgccaattcatcgctggcgctaaacgcgccccgaaggactccatcagcgcgatcgagttcgtcgcgctaagccgaatcataaacacccttgccaacctctccaagaaatccggagaaatgtatgacaaagccatggttctcacaatcctagactcagtactcgaaaaaggagaaatgtcctactacgccctacgagaggctatcaacctagacgagaaaatacgcttcgccgactcccgcctggactactccaaagagataaaagagaccgagaaagtaaaattcgtggaatgtaaaaacctaaagagcttcaagaaagtactcggcaactgctacaaaacactcgaacgcaaacacatagactcaattgccgaacgcatagcagtcatcaaggacgtcgaaaaactgcacaaagagctggagtcatactgcgcgaccgagcagctatcactcacatccgagcaaatccaggctctgtcccacctcaacttctcctcccacatatcactcagcctaaaagcactcgaacaaatactcccctttatgcggggcgagagagaagcccgatccagcgacgccgactactgcatagggatcgacgaatccggagaaagccagtgcctccgctacgacgagagcgtagagaaagctggcctcaaagccctcagcaaagacaccctcaaaggccaaatcctcccgcccttgaacgagttcgaaccctacctggccaaccccgtcgtcgcccgggcactagcagaatacagaaaggtcctaaatgccctgctaaagcaatacggctccccacacaagatccacatagaatacgcgcgcgaagccaaactaaacaccaccgaacgccaaaagtacgaaaaggagcaaaaagacaactacgccgccaaccaagccgcccacaaaaagtgccaagagctaggacttgaaccgtcctcaactaacctcctaaaactcaaactatggcaggagcagggcggactgtgcctctactcaggggcaaaaatcacaatcagttaccttcaggaccccaccgcgctgcaagtcgaccatatttacccctactcacgatccttcgatgattcatacatgaacaaatgcctcgtcctgaccaaagcaaaccaagaaaagggaaaccgaaccccgttcgaggctttcggcaccgatagcgcaaaatggggagtcataaccaccctggcccagaaacttccgcacaagaaaagacgccggatcctcaacaccgcgttcaacgataaagaagccggcttcaagctccgaaacctaaatgacacatcgtacatcgcccggcttgtggctgactatactgaaacctacctagagttcctgtcccttgtcgaatccgaaaatacaaccctgggaaagggtcagaaaggatccaaaaagcacatcgcgatagtcaacggcgcgctaaccagcaccatgcgatactacttaggtttcgcctcaaaagaccgtgacaaccacctacaccatgccttagacgctgtcatcatcggctttatgaacgatagcgtcatcaaggcattctcagacttcaagaaaacacaagaaacctcaaaagccgcatactacgcgcataccctctcaaaacaagaatacaagaaacaacgagcattcatacagctacccagcggtgaaaacttccgagcgaacgtactagaaaaagccgaatccgttttcgtatcaaaacccccgcgaaaacgagtccgaggcgcactgcacgaagaatcattctactcccagaacgacaccaaactgctaaaatcgtacggtggcgcagaaggcatcgaaaaagccctgcagctcggtaaaatccgccaaatcggcacaaagatcgtctcgaacggtgccatggtccgcgtagacatattcaaacacagaaaatccggcaaattctacggagtcccagtatacacaatggacttcgcactaggaatacttcccaacaaggccgtagtccagggaaaagataaaaacgacgtgatcaaggactggctagagatggacagctcatacgagttcatattcagcctatacaaggacgacctcctcctagtacaaaagaaagaaatggcagaacccgaactatgctacttcgtatccttcgacacaagtggagccagcatcaaagtggcgaaacacgacaacaacttcagcacacttacagaaaaccaaaaactactgttcagcaacgcaacaaaggaagaagtcgtaggtaaaagcatcggaatccaaaatctgaaagtctttgaaaaatggcaggtatcagtcctcggagaggtaaaacgaacccaatcctacccccgggaaaatatctccctagccagcaaggccaagaaatga

SEQ ID NO: 6105 - RNA, 3144 nt, synthetic construct
  misc_feature 1..3144: note = Cas9 variant
  source 1..3144: mol_type = other RNA
atgaagctcttacgatacatcctaggccttgacctcggcatcgcgtcggtaggctgggccatcgtagagatcgacgagaacgacttcccaataaggctcattgacataggagtccgcaccttcgacaaagccgaggtaagcaagaccggcgaaagcctggccctcgcccgtcgcctagcacgctccacgcgcaggctgatccgccgtcgcgccttccgactactcaaaggaaaacgattactaaaacaacataacgtcatcaacaaagaagcattaacaaccctccccacggactgctgggcactacgcgtcaaaggcctcgacgagcggctttccccaacagaatggagcgctgtactcctgcaccttctcaagcaccgcggctacttatcccagagaaagaacgaggctaaaagcgccgacaaagaaatgggagcgctactctcaggcgtagcctccaaccaccaactcctcgtcgaaaaccagttccgaacaccagctgaaatcgccgtcaagaaatttgccctagaagaaggacacatcagaaaccaactaggggcctacacccacaccttcaaccgactcgacttactagcagaaatgaaactccttttccaaacacaacgagagcttggcaacccccacacatcaggccaactagaacaagagttctgcgaactcctcatgtggcagaaacccgccctctcaggagacgcgatactaaaaatgctgggaaaatgcacattcgaaacgaacgaatacaaagccgcaaaacacagctacaccgcagaacgattcgtatggctcaccaaactcaacaacctacgaatactcgaacacggaagcgaacgcgtgttaaacacagacgaacgctccctcctgctcaaccagccctacgaaaaagccaaactaacgtacacacaagtgagaaaactgctaggactcagcgaagaagcaagattcaacggcgtccgctacggaaaggaaaaagcagaagacgctaccctaatagaactaaaagcatatcacgccatcaggaaggccgtggaaaaagccgacaaaagtgcctgggagacccttaaaaaccaaaccgcactgcttgacgagataggcacgaccttctccatctacaagacagacgatgacataaccgaacaactcaacggaaaactctcagacacggtacttaacgcactcctggagaacctaaacttcgacaaattcatacaactgtcactaaagagtctctataatatcgtcccactgatggaacaaggactccgctacgacgaagcctgtcaacaaatatacggggaccacttcggaaagaaatccggcgagataaaccgactcctcccaccaatacccgccgacgaaatacggaatccagtggtcctccgatcactaactcaagcacgcaaagtcatcaacgcagtgatacggctatacggcagcccggccagaatacacatagagaccgcccgcgaattagggaaatcatacaaagaccgaaaggagatcgagaaacgacaagagcaaaaccgagccgaaagagaaaaggccaccgcccagttcaaaaccctgtttccaacattcataggggaacccaaaggcaaagacatcctcatgatgagactatacgaacaacaaaacggacaatgcctctactcgggcaaacccctcaacctcaacagactcctggagaagggctacgtcgaaatcgaccactcactccccttcagtcgcacatgggacgactctcaaaacaacaaagtccttgtgctcgccggcgaaaaccaaaacaaagggaaccagacccctttcgagtggctcggcaaagacgagcaccaatgggcccttttcgtagcacgcgtcaatggatgccgcttcccatacgcgaaaaagcaacgaatcctcacccaaaagctcgacgaacaaggcttcatagaacgtaacctaaacgacacccgctacatcgcacgattcctcgtcaacttcgtccgagaaaacttgcacttgaccggcaaaggcaaaaacagagtctttgcctccaacggccaaataacggccttcctacgcggacgatggggactatcaaaagtcagggaagagagcgaccgacaccacgcattagacgcagtcgtcgtagcgtgctccacagtcgccatgcaacaaaagataacccgcttcgtcaaataccaagagggaaacctacaaacggcagaaagaatcgatcgtgaaacaggcgagattataccactgcatttccctgacccatggcactttttccggcaggaggtcatgatccgcatattctccgaaaacccccaagaggacctcatcatacaactccccgaccggcccgaagcgaaccacgagttcgtccaacccctgttcgtctcccgcatgccaacccgcaaaatgtccggccaaggacacatggaaaccataaagagcgctaagagactagacgaaggcatctcggtaagcaaggtcccactaacccaacttaaactaaaagacctcgacaatatggtgaacagggaaagagagaaagccctctacgaagcactcaaagcccgcctcaacgccttcaacgacgaccccacaaaagccttcgccgagccattctacaagaaaggtggtcaacaagtcaaagcagtaagagtagagcaagtgcaaaagtctggcgtagtagtacgcaacggaaacggtgtggccgacaacgcatcaatggtccgcgtcgacgtttttatcaaaggcgggaagtactttctcgtccccatatatacgtggcaggtcgccaaaggaatactgcccgacagagccgtcgtagcggcaaaagacgaatcggagtgggaactcatggacaagaccgcacaattcctgttctcgatgtttcccaacgacttaatccaagttaagacgaagaaagagacctttttcggctattacaacggcctagaccgcgccacaggggcgataaacctcaaagaacccgactccaacatcaacaaaggcaaatcaggcctccaccgctctatcggggtgaaaacggccctctccgtcgagaagtaccaggtcgacgaactcggcaaaaatatccgcccctgccggccgtccaaacgtcaagcagtgaggtga

SEQ ID NO: 6106 - RNA, 3147 nt, synthetic construct
  misc_feature 1..3147: note = Cas9 variant
  source 1..3147: mol_type = other RNA
atgaaacgtcttggcctcgacatcgggacaaactcaataggttggtgcctaatagaggatgatggcgacggaaaaggcagaataatagatattggcgcacgtatcttcagtgacggacgagacccgaaatcgggcgccagcctcgccgtcgaccgcagagccgcgcgcgctatgagaagacgacgcgatcgctacctggggagaagaaccgctttcctcaaagcactgaaacgattcggcttaatgcccgccgacgaaagtgccgccaagttactcgcagaccgggacccatacgagctacgggccagagccctagacgagcgcctcgaacctcacgaaattggcagagccctgttccacctaaaccaaagaaggggattcaaaagcaaccgaaaagccgagagaaaaaccaaggacgccgaagacggcaaaatagccaatggcgctaaagctctcgaccaggctatggcagaaagcggagccgaaacactgggccaattcctcagttcgcgagataccaagagagtaaggatgggaagcgacgcacaaggctacgacttttacccccaacgtcgccacgtggaatacgagttcgacacgatctggagccgacaacaacagcaccacccagcactgctaacagaagaagcaagaaagaaattacacgacatactattcttccaacgaccactcaaagaacaggaagtgggcgtgtgcaccttcgtacacaacgaatgccgcctcccaaaagcacaccccctcttccaggaacgtagactttacgaagaagtaaaccagctagaaataaccaccccaggagcacccaaccgtaaactaacaatggacgaacgagacgctctgatcctagaactgcgatcccgcaaagagcgatccttcgacagcctcgctaaacgcctaaaactcgcaccaggccagagcttcaataaagcctcagaatcccgaacacggctaaggggcgacgaggtctatgcagtgatggcccataagaaaagattcggcgaccggtggccccacctagaccgggacaggcaatgggcaataataaaaagaataatagaagaagaagaccccgataaacttcacgcgttcctaaccggggaatggggcctcacagacgaacaagccctggccacagcccgggccccactcccagagctctacgggcgactagggccaacggccacagcccgcatactagaagaactcaaaaaggacgtaatcacatacgatgaagctgtgcggcgagcaggatggcaccacagcgatgaccgaacaggagaaatcctaccacaacttccatattacggcgaattactaacaagagacatcccgcccggcacccaagatcccaacgatcccccagagcaaagatggggaaagataacaaacccaaccgtccacataggcctgagacaactcgaaaagctagttaacgcaatcataaaagtccacggacgaccagaccaaatcgtcgtcgaattagcccgggaactcaaactaaacgaaaaagacaaggaggagcacaacagaagaatacgcagggacacagctgcagcccaactcagatcggcgaaattacagtccgagggcatccccgacaccggcgcaaaccgaatgctcctcagaatctgggaagaactgaatccaggagaagtactagaccgccgatgcccatactgcggggaacccgtaggcatgaggatgctattcgcaggagaagcagacatagaccacatcatcccatattcccgcagcctagacgacagtgcaggaaacaaggttgtagcccacagaagctgcaaccgggcaaagggaaataggacaccctacgaaaaatgggtccacgacccggaccgatgggacgtcatcagtacacaagtcgccagactccacaaatcaaaacaatggcgatttggccccgacgccatggcaagagtcgagaaagacggaggtttcatcgcacgccagctcaccgacacccaatacctaagccgactcgcaggcagatacctaagcagcctctacccaaccaaggacgacggcagcgtgtacgtaatcccaggcagaatgaccgcaatgctgcggcgccgatggggcctaaacagcctacttcctgaccacaactttgtcgacaacgaacactctaacgcacctaaaaacagactagaccacagacaccacgccatagatgcggccgtcgtagcagtaacaacacgcgccctcatgcaagaaatcgcccgcaccgccggacgtgccgaggataaggacctagacagactattcgaagaccttccgcaaccctgggaaggcttcagggaagaactaggcgaaaaacttgtaagggtcaccgtctcccacaagcccgaccatgggcggaaaggcctcccaccaaagaacagagacgtcacagcaggcagactccacaacgacacagcatatggcctaacgggagacgtagccgcagacggaaagaccccgatcgtagtccatcgcgtaccactcatgagcctaaaacccgccgacatatctgatccagaccgaatacccgacccagccctcaggagcgcactacaccgcgctaccgatggactatccggtaaagcctacgacgcagcactagcaggattcgcaaagacacacccacagttcgcagggataagacgagtcagggtgcgcgaaccactaaccgtaatcccaatcgcagaccgagatggtcgaccctttaaagcatacaaaggcgacgctaacagcagagtagacatatggcgaatgccagacggcaaatggctctctgacgtagttaccatgtatgaagcgcacagaagagaccactccgacagaagacctcaccccgccgccaagaaactgatgagcctccggcaaaacgacatgatcgcagtcgaacgagacggcgccccacgccaaatcatggtagtgaaacagatatggccaacccaaataaacctcgtagaacacaaagagaccggaaaccttaaagacagacacagcaacgagacggacccgtttcgtttcttcgcgccaaccgcaggcggcctaaagaagatgaaagccagacaagttcgcatagaccccctaggccgcatcttcgacccgggacctcgatga

SEQ ID NO: 6107 - RNA, 3147 nt, synthetic construct
  misc_feature 1..3147: note = Cas9 variant
  source 1..3147: mol_type = other RNA
atggccaacatagccgaaaacctggtcttcggaatagatctaggcataggatcatgcggctgggctgtcctaaaccaaaaagcaaaagacgagaatatagtcgcgctcggctcctggtgcttcgacgtcccagaaacagacaaagaacgaatcccaaccaaccaaatacgacgtgcaaaccgcctactacgacgcgtaattaggcgcagaagaaatcgcatggctgaaatccgcagactattcgcgagcaaaggtatgctcgacacagcggacccagacgcactggcaaaaatatcggcagacccatgggaaatgcgagcgaaaggcctcgactaccaactcacaccacaagagttcgccgtcgcattaggacacatagctaagagacgcggattcaagagcgccgcaaaaagagtatccacgaatgccccttccgaagactccaagatgctagcagcactagagaaaaccaaagaacaatcggcacaataccgaactatcggagaaatgtttgcccgcgacccagcatacgcggaccgcagacgaaaccgagacggctgctttgaccggactatgagcagagaagacctattcaaagaaacgcaaatactattcgagagccaaagaagactcggcaacttcagcgcaacctccgaaacagaacaagcattcatcgacatcgcattccgacaaaaaccaatgcaagacagcgaacgacttgtcgaaacctgcctattcgaaccagacgaaaaacgagcaagcaggttcgcccccagcttcgaaagattccgactattatgcagactcgtaaacctacgggtcacggatggcctggaggacagaccactgacacccgaggaactcaggctcgcgtgcgaagatgcgggaaagacccgaaaactgtcggtaaagaaagtacgcagcctaataggactacgagacgaccaaaggttcacaaccatcccacccgaccaggaacaacacgacatcgcagccagaacaggggacgcgctcacaggcacagcaaccttccgagcaatcctcggagaatccttctggaggcaactactaccccacccggagcaactagacagggcagcctggataatttcattccacgaactaacagacacaataatatccaaactggccacaataggactgccctcagaggtgatggagctgattagaaaagcgctcgaagacggaaaattcagcaaattcaaaggcgcagcaagcctaagcgacaaagcggcacggaaactaataccatttttacaggaaggcctcacatacgacaaagcctgccaaaaggccggctataaccacgccgcgtccaaattcacacactacgactcaatcgatacgaaagccaaattcaacagcctaatggatgacgtcagggacagcatcacaaacccagttgcccgcaaggcaatctcagaaggcatgaaacaagtgtgggccatgaggaaccagtggggcctacccggagcaatatgcatagaactcgcacgagacgtcggtaacagcgcggagaagcgtcgagagatcgaaagtggcattaagaaaaatacggcgcaacgagagcgcgaacgacaagaagcaaaggaacacctcaaccaaagcgacatcagctcggagacgctgctacgctaccgcctgtggaaagaacaaggaggccggtgctgctacacagaccaaccaataaccccatcgcaactcatagcttccgacaactcggtccaagtagaccacatcctcccatggagccgcttcggggacgactcataccttaacaaagccctgtgcacagcaaaagcaaaccaggagaagaaaaacagaaccccatgggaatggatacacaaccaaaaaggagtcgaagcgtggaaccacttcacagcagccgtagaatcacggaaagaaacaaggggactaaagaaacgaaactttctcctaaaaagctccaaagaaacggaagaaagattcagaagcagaaatctcaacgacacacgctatgcagcaagggtaatggcagaggccgtccggctactatacccgagcggaaatagagcggagaaagggggtgtaaaacgcgtcttcaccagacccggagcactaaccgcagccctccgacatgcctggggcgtcgaatcactgaagaaaattaacgggaaacgcctgaacgacgaccgacaccacgcgctggacgcagcagtcgtagccgcagtaagcgaaaaagaaatacagaaactcaccaagagcttccaaatctgcgaacaaaaaggactagcccgaccgatgcgagatgtccccatgccatgggaaggcttccgacaccagctagagactgcctacgcagacataagggtcgccaggccagagcgtcgccgcgcaagaggaaaaggtcacgacgcaacaataaggcagctccgtgaggaaaaagacggaccagttgtatacgaaagacgagccataagcgacctaaaactgaccgacctagaacgaattaaagacccagaacgcaactccgcaataatcagctcactcaggacttggatagaaaaaggaaagccggccgactacccaccgcaatcgccaaagggcgacgaaatacgcaaaataagagtcatgagcagaaacaaacccgcggtaagcgtgcgaggcggcacagccgaccgtggggaaatgacgcgggtcgacgtattcacaaaaatgggaaagaaaggaaaaccagaatggttcctggtccccatctacagacaccaagtaatagaccgcatacagtggccccagcccccaaaccaagcggccgccaacggaaagagcgagaaaaattggccaacaatggggctagaacacgagttcagattttccctgtacccacgaagttacgtccaaatcgtcaagcgagacggagaaataatagaaggctatttcgccggcctggaccgaaccgtagccgcattctccctgctctcaagcagcgatcccacaagcatacagagaggaatcggagcaaaaacgctagaaagcatacggaaatacaatgtcaaccgcttcggcgacatatcgatggtggaacaagaaacgcgcacatggcacggagacgtctgcataagcccagaccaaccagacagcgcatga

SEQ ID NO: 6108 - RNA, 3147 nt, synthetic construct
  misc_feature 1..3147: note = Cas9 variant
  source 1..3147: mol_type = other RNA
atggtagagaaaatcctgggcatcgacctaggcatatcgagtttaggatgggccgtcgtagaatacgacaaagacaacgacgaaaacaacaagataatcgactgtggcgttcggctattcactgcggccgaaaccccaaaagaaaaagaatcccccaacaaagcacgcagagacgcacgaggactcagacgcgtcatcaaacgccgacgcgttcgaatgaacaccatcaaaaacttgctaatcacctacaagctcatagacaagacactacttgacgaagaaatgggcatgttccacagccaaagcaaccgcgtagatgtctggaagctcagacacgacgccctgtatcacctactatccggcgatgaactcgcacgggtacttatacacatagccaagcaccgaggctacaaattccttggcgacgacgaatccgacgaagaatccggcaaggtcaagaaagccggcgcggaacttaagaagaaattcctcgaagccggctgccaatcagtaggcgaatggctttggaaagaacgaggcctgcaaggcaagaaacgcaacaaatccggcgactacgagatatccatcccccgggacttcctcgttgaggaaatacagcgcatattcgaaacgcaacaaaaattcggatcgaccttcgccacgtcagagctccagaaagcatacacggacatcgccttctacgtcaaaccaatgcagagcatcgaagacatggtaggatactgcaccttctatcccaagattaagagcaaaaaccaagacggagagaaaagagcccccaaagcgtcgccgtcagcagaacaatttgtcatcctctctaaaatattcagcacaattgtcatagacgagaacaaacaggaaaagaaactaatcgaactgaagtcgatagagcagctcatccagatcgcaagatccaaagaaacactaaaatacaaacaactccgaaaagaactcaacctagcaaaagacatctcattcaagagcatctcggacgaggagaaaacctggatcaacttagtcggcaacgcaaagttcaagaaaatcctcggactgaactacgaaacgttcctgaaaaatacagagatatccgacgaaatcgcaaagatcctgacgtacgacaaaaccttcgaacaaaaagaaactaaactgaagaacctcctagtcaatatcgactggatcgacaacaaccacatcgcagaactggccaaactgagcttctcccaattcaaccaacttagcctcaaagcaatcaaaatcatctcgaaaatcatgatagaaggatacgcccgctacgacgaagccgtacaatacgcgtttgaaaataacctactccccaaaccaagccatgaaaaatcaatcctcctaccaccccttaaagagaccaacatcgccatcctcaaccccacagtgatcagagcattcgctcaattccggcaagtcgccaacgcccttgtaagcaagtacggctccttcgacaaagtacactttgagctagcaagagaggtaaacacaaaggaagaccgaaagaggtgggaaaaagatcgcgacaagaacgagaaaatgcaccgccagataaccgaaaagctcgtggaagagggcgtgaagccctcctacaaaaacatcctcaagagcaaactgcgctccgaacaaaaagacacgtgcccttactgccagaaaaacctccactaccccatgatattcgaagacggttacgcagagatagaccacatccttccactctcccaatcacaggacgactcttacgtaaacaaggtactcgtacacagcgcttgcaaccaaaataagaaaaaccgaaccccgttcgaatggttccaagacgagaaaaaggactgggacaccttcaaatcatatatcctaatggaatcaacgctaggcgagaaaaagagaaactacctgatcaaagaaaacttctccgatccccaatcccgaaaagagttcatatcacgcaacttgaacgacacaagatacatgtccaaagccatcaaaacctactgcgaaaaccactggaaactgtcccacgacgacgacaaactacgtatccaagtccgttcaggaaaactgacatccacccttcggcatcagtggggcctcgataataaaaaccgagaaacccacacgcatcacgcaatggacgcgatcatgatcgccttcagcacccaggggatggtcaagaaactctccgactacttcgctaagaaagaggccaaagtcgagaaagacaaacccgtactgatcaccccaatcaaacaattcaaagaagcagttgaacaagccaccaccctggaacgacaggaatcgatccagactaaggcaggagacaccatcacccttaaccgtctgctcatatccagaccaccacgagcaagcgtgaccggtgccgcgcacgaacagaccgcaaaaccctacccccgtatcaagcctatcaaaaacaaatacaagaggcgcagaatccccatagacgaagacaaattcgaactattccgcaacgacaaagttgcatcaggtaacgacaaaaacttctacaactcctcaaccatcccccgcgtggacatctacaagaaagacgacaaataccacgtggtcccaatctacctatcagacatgacgaaagccgaggtccctaacaaatcattaggaacaaacccggagggaatggacgagaagtatttctgcttcagcgtgttcaaaaacgacctaatagagctcgaaacaaaagcaaccccaaagaaaccctctaagaaactacttggatatttcaaacaattgaacggcgcaaacttcatactcaactccatacacaacggcataatcgacggctttgtatgcagccccataacactcttcaaacaacagaaagacatgtgcaagaaatgcctgccagaagaccgagcaataggaaactgcagccaggaaacgctagagttctgggaagccgaaaatataaaagtcccaaagaaggacttcgaatgcgaccaaggcattaaattcgccatagcagtccgaaaatataccatcgacccactaggctactatcacgaagtaaaaggcgaaaaattgctcggcaccataccgcagggggcaaagaaacacccaaaacgacaaaaatga

SEQ ID NO: 6109 - RNA, 3150 nt, synthetic construct
  misc_feature 1..3150: note = Cas9 variant
  source 1..3150: mol_type = other RNA
atgatcaacgaacggctaaccttcggaatcgacctaggaataggaagctgcggctgggcagtactccggcacgcagacgcggctggggagccaggagtaatagaaggactaggctcctggtgcttcgatgtccccgaaacaagcaaagaacgcatacccaccaaccaagtccgccgaagcaatcggctactccgtcgcgtaatcaggagaagaagaaaccgaatggccgaaataaggcgactattccacgcgcaagggctactgcccagcgcagacgaggatgcacttaaacgaccacgactcgacccgtgggaattaagagcacgcggactagaccagtgcctaagcgccgaagagttcgcagtagcactcggccacattgcacggcaccgtggcttccgaagctcggcaaaaagaaaagccgcgaacacctcaggggaagactccaaaatgctcagtgcactgctggtaactcgagaaagaacagcccgctacagaacagtcggcgaaatgttcgcccgcgaccccgaatatagcgcacgacgtcgaaaccgtgacggaatcttcgaccgcacagtcgcccgagacgacctcatacacgaagtgggaaaactgttcgaagcgcaacgagcccgaggatccgcattcgcgagcccggatctggaagcggacttcaacgcaatagcattcagacaggcagaaatgcaggacagtgaacgcctagtaggaaactgcccattcgaacgcgacgaaaaacgagcggcacgctgggcgccatcattcgaacgcttccgattactaactagactcataaacctaagaatagcgacagcagaaggagaacgacgctttacaccagaagacttagcaagagtcagcgcagaactcggagcaacagccaaactccccgtatcaagagtaagagcgctcatcggactcctacccgacgaacgcttcacaacgataagagtagaagacgaagacagagacatagtagcacgcaccggcgaagctgccccaggaacgtggagactaagaaagaccctcggcgaagccctctgggcggaaatgcaggcaaggccggaccaactcgacgccatagcacacgtgctcagcttcttcgaagcaacggccaaaattagaagtgaattggaccggctaggccttccagcggctgtaatagaagcactagataggggactagaagacggcgcgttcgcaaaattcaaaggcgcggggcacatatcagctaaggcatgccgaaacctgctgccccacctacaacaaggacaccgatacgaccaggcctgcagactcgcaggctacgaccacgcggcttccaccctgtcacatacagcacaagtagtaagcaaagcagggttcaacgccctcgtaacggaacttggcgaatcaatcgcgaacccaatagcacgaaaggccctaacagaggggctaaagcagatacgagccatgtgcgcaaggtggggcctgcctggggccatccatattgaactagccagggaagtagggaacagcatagagaaaaggagggagctcgagtcacagcgggaaactacaaccaaacgacgccaaacagaacgggacgaaatccgaggactcctggccctagaagatgtagacgacgatacattgctccgctatcgactctggaaagagcaaggcggaaaatgcctgtacaccggcaaggacatccacgtaaggcaactaatagcaaccgacaactccgtacaagtggaccacatattaccatggtccagattcggggacgacagcttcaacaacaaaacgctctgcctcgcatcagcaaaccagcggaaaagaggacaaacaccatgggagtggttctcactaaccggaacaccagaggcctgggaagtttttgcaagccgagtggaaaccagcaaggatctccggggatttaagaaacgaaacctcctcctgaaaaacgctgacgaggtagcccaaagattcagaagccgaaacctaaacgacacacgttacgccgcaagactactcgcagaggcggccaaactcttctacccagcgggagaccgacaagaaaaagacgggcgcagacgagtattaacacgacctggcccgctaaccgcagccctcaggcacgcgtggggactcgaaagcctgaagaaagcagacggcaaacgagtctccgatgaccggcaccacgcactagacgcactcgccgtagcagccatctcggaacgtgaagtacaacgcctgacaaggagcttccaagaatgggaacagcagggactggcacgaccactccgccacgtagccccaccatggcccggcttcagaggagacgtgctggccgcctatgcacaagccttcgtagccagaccagaaagaagacgtgcgcgcggaaaaggccacgacgcaagcataagacaagtcgtaggagagggacccgaagcacaagtattcgaacgtcgaggattagccgacctgaaagaggcagacctcgaccgcgtcaaagaccccgagagaaaccaagcaataatagaagccgtaagggcgtggatactcgccggaagacccgctgacgccccaccacgaagccccagaggagacgtaatagtcaaactcagaacagcgcctgcaaagaaaataaaacccgcagtccccgtaagaggcggcaccgcagacagaggagacatggtccgaatagacgtcttcacccgaccgaaccgcaaaggacgagacgaatggtacctagtacccatctacccacaccaagtgatgaatagaaaagcatggccccatcccccaatgagaagcgtggtggcgtacaaagacgaggcaggatggacagagattggcgccgaacacagcttccgatttagtctataccccagaagctacgtacagctagtcaaaagcaacggagatgtaatcgaaggatacctagtcagcatggaccgctcaactggcgcattcagagtcttcgtccacaacaacccagcagaaatggccaaaggaataggcgccaaaacactcctcaacctcagaaaattcaacgttgaccgattcggagtgcggaccgaagtcaagtcagaagttagaacttggcacggcgaagtatgcacatcaccagtcccacccgactga

SEQ ID NO: 6110 - RNA, 3150 nt, synthetic construct
  misc_feature 1..3150: note = Cas9 variant
  source 1..3150: mol_type = other RNA
atgcaactatccaaactcaactacatcctcggtctcgacctcggtatcgcaagcgtaggctggagcgtaatagaaattgacgaaactgaaatgccaatacgcctcatagacgtaggcgtccgaacgttcgaacgagcagaggtgcccaagaccggcgaatccctcgccctagcccgacgcctcgcacgctccacccgccgactcatacgccgccgcgccttccgcctcctaaaagccaaaagactcctcaaaaaccaccaaattgtaagcgccgacgaactatccacactccccaaccattgctgggaactccgcgtcaaaggactagacgagcgcctcacctgtcaagaatgggccgcagttctcctacacctactaaaacaccggggctatctgagccaacgcaaatccgaagctcaaaacgccgacaaagagatgggagcactactgagcggggtcgcgaacaaccacaaactattaagcgaaaaccattacagaacccccgccgagatagcagtaaagaaattcgcccttgaagaaggtcacatgcggaaccaacgcggagcctacacacacaccttcaaccggttagacctcctagcggaaatgcgcctcctgttccagacccaacgcgagcttggcagcccctacgcctccggagagctggaacaagaattttgtaaacttctgatgtggcagaaacctgcgctaagcggagacgccatcttaaaaatgctcggcaaatgcaccctcgagcccaccgaatacaaagcggccaaaaacacatacacagcagaacgcttcgtatggctcaccaagctcaacaacctacgaatccttgaaaacggatccgagcgggcgttgaacgcagacgagcgggccctactactcaaccaaccatatgaaaaggcgaagttcacctacgaacaagcccgcaaacttctccaactaaacgaagccgcaagattcaacagcgtgaggtacggcaaagaaaacgccgaaaaatcaactttaatggagatgaaagcctaccacgccatacgcaaagccgttgaaaccgccgactcatccgcatgggccacactaaagacgcagcccctactccttgacgagatcggtaccgcctttagcatctacaaaaccgatgaagacatcaaaacccaacttcaaggcaaactagcagacaacgtcatcgacgtgctactagaaaacctgaacttcgataaattcatacagctaagcctcaaggctctctacaaaatactccccctcatggagcagggcctccggtatgacgaggcgtgcagccaaatatacggggaccacttcggaaagaaggaacagaaaaacgaccgcctgttaccacaaatacccgcggacgagatccgaaaccctgtagtactacgaactctctcccaagcccgcaaagtcatcaacgccgtcatacgactctacggatcacccgccaggatccacatcgaaacagcacgtgaactaggaaaatcctataaagaccgtaaggaaatcgaaaagcggcaggagcaaaacagagctgaaagagaaaaagccgtcgacaagttcaaggaactcttccccaacttcataggagaaccaaaagctaaagacatactaaccatgcgtctctacgaacagcaaaatggtcagtgcctctacagtggaaaatcactcgatctccaccgtctcctcgagaaaggatacgtcgaaatcgatcatgcattgcccttcagccgcacatgggacgactcgttcaacaacaaagtcctagtcctcgccggtgaaaaccagaacaaatccaaccagacaccatttgaatggctaggcaaagatgaacaaaagtgggcgttgttcacggcaagagtcaacagttgcagattcccatattcaaagaaacaaagaatcctaaccaagaaactcgacgacgaaggcttcatccaacgaaacctaaacgacacccgctacattgcacgatttctagtcaatttcgtcaacgacaacctacacctgaccgggaaaggcaaacgcagagtattcgccagtaacggacaaatcaccgccttcctcaggggaaggtggggcctaacaaaagtccgagaagaatcagaccgccaccacgcgctcgacgccgtcgtagtggcgtgcagtacagtctcaattcaacagaaaatcaccaggttcgtcaaataccaagagggcaacctgcaaaccgccgaacgaatcgaccgggaaaccggcgaaatcatccccctacacttcccagacccctgggccttcttccgcgaggaagtcatgatccgaatcttctccgaaatgccccaagaagacctcgtaatcaaacttccagaccgaccacaggccaaccacgagttcgttcaacccctattcgtatcccgcatgccaacacgcaaaatgtccggacaaggacacatggaaaccataaaatccgccaagcgcctcgacgaaggaattagtgtctctaaagtccctctaacccaactaaaactaaaagacctagaaaacatggtgaaccgggacagggagatcgccttatatgaagccctgaaggcccgactcaccgagttcaaagatgacccagccaaggccttcgccgaaccgttctataaaaagggaggtgttcaagtgaaaagcgtccgtgtcgaacaagtccagaaaagcggagtcgtggtccgcaacggaaacggggtcgcagacaacgcaagtatggtacgagtagacgtctttataaaaggaggaaaatactttctcgtaccgatatacacctggcaagtcgctaaaggcatcctacccgaccgcgcagtcatagcctacacccctgaaaacgaatgggagctcatggacgacagcgcacaattccaattctcaatctaccccaacgacctaataaaacttaccactaaaaaggccatcttcttcggttactattcaggcttcaaccgcctcacaggcgctatcaatatcaaagagcacgacctccaaatctcaaagggagacaaaggggtgcacctaggactcggcgtaaaattggctctgagcctcgaaaaataccaggtcgacgaactagggaaaaacattcgcccatgccgtcccacacaacgacaaaacgtccgctga

SEQ ID NO: 6111 - RNA, 3153 nt, synthetic construct
  misc_feature 1..3153: note = Cas9 variant
  source 1..3153: mol_type = other RNA
atgtcgtcatacaggtttagcttcgacctaggcacgaactcaatcggctgggcggtattcgaactcgaccccaaaacccgacccgtagcgctcgcggactgcggagtccgcatattcccagacggccgaaacccaaaggacaaacaatcccttgctgtagcccgccgagaggcaagagccgtcaggcgacgccgcgaccgctacctcaaacgacgatcagagctaatggagagacttgtcgccaagggactcatgcccgaaagtcgcgacgaccaaaaggccctagaaggactcgacccctacgcactaagagccgcaggcctggacgacgccctcccgccccaccacttcggcagagccctgttccacctcaaccagcgcagaggattcaagtccaacagaaaaacggatagaggagaaaacagcgaaacaggcatcacaaagatcggcatgaagaaactacacgaggcattactaagcgagggctgtcgaacactaggggaacttcaacacagacaccacgaggccaaccaaacacccgccatggacactaacccgaaaagcgttcgcagcaagctccgtggcgaaggtgcaaaagcagtctacgacttttatccatcccgcgacgcagttgaggacgagttcaacaaactgtgggactcccaaaaacgcttccaccccgacctactcaccgacagcgcacgcgacgcaataagggatgcaatattctaccaacgcaaattgaaaacgcccgacgcagggcggtgctccttcaacccagcagaagagagagtagcaagagccatgcccatagcgcagcacttcaggatactccaattcgtaggagacctccgcctgatagacaacgaccttgtaagacaccccctcaacaacgatcaaaagaaagcactataccgcgacctcctagcaaaagggaaactcaccttcaaagcaatgaggaaaacaataggcatcggaagcgaatacgcattctcccacgaatccgaaaaacaaagcgagttccgaggagacgaaacagccgcccgcctggcaggccccaaatacttcggcccgaaatggagagaactgtccttcaacgaccaaagtgaaatcgtagaccgactcctacacgaggaaaacgaagaaacgctgatacagtacctccaggacagattcggcttcgaccacgaccgatgcgaggtaatagccgacgcacccctaccggacggacacactcggctaggcaagacagccctagaaactctagtagagataatgcgagatgaccacctaccatacgaccaagcctgcaccaaagcaggatacgaacacgccctgccaccagatggggtaatactcgatgacctcccatattacggaattgcgctagagagacacgtggccttcggagacggaaaatccgaaaacccagaaaaacggtatggaaaaatagccaacccaactgtccatatagccctcaaccaactacgaaaagtcataaacgctctcatagcccgatacggtcacccagaccaagtcgtaatggaaatagcccgggaccttaaacagagcaaagccaaaagggatgacatcagcaaagagcaaaagaagaaccaagacagaaacgaccaacgcaggaagaaactacaagaagcacacatcgccgtcaacgctgaaaacatgctgcgcatgcgcctatgggaggaactggatgaagacaacgcagcagcgcgagcttgccccttcaccggagagacaatctcaatggctcggttattcagccctgaagtagaaatcgaacacatactaccattctcgcgaagcctggacaacagcccagcaaacaaaacactatgcatggtctgggccaaccgggcgaaaggaaacagaacaccatgggaagcctttggccgcgaccgcgagcccggattcgactggcccgaaatcgccgccagagcagcacgactccccaaaaacaaatcatggagattcggtccagacgccatggagagattggaacgagaaggagacttccttgacagacaactgacagatactcaatacctatccagaattgcacgtgaatatgttacaaaaatctgcgatccaaaccaagtgtgggtaacaccaggaagactaacagcctggctcaggcgcaactggggcctaaatggaatactccccaccggcaacgccacaaagaaccgcgacgaccatcgtcaccatgcaatagacgcgattgtagtaggactcacagaccggggaatactcaaccgagtcagccgaagtgcagccctagcagaagcagaggacctggaccgaagcatcgccgaaatgccagaccccttcgacggattccgcgacaacatccgccacatcttagagcaaatcatagtatcccacaagcccgacgccggatttgttccaggtcatccaaaaggaaatacaaccccgggcgccctacacaacgacaccgcatacgggataataaaaaccgacgcgaaaggcatgtctgaagtagtcacaaggaaggatgtactgtcgttcaagggcacaaaagagatagagagcatccgcgacgccgccacccgacaatcccttttagacgccgtagcaggagtacccagcggactggcattcaaagaagccctgcgcgactggagcgtcagaacaggtacaaaacgagttagagtgacatttaacatgagcgtcataccgatccaggacagagacggaaaggcatacaagggctacaaaggggacggcaatctgtgcgccgaaatatacgaacgtccagacggcaaatggggcgacgaaatcatatcccgctttgacgcagtacaaccaggcttcaccccacagtggcaacgagaccatccagcagcgcaccgggtaatgcgcctattcagggatgacatgataatggcggaaatagacggtgtaatgactgtgtgccgaatagtaaaaatgagccctggtaaagtagtattcacaccacaccacgaggcaaacacagatagcagaaacagggacaaagacgacccattctcattccacacatgctctggagaaagcctccggaaacgaaaagcccaaaaactattcgtagacccgctcggaaaaataagagggtacagagcaaaggaaggctga

SEQ ID NO: 6112 - RNA, 3153 nt, synthetic construct
  misc_feature 1..3153: note = Cas9 variant
  source 1..3153: mol_type = other RNA
atgggcgaaaacatgatcgacgaatccctaacattcggaatagatctagggatcgggagttgtggatgggcagtgctgcggcgaccctcagccttcggcaggaaaggagtcatagaaggtatggggtcctggtgttttgacgtccccgaaacaagcaaagaacgaacaccaacaaaccaaatccgcaggagcaatcgactgctcaggcgagtaatcaggaggcgacgcaacaggatggccgcaataagacgactactacacgccgcaggcctcctacccagcacggactcggacgccctgaaacgacccggccacgacccatgggagctcagagcccgagggcttgacaaaccattaaagcccgtcgagttcgcagttgtcctcggacacatagcaaagcgacgaggcttcaaaagcgctgcaaagagaaaggccacaaacatcagctcggacgacaagaaaatgctcacggcactcgaagcgaccagagaaagactaggaagataccgaacggtcggagagatgttcgccagagaccccgacttcgcatccagaagaagaaacagagaaggaaaatacgaccgaacaacagcaagggacgaccttgaacacgaagtccacgcactattcgcggcgcagcgacgactcggacaaggctttgccagccctgaacttgaagaggcatttacagcatcagcattccaccaacgacccatgcaagactccgaacgattagtcgggttctgtcccttcgaaagaaccgagaaacgtgccgcaaaactaactcccagcttcgaaaggttcagactattagctcgcctacttaacctacgcataacaacaccagacggagaacgcccactcacggttgacgaaatagcattagtcacacgagatctcggaaagaccgccaaactgtcaatcaaacgagtacgcacactaattggactggaagacaaccaacgcttcactacaattaggcccgaagatgaagaccgagacatagtggcacgcaccggaggagcaatgacaggaaccgccacacttcggaaagccctcggcgaagccctatggacagacatgcaagaacgcccagaacaactcgatgcaatcgtccaggtcctgagcttcttcgaagccaacgagaccatcacggaaaaactcagagaaataggactgaccctagccgtgctagacgtactactgaccgcgttggacgctggcgtattcgccaaattcaaaggagccgcacacatcagcacaaaagcagcacgaaacctgctaccacatctagaacaaggacggcggtacgacgaggcctgcaccatggcgggctacgaccacgcagcatcgaggctctctcaccacggacaaatagtagcgaaaacacaattcaacgcgctagtcaccgaaatcggggaaagcatcgccaacccaatagcacgcaaggcactaatagaaggactaaagcaaatatgggccatgcgtaaccactggggactcccaggaagcatccacgtcgaattagcaagggacgtcggaaacagcatcgaaaaacggagagaaatcgaaaaacatatcgaaaagaacacagcattacgtgcccgcgagcgccgcgaagtacacgacctcttagatctagaagacgtcaacggagacaccctgctaagatacagactctggaaagaacagggtggcaaatgcctgtacacgggaaaagccatacacatccgacagatcgcggcaaccgacaactcagtacaagtagatcacatactcccatggtccagattcggagacgactccttcaacaacaaaaccctatgcttagcatccgcaaaccaacaaaagaaacgaagtacgccctacgaatggctatcaggccaaacaggggacgcctggaatgcattcgtacaacgcatcgagactaacaaagagctccgcggattcaagaaaaggaactacttactaaagaacgccaaagaagcggaagaaaaatttcgaagcagaaacctgaacgacacaagatacgcggcccgactattcgcagaagcagtcaaactactatacgcattcggagaaaggcaagaaaaagggggaaaccgccgagtgttcaccagaccaggggcactcaccgcagccctacgccaagcctggggcgtagaaagtctaaagaaacaggatggcaaaagaataaacgacgaccgccaccacgcactagacgcactaaccgtggctgcagtggacgaagcagaaatacaacgtctcaccaaaagtttccacgagtgggagcaacaagggctagggcgcccactcagaagggttgaaccaccatgggaatcatttagggcagacgtagaggcaacataccccgaagtattcgtagctcgacctgagaggcgccgagctagaggggaaggccacgccgcaaccataaggcaagtgaaagaacgcgagtgcacccccatagtgttcgaacggaaagcagtgtccagcctcaaggaagcagacctcgaaagaataaaagacggcgaacgaaacgaagcaatcgtggaagccatacggtcctggatagccacaggacgcccagccgatgcaccaccaagaagccccagaggagacatcatcaccaaaatccgcctagccacaaccataaaagcagccgtgccagtgcgcggtggaaccgcaggaagaggagagatggtacgcgctgacgtcttctcgaaaccgaaccgccgaggcaaagacgaatggtacctggttcctgtttacccacatcagataatgaacaggaaggcgtggcccaaaccaccaatgcgaagcatagtcgcaaacaaagacgaagacgaatggacagaagtggggcccgaacaccagttcagatttagcctttatccacgctccaatatcgaaataatacgcccgtcaggggaggtcatcgaaggatactttgtcggcctacaccgaaacacaggtgcgctcacaataagtgcacacaatgatcccaaatccatacactcagggataggtacaaagacactcctcgcaataagtaaataccaagtggacagattcggaagaaagtcacccgtaagaaaggaggtcagaacatggcacggcgaagcgtgcatcagcccaacacccccgggatga

SEQ ID NO: 6113 - RNA, 3153 nt, synthetic construct
  misc_feature 1..3153: note = Cas9 variant
  source 1..3153: mol_type = other RNA
atgaaaatcctagggttcgacatcggaatcgcgagcatagggtgggcattcgtagaaaacggagagcttaaagattgcggagtccgcatattcacaaaagccgagaatccaaagaccggtgactcactcgctatgccccgacgtgaagcccgctccgtccgccgacgactggcccgccgaaagggccgcctagaaacattaaagcgactcctcgctaaagagtgggatctatgctacgaagactacatcgctgccgacggcgaactcccaaaagccttcatgggcaagaacttgaacaacccctatgtgctacgctacgaggcactacaaaggcttttatccaaagaggagctagtccgcgtagtgctccacatagccaaacacagaggctacgggaacaagaacgccaaaataaccaagagcgaggaaagcaaacgcgagcaaggcaaaatcctctccgcactagccaccaatgcctccgcgatcgccaggtacagaacagtgggcgaatacttctacaaagagttctgtgaagtaatcaagaacccccaaggcctcagcaccaacgaacactatacacaaagcaaagtccgcgtcctcaaacctatcaggaacaagggcggagagtatacaaactgcatcctccaagaggacctccaacgagagctccgctgcatattcgaatatcagaaaggcttcggattccccataacccaggagttccaagataagattctcaagatcgccttctaccaacgcccgttaaaagacttctcccatctagtcggaaagtgcacattctacccagacgaatttcgggcgctgaaatgctcgctctccgccgtagagttcatcaccctctccaaaactatcaacgtactcacatatatatcgaaagaatcaggggaagtgtacagtaaaggccaatacgaacagatgctagactccgtattcaaggcagtctgcgaaaaaggcagccttagtttcgcgcaactccgcaaaatcctgcacatagacgaacgaatccgcttcaaagaagttgactacatggcccgcaaaagcaagaacacaagcggagacagcacccacaagcagaaaaccagcaaccccgaaacaaagaaattcattgaacacaaaaacctcaagaaattctgcgaaattctctcagaaatcgccgaagaccgagccctcgccgacagtatcgccagagacatgaccctaatcaaagacgaagaaaaactagctcaaaaactacacggctacgggaaattcagccaggaacagatcacacaactcagcgccctcaacttctcccaccacatcaacctctccctcaaagccctgagtgaaatactcccctttatgcgcgaaggcatgcgatacgatgaagcatgcaaacttgccggcctcaaggcacggcacaacgacaagaaaagcaaattcctcccacctttctgcgaaagcatttatgcagatgagctaacaaaccccgtcgtacaccgggccatcgcagaatacagaaaaatcctcaacgccttaatcgctaaatacgggtccgtccacaaaatccacatcgagctaaccagagacgtcggcaaaaacttccaagaaagagagaaatacaagaaagagatcgagtcaaactacaaagcgcgagtacaagccatgcaggaatgcgagaaactaggcctcacactgagtgagggaaacatcctaaaactacgcctcttccgagaacaaaacgaaatctgtgtatattcaggccgcaaaataaccctggccaacctcaaagaacaaggagccctggaaatagaccacatactcccatacagccgctcaagcgacgactcttacatgaacaaagtgctagtgtttaccaacgaaaaccagaacaaaggaaacaaaaccccatacgaggcattcggcggagacagccagaaatggggagagatagagagcctagccctcagatccggataccccaagaagaaagccaaacgtatcctcgacaaaggcttcggggacagggaagccggattcaaatcacggaacatcgtagacagcggctacatcgcgcgactaatcgccaactacacaaaagaatatctcaaattcctaccactagacagccacgaaaacaccgccctgattgccggtgaaaaagattccaaaatccacgtcgaagcagtcaagggcatgctcactgcgacaatgaggcacttctgggggctcggctccaaaaaccgctacgaacacacacaccacgccgtcgacgccattatcatcgcatatatcaatgccgccatgatacagcgattctcccagttcagacaaaaccaagagtcactaaaggccagattctatgccaaagaactagcaaaagaagagttcaagacccaacgagctttcttcgaacctttcagagggttccgagaacaagtactcgccaaagtcgggcagatcttcgtctcgcgtcccccgcgcaagcgcgcccgcggcgcactacacgaggagaccttctactccatcgacgataagaaactgagcgagacttacgggggcaaagaaggcgtacaacgcgcgctcagcctgggcaagatacgccaaattggtactaagatagtcgcaaacggccccatggtgagggtcgacatattcaaacacaaacagtcccggcgattctacgcagtgcccatctacaccatggacttcgccctcggaatactaccaaacaaagcagtggtatcaggaaaggacaccaaatccaaagtcatcaaagactggttagagatggatagctgctacgagttttgctttagcctattcaaagacgacctgatcgaagtccaaaaatctgacatggagaagcccgagctcgcctacttcgtatcactcgatgcatccgacggcagaattaaagtacgccaccactgcaacgacatcacaaaaatcaacgagaaccagaaaaagctattctcagaagcaatcgagaaagaggttgtcggccgaggatcaatccaaaacctcaaagtcttcaaaaagtacaaagtaagccccctgggagaaataaaagaagccaaatacgagccccgacaacccatcgccctcaagacgtcgccaaagaagcaccgaaagcagaacaacgcacagtga

SEQ ID NO: 6114 - RNA, 3156 nt, synthetic construct
  misc_feature 1..3156: note = Cas9 variant
  source 1..3156: mol_type = other RNA
atgaacaactacatactgggtctcgacattggcattacaagtgtgggatacggaatagtcgactccgacacgagggagatcaaagacgccggcgttcgcctcttccccgaagccaatgttgacaacaacgagggcaggcgctctaaacgcggggcccgccgcctcaaacgaagacgtattcaccgcctagaccgcgtcaaacacctactcgcagaatacgacctcctcgacctcacgaacatacccaagagcaccaacccgtatcaaacaagagtcaagggactcaacgaaaaactcagcaaagatgaactcgtcattgcactcctgcacatcgccaagcgccgcggcatccacaacgtcaacgtcatgatggacgacaatgattcggggaacgaactgtcaaccaaggaccaactcaagaaaaacgccaaagcgctttccgataaatacgtctgcgaactccaactggaacgcttcgaacaggactacaaagtccgcggggagaaaaaccggttcaaaacagaggacttcgtcagggaagcccggaagctactagaaacgcaatcgaaattcttcgaaatcgaccagaccttcatcatgcggtacatcgagctaatcgaaacgcgacgtgagtacttcgaaggcccgggcaaaggatcaccgttcggatgggagggcaacatcaagaaatggttcgaacaaatgatgggccactgcacgtacttcccggaggaactccgcagcgtgaaatacagctactccgccgaattattcaacgccctcaacgacctcaacaacctcgtcatcacccgcgacgaagacgccaaactcaactacggagagaaattccaaatcatcgaaaacgtattcaaacaaaagaaaacccccaatctaaaacagatagctattgaaatcggcgttcacgaaactgaaataaaaggatacagagttaacaagtcaggcaagccagagttcacccaattcaagctataccacgacctcaaaaacatcttcaaagatcccaaatacctaaacgacatacaactaatggacaacatcgccgaaatcatcaccatctatcaagacgccgaatcaataatcaaagagctcaaccaactaccagaactactatccgaaagagaaaaagaaaagataagtgctctctcagggtactcgggtacacacaggctctcactcaagtgcatcaacttgctgctcgacgacctctgggagtccagcctaaaccagatggagctattcacgaaactcaacctcaagcccaagaagatcgacctatcgcagcaacacaaaatcccaagcaaactcgtagacgacttcatcctatccccggtcgtcaaaagagccttcatccaatccatacaggttgtaaacgccatcatagacaaatacggcctgcccgaagacataatcatcgaactcgcgcgcgagaacaactctgacgaccgccgcaaattcctaaaccaactccaaaaacaaaatgaagaaacgcgcaaacaggtagagaaggtactacgcgaatatggcaacgacaatgcaaaacgaatcgttcagaaaataaaactccataacatgcaagaaggcaaatgcctatattcactaaaggacatcccactagaagatctcctccgcaacccacaccattacgaggtcgaccacataatcccgcggtccgtagccttcgacaactcaatgcacaacaaggtactcgtccgcgcagacgagaacagcaagaaaggcaaccgaaccccgtaccaatacctaaactcctcggaatcatcactctcgtacaacgagttcaaacaacatatcctaaacctctcgaaaacgaaggacagaatcacgaaaaagaaacgcgaatacctcctcgaagaaagagacatcaacaaattcgatgtacaaaaagagttcatcaaccggaatctagtggacacgcgctatgccacacgtgagctcaccagccttctcaaagcctacttctccgccaacaacctcgacgtcaaagtgaaaacaataaacggaagttttaccaactacctccggaaagtctggaagttcgacaaagaccgaaacaagggatacaaacaccacgctgaagacgccctcataatcgcaaacgccgacttcctattcaagcacaacaagaaactccgaaatatcaacaaagtcctagacgccccctccaaagaggtcgacaagaaacgagtcacagtccaatccgaggatgaatacaaccaaatcttcgaagacacccaaaaagcccaagcaatcaagaaattcgagatacgcaaattctcccacagagtcgacaagaaaccaaacagacaactgatcaacgataccctatattccacacgcaacatcgacggcatcgaatacgttgtcgaatcaatcaaagacatttactccgtcaacaacgacaaagtgaaaacaaaatttaagaaagacccacaccggctactcatgtaccggaacgacccacaaaccttcgagaaattcgaaaaggtgttcaaacagtatgaatcagaaaagaacccattcgcgaagtactacgaagaaaccggagaaaagatccgaaaattcagcaaaactggtcaaggaccttatatcaataaaataaaatatttacgagaacggctaggcagacattgcgacgtgaccaacaagtacataaacagccgaaacaaaatcgtgcaactaaagatctacagctaccggttcgacatatatcaatacggcaacaactacaagatgatcaccatctcctacatcgacctagaacagaaatccaactactactacataagtagagaaaagtatgaacaaaagaagaaagacaaacagatagacgacagctacaaattcatcgggagcttttacaaaaacgacattataaactacaacggagaaatgtaccgtgtaatcggcgttaatgattcggaaaagaacaagattcaactagacatgatagacatatctatcaaagactacatggagcttaacaacatcaaaaagacaggcgttatatacaaaaccataggcaaatcgaccactcatatcgaaaaatacaccacggacatcctcggcaacctctacaaggctgccccacccaagaaacctcagcttatatttaaatga

SEQ ID NO: 6115 - RNA, 3159 nt, synthetic construct
  misc_feature 1..3159: note = Cas9 variant
  source 1..3159: mol_type = other RNA
atggaaaacaaaaatttgcactacatcctcggcctggacctaggaatagccagcgtcggctgggccgtagtcgaaatagacgagaaagagaaccccctccggctaatagacgtaggcgtccgtaccttcgagcgcgccgagacccaaaaaggcgagtcactcgcactcagcaggcgctcagcccgatccgcaagacgacttacacaaaggcgcgtagcccggctcaaaaaggcgaaacgtttactgaaatcagaaaatatcctgctctcaacagacgagagactaccccaccaggtatggcaactccgagtcgagggactcgaccgcaagctggaacgacaggagtgggcagcagtcctactccatctcataaaacaccgcgggtacctctcccaacgcaaaaacgaaagcaaaagcgaaaacaaagaactaggcgcactactatccggagtcgcctcaaaccacgagttattacagcaagcaacatacaggacccctgcagaactggccgtcaaaaagttcgaagttgaagagggtcacatccgaaaccaacagggagcttatacccacacattcagtcggctagacctactcgcagaaatggagctcctcttctcccgccaacaacacttcgggaaccccttcgccagcgagaaactcctggaaaacctaaccgccctcctcatgtggcagaaacccgccctctcaggcgaagatattctcaaaatgcttggcaaatgtacattcgaagacgaatacaaagcggctaaaaatacttataccgcagaaaggttcgtttggatcaccaaactcaataacctacggatacaagaaaacgggctagaacgagcgctcagtgacaacgaacggctaatgctcatagaacaaccctacgaaaaagccaagctgacatacgcccaagtccgatcgatcctcaacctctcggacgatgccatattcaaaggcgtccgctactcgggagaggataagaaggccatcgaaacaaaaaccacactcatggagatgaaagcctatcaccaaatacgcaaagttctagaaggcaataatctcaaggctgagtgggtagccctaaaagcgaacccgaccctcctagacgaaataggcaccgcctttagtttgtacaaaacagacgaagacataagcgcatacctagcagggaagctctcacaacctgtcctcaacgccctcctggaaaacctgagtttcgacaaattcatacaactgtcgctaaaggccctctacaagctcctacccctgatgcagcaaggtctcaggtacgacgaagcctgcagggagatatacggagaccactacggtaaaaagaccgaggaaacacaccactttctcccccaaatccccgccgacgagatacggaaccctgtagtactccgcacactcacccaagcccgcaaggtcataaacggagtcgtacgcctctacggctcaccggcacggatccacatagagaccggcagggaggtaggaaaaagctacaaagaccggcacgaactaaagaaacgccaagaagaaaaccgaaaacagagggagaagaccataagcgaaatcaagacactcttcccaaacttcagcggcgaaccgaaaggcaaggacatactgaaaatgcgcctctactaccaacagaacgccaaatgcttatactccgggaaaccgctcgaactccatcgccttttcgagcaaaagtacgtcgaagtggaccatgccctaccccttagccgcacgtgggacgattccttcaacaacaaggtactggtactcgcgaatgaaaaccagaataaaggaaacctgacacccttcgaatggctcgatggcaaaaacaactccgaacgatggagaacattcaaggccttagtcgaaacatcggcattcccctacgcaaagaaacagcggatactatcacaaaaactcgacgaaaagggattcatcgaacgaaacctcaacgacacacgctacgtagcacgcttcctgtgcaactttatcgcagacaacatgcatctcaccggagaaggcaaacgcaaggtattcgcaagcaacggccagataaccgcgctgctgagacgccgctggggcctggcaaaaagcagagaagataacgaccgccaccacgcactagacgcagtcctcgtagcctgcagcaccgtagccatgcagcagaaaatcacgaggttcgtacggttcaaagctggagacgtcttcaccggagaacgcatcgacagagaaacaggagaaatcatacctcttcacttccctacaccatggcaattctttaagcaagaagtcgagatacgcatcttcagcgacaaccccaagctcgagctagaaaaccgcctgccggaccggccacaagcaaaccacgagttcgtccaaccactgtttgtaagcagaatgccaacccgaaaaatgacaggacaaggccacatggaaaccgtcaaaagcgccaaacggctcaacgaagggatctcaatgatcaaaatgcccctaaccaagctcaaactaaaagatctcgaactaatggtcaaccgcgaacgcgaaaaagacctatacgacgccctcaaaacacggctcgaagcattcaacgacgaccccgccaaagcattcgcagaaccattcatgaaaaagggtggtgccatcgtaaaaagcgtccgcgtagaacaagtacaaaaatcaggcgtcctcgtacgccaaggcaacggcgtagctgacaacgcgagcatggtaagggtagacgtcttcaccaaggatggtaaatacttcctagtgccgatctacacatggcaagtcgcaaaagggatcctgccgaacaaagcagtgatacaaggaaaagacgaagaggactgggaggacatcgacgacgcaacattccagttctcactccaccccaacgacctcatctcagtcaagaccaagaaagacgagttcctcggatatttcaacggtctaaaccgacacacaggcggaattaacatccgcacccacgacctagaaaaatcaaaaggaaaacaaggcatattcgaaggaatcggcgtaaaaatagctctctcattcgaaaaataccagattgatgaattgggcaaaaacatccggctgtgcaagcccagcaaacgccaacccgtccgatga

SEQ ID NO: 6116 - RNA, 3159 nt, synthetic construct
  misc_feature 1..3159: note = Cas9 variant
  source 1..3159: mol_type = other RNA
atgaaaaacacgtcactcaattacgttctgggactcgacctcggaataagctcagtgggatgggcagtagtcgaaattgacgaaaaggaaaatcccctatccctaatcgacgtaggagtacgaacgttcgaacgcgcggagacccaaaagggcgaaagcctagccctcgccagaagactcgcacgcagcgcccgcaggctcacccaacgacgcgtagcaagactgaagaaggcaaaacgcctccttaaatccgagaacatcctcctgagtaccgacgaatgccttccgcaccaagtatggcaactcagggtagagggtctcgaacgcaagctcgaacggcaagaatgggccgccgtgctgctccacctcataaaacaccggggatacctctcccagcgtaaaaacgaaagcaaatccgagaacaaagaactcggcgcactcctatccggggtcgcaaacaaccacaagctcctccaacaaacaacctacaggacaccagccgaactagccgtcaagaaattcgaagtcgaagaaggacacatccgcaaccaacaaggatcctacacgcacacgttcagccgacttgacttgctgtccgaaatggaactcctattctcgaggcagcaacacttcggaaacccattcacctccgaaaaactactcgaaaacctgacagcactcctaatgtggcaaaaacctgcactcagcggggacgccatccttaaaatgctcggaaaatgcactttcgaaaacgaatacaaagcagcaaaacacacatactcagcagaacgattcatctggataacaaagctcaacaacctccgaatacaagaaaacggattagaaagagcactcaatgataacgaacgcctcgcactaatgaagcaaccctacgaaaaagcaaagctaacgtacgcccaagtacgcagcatcctcaacttatccgacgaagcgatattcaaaggactacggtacagcggcgaagacaagaagacgagcgagaccaagaccgtgctaatggaaatgaaagcataccaccaaatccgcctagccctcgaaaagaacgacctgaaaaccgaatgggccgaactcaaagtcaactcgtcattactcgacgaaataggcacagccttctcactgtataaaaccgacgaagatatcagcacctgtctagcgggcaaactatcccaaccagtgttaaacgcacttctagaaaaccttaacttcgacaaattcattcaactctctctaaaggccctacacaagatactgccgctcatgcaacagggactccgatacgacgaagcatgcgcagaaatatacggcgaccactacgggaagaaaaccgaagaaaaccatcttctgctcccacaaattccagcagacgaaatccgcaacccggttgtcctacggaccctaactcaagcacgaaaggtaatcaacggagtcgtgagactgtacagctcaccagcaaggatccatatcgaaactggacgagaggtaggaaagagctatcaggaccgtagagagctagaaaagcgccaagaagaaaaccggaagcagcgcgaaaaagccatcagcgagataaaaaccctcttcccaaacttctcgggggagccaaaagccaaagacatcttaaaaatgcgtctgtactaccaacaaaacgctaaatgcctatatagcggaaagcccctagaactccaccgtctccttgaacaaggatacgtagaaatagaccacgccctgcccttcagccgaacatgggatgacagcttcaacaacaaagtcctcgtcctagccaacgagaaccaaaacaagggaaacctcacaccttttgaatggctggacggcaaaaacaacagcgaacgatggaaggccttcaaggccctagtcgaaacatccgccttcccctacaccaagaaacaacgcatcctatcccagaaactcgatgaaaagggcttcatcgaacgcaacctcaacgacacacgatatgtagcgcgtttcctgtgcaacttcatagcggacaacatgcacctcacgggggaaggaaaacgcaaagtttttgcctccaacggccaaataacggcgctcctacgcggcagatggggactcgctaaatccagagaggacaacgacagacatcacgccctcgacgcagtagtggtggcctgcagtaccgtgtctatgcaacagaagatcacgcgttttgtcagattcgaagaaggcaacgtcttcacgggcgagcgcatcgaccgcgaaacaggcgaaatcataccgctgcacttccccgccccgtggaaattcttccgtgaagaagtggaaatacgaatcttcagcgataaccccaagctagagctggagaaccgactgatcgcacgcccccaagcgaaccacgagttcgtacagccactattcgtcagccgcatgcccaccagaaagatgacaggccagggccatatggaaaccataaaatcagcaaaaagactaaacgaaggactcagtgtgataaaaatgctcctgacgaagctccggctcaaagacctcgaaagcatggtaaatcgagaaagagaaaaagaactgtacgaagccctcaaagcgcgcctcgaagcgttcaacgacgaacccgccaaagccttcgccgaacccttcatgaagaaaggcggagctatcgtcaaaagcgtgcgagtcgaacaggtccagaaatccggcgtcctcgtgagggacggcaatggcgtggccgacaacgcaagcatggtacgggtggacgtattcacaaaagggggaaaatacttcttggtacccatatacacctggcaggtagcaaaaggcatcctaccaaacaaagctgtgatacaaggtaaaaacgaagaagactgggaagttatggacgacgcaacattccgcttcagcctacaccaaaacgacctagtcaagctggtgacaaagaagaaaacaatattcggctacttcaacggcctaaaccgtgcaacagggaatatagacataaaagaacacgacctagagaaaagcaaagtgaaggatggaatccaccaaagcataggaatcaaactggccctatccttcgaaaaataccaagtcgacgaactgggcaaaaacatacgcctatgcaaaagcagcaagcgacaagccgtccggtga

SEQ ID NO: 6117 - RNA, 3159 nt, synthetic construct
  misc_feature 1..3159: note = Cas9 variant
  source 1..3159: mol_type = other RNA
atgataggcgaacacgtccgcggaggctgcctgttcgacgaccactggaccccaaactggggagcgtttagactcccgaacaccgtcagaacattcactaaggccgaaaacccaaaagacggaagctccctagcggaaccacgccgacaagcgagaggactacgaaggcgactacgccgaaaaacgcaacgactagaagacctgagacgcctacttgcaaaagagggagtactaagcctcagcgacctcgaaacactattccgagaaacacccgcaaaagacccttaccaactacgcgcagaaggcctcgaccgcccactgtcgttccccgaatgggtaagagtcctataccacataacgaaacaccgaggatttcaatccaaccgacgtaaccccgtcgaggacggacaggaacgctcacgccaggaagaagaaggaaagctattaagtggggtaggcgaaaacgaacgtctactccgtgaaggaggatacaggacagccggcgaaatgctagcaagagaccctaaattccaagaccaccgacgtaaccgggccggagactactcgcacacactaagccggtccctactgttagaagaagcacgaaggctctttcaatcccaaagaacactaggcaaccctcacgcgtccagcaacctagaggaagcatttctacacctcgtcgccttccaaaatccgttcgcctccggagaagacataagaaacaaagccggacactgtagcctagaaccggaccaaatacgcgcaccaagaagatctgcctccgcagagacgttcatgctcctacagaaaacgggcaacctacgcctcatccacagacgaacaggggaagaacggccactgacggataaggaacgagaacaaatccacctactcgcgtggaaacaagaaaaagtgacccataaaacactacggcgacacctcgaaatcccagaagagtggctattcacgggactaccataccacagatctggcgacaaagcagaggaaaaactattcgtccacttagcgggcattcacgagatccggaaagcccttgacaaagggcccgacccagccgtctgggacacgctacgatcgagacgagacctactggactccatcgccgacaccctcacattctacaaaaacgaggacgaaatactcccccgactagaaagcctcggactaagcccagaaaacgctagagccctagcaccccttagcttcagcggcactgcgcacctatccctatccgccctaggtaagctgctcccccacctagaagaaggaaaatcatacacacaagcccgcgccgacgccggctacgccgccccaccgcccgaccggcaccccaaactacctcccctcgaagaagccgactggcggaatcccgtcgtattccgcgcacttacacaaacccgcaaagtcgtcaacgccctagtcagacggtacggcccaccatggtgcatccatctcgaaaccgctcgagaactgtctcaacccgcaaaggtacgaaggcgcatcgaaacagaacaacaagctaacgaaaagaagaaacaacaagccgagcgagaatttttagacatagtaggaacagccccagggccgggggacctcctcaaaatgcgcctatggcgagaacaaggaggtttttgcccctactgcgaagaatacctcaatccaacccggctcgccgaaccgggatacgcagaaatggaccacatccttccatacagtagatcactcgacaacgggtggcataacagagtcctcgtgcacggaaaagacaaccgcgataagggaaaccgcaccccgttcgaggcattcggaggagataccgcacgctgggaccggctggtcgcttgggtgcaagcaagccacctaagcgcacccaaaaagcgcaatttattaagggaagacttcggcgaggaagcagaacgcgagctaaaagaccgcaacctcactgacacgagattcatcaccaagaccgcggccaccctcctacgggaccgtctcaccttccaccccgaagccccgaaagacccggtaatgacactaaacggaagactcacagccttcctccgaaaacaatggggcctacacaaaaacagaaagaacggcgacctgcaccacgcactcgacgccgccgtcctagccgtagcgtcccgctccttcgtataccgactgagtagccacaacgcggcgtggggagaactaccaagaggccgagaagcagaaaacggcttcagcctaccataccccgcattccgctcagaagtattagcacgtctgtgcccgactagagaagaaatactcctacgattagatcaaggaggcgtaggatatgatgaggcgttccgaaacgggctgagaccagtattcgtcagccgcgcaccaagccggcgcctgaggggcaaagcacacatggaaacactccgatccccaaaatggaaagaccacccagagggcccccggacagcctcacgcattccgctcaaagatctgaacttagaaaaattagaacgaatggtcggcaaggaccgagaccgaaagctgtacgaagcacttcgtgagcgcctcgccgctttcggaggaaacggcaagaaagcattcgtcgccccattcagaaaaccatgccgatcaggcgaaggaccactcgtacgctccctaagaatcttcgacagcggatacagcggggtagaacttcgcgacggaggagaagtctacgcagtagcggaccacgaatcaatggtcagagtagacgtctacgccaaaaagaatcgcttttatctcgtccccgtatacgtagctgacgtagcccgcggcatcgtaaagaacagagcgattgttgcccacaaaagcgaggaagaatgggacctagtagatggctcgtttgacttccgttttagcctattccccggagacctcgtcgaaatagagaaaaaggacggggcatacctaggatactataaatcgtgccaccggggcgacggccgcctcctacttgaccggcacgacagaatgccacgagaatccgactgcggaaccttctacgtgtcaacccgcaaagacgtactaagtatgtcaaaataccaagtagacccgctcggcgaaatccgcctagtaggaagcgaaaaacccccattcgtattatga

SEQ ID NO: 6118 - RNA, 3162 nt, synthetic construct
  misc_feature 1..3162: note = Cas9 variant
  source 1..3162: mol_type = other RNA
atgaaacgcaactacatcttgggcctagacatcggaataaccagcgtgggctacggaataatcgactacgagacccgtgacgtaatcgacgcaggggtacgtctcttcaaagaggcaaacgtcgagaacaatgaaggccgaaggtccaaacgaggggcccggcgcctgaagcgacgccgccgacacaggatccagcgcgtcaagaaactcctcttcgactacaacctgctgacagaccacagcgaattgtccggtataaacccatacgaggcacgcgtgaaaggactatcccaaaaactcagcgaggaggagttcagcgctgcactgctccacctcgccaaacgccgtggggtccataacgtcaacgaagttgaggaagacaccggtaatgaactcagcacaaaagagcaaatctcccggaacagcaaagccctcgaggagaaatacgtcgccgaactgcagcttgagcgcctcaagaaagacggggaagtcagagggagcataaaccggttcaaaaccagcgactacgttaaagaggccaaacaactcctcaaagtccaaaaagcataccaccaactcgaccagagcttcattgacacgtacatcgacctactggaaacccgccgcacatactacgagggacccggagagggatctcccttcggatggaaagacataaaagaatggtacgagatgctcatgggtcactgcacctacttcccggaggaactacgctcagtcaaatacgcatacaacgccgatctatacaacgccctcaacgacctgaacaacctcgtaatcaccagagacgaaaacgagaagttagaatactacgagaaattccagatcatagaaaatgtcttcaagcaaaagaagaaaccaaccttaaaacagatcgccaaagaaatactcgtgaacgaggaggacatcaaaggataccgcgtcacatccaccgggaaaccggagttcacaaacctaaaagtctatcatgacatcaaagacatcacagcgcgcaaagaaataatcgaaaacgctgaactgctcgaccaaatagccaaaatactaaccatataccaatccagcgaggacatccaagaagaactaacaaacttaaactcagaactaacccaagaagaaatcgaacaaatctcaaacctcaagggatacacgggtacgcacaacctcagcctcaaagcaattaacctcatcctagacgagttatggcacacaaatgacaaccaaatagccatattcaaccgactcaaactcgtccctaaaaaggtcgacctctcacaacaaaaagaaataccaacaaccctcgtagacgacttcatcctaagcccagtcgtaaaacggagtttcattcagagcatcaaagtgataaacgcaatcatcaaaaagtatggcctgccaaatgacataataatcgagctggcgagagagaaaaacagcaaagacgcacagaaaatgataaacgaaatgcagaaaaggaaccggcaaactaacgagcgcatagaagagatcatccgaaccacaggcaaagagaacgcaaaatacctcatcgaaaagatcaaactacacgacatgcaagaagggaagtgcctttactccctcgaagccatcccactcgaggacctactaaacaacccattcaactacgaggtcgaccacatcatcccaaggagcgtcagtttcgacaatagcttcaacaacaaagtgctggtcaaacaagaagaaaactcaaagaaaggcaaccggaccccattccagtacctaagctcctccgacagcaaaattagctacgaaaccttcaagaaacacatccttaacctcgcaaaggggaaagggcgtatctcaaaaaccaaaaaggagtatctactcgaagaacgagacatcaaccgattctccgtacagaaagacttcataaaccgcaatctcgtcgacacacgatacgcaacacgaggcctcatgaacctgctcagatcctactttagggtcaacaacctggacgtaaaagtcaaaagcatcaacggcggcttcacctccttcctccgccgaaaatggaagttcaaaaaggagcgaaacaaagggtacaagcaccacgccgaggatgcccttataatcgccaacgcggactttatcttcaaagaatggaaaaagctcgataaagcaaagaaagtcatggaaaaccaaatgttcgaggaaaaacaagcggaaagtatgcccgagatcgaaacagagcaggaatacaaagagatcttcattacaccccatcagatcaagcacatcaaagacttcaaagactataaatacagccacagggtggacaagaaacccaaccgcgagctaatcaacgacacactatactcaacacggaaagacgacaaaggaaacaccctaatcgtcaacaacctaaacggcctctacgacaaggataacgacaaactcaagaaactcataaacaaaagtcccgaaaaactgctaatgtaccatcacgacccccagacgtaccaaaaactgaaactcatcatggaacaatacggcgatgagaaaaaccccctatacaaatattacgaggaaacaggcaactacctaactaaatactccaagaaagacaacgggccggtgataaagaaaatcaaatactatggaaacaagctaaacgcccacctggacatcaccgacgactacccgaactcacgcaacaaggtagtaaagctcagcctgaagccctaccgattcgacgtttatctcgataacggtgtatacaaattcgtaactgtcaaaaacctggacgtaatcaagaaagagaactactacgaagtaaacagtaagtgctacgaggaagcgaagaaactcaagaaaatatcaaaccaagccgagttcatcgccagcttttacaacaacgacctaataaaaatcaacggtgaactgtaccgagtcatcggcgtaaacaacgacctactcaacagaatcgaagttaacatgatagacataacctaccgagaatacctagaaaacatgaatgataaacgcccgccccgcatcatcaaaaccatcgccagtaaaacccaaagtataaagaaatactccaccgacatactcggaaacctctacgaagtgaaatcgaagaaacacccacagataatcaagaaagggtga

SEQ ID NO: 6119 - RNA, 3162 nt, synthetic construct
  misc_feature 1..3162: note = Cas9 variant
  source 1..3162: mol_type = other RNA
atgaagcgcaactatatcctcggcttggacatcggcattacatccgtaggatacggcatcatcgactacgaaacacgcaacgtgatagacgctggggtccggctattcaaagaggctaacgtcgagaacaacgagggccgcaggagcaaacgtggcacacgacgcctcaaaagacgccgacggcaccgcctccagcgggtcaaaaagctcctgtttgaccacaacttcctcacagacaactccgaactcagcggcatctcgccatacgaggcaagggtaaaggggctaaaccaaaagatctccgaggaagagttcagcgtggcactccttcacctggcaaaacgcaggggtgttcacaacgtaaacgaagtagaagaagacacgggaaatgaactcagcaccaaggaacagataagcagaaactcaaaagccctcgaagaaaaatacgtcgccgagctccaactagagcgactcaaagtagacggagaagtcaggggcgccgtgaacaggttcaaaacaagcgactacgtaaaagaggcccagcaaatactaaaggtacaaaaggcataccaccaattcgatcagagcttcatcgacacatacatcgacctgctggagacgcggcgtacatattacgaaggcccaggggagggctccccattcggctggaaggacataaaagagtggtacgaaatgctcatgggacagtgcacctacttccccgaagaactccggtcggtcaagtacgcatataatgccgacctctacaatgccctcaacgacctgaacaacctcgtaattgcccgtgatgagaacgaaaagctcgaatactacgaaaaattccaaatcatcgaaaacgtcttcaagcaaaagaagaaaccgaccctcaaacaaatcgccaaagaaatcctagtaaacgaggaagacataaaggggtatcgcgtgactagcaccggtaaacccgagttcaccaacttcaaggtataccatgacataaagtccataacatctcgcaaggaaatcctcgaaaacgcggaactgctaaaccaaatagccaaaatactcaccatctaccagagctcggaagacatccaaggcgaactcgcccgactatacagtgagttgactcaagaggaaatcgagcaaatatcgaagctcgcaggatacacaggtacacacaggctatcactcaaagccatcaacctcattatagacgaactctggcacaccagcgacaaccagatggaaatattcaaccgactaaaacttgtgccaaagaaggtcgacctctcccaacaaaaggagattccaacaacgctagttgacgacttcatcctcagccccgtagttaagagatcattcatccaaagcatcaaagtgatcaacgccataatcaaaaagtacggattcccgaatgacataatcatcgaactcgcccgcgagaaaaattccaaggatgcccaaaagttcatcaacgaaatgcagaaacgcaaccgacaaacaaacgaacgcatagaggagattatccgcactacaggcaaagagaacgccaagtacctaatagaaaagattaaactccacgatatgcaagagggaaaatgcctctacagcctggaggcaataccgctcgaagacctactcaacaacccattcaattacgaggtcgaccatatcatcccccgcagcgtcagcttcgacaactctttcaacaacaaagtactggtcaaacaggaggaaaacagcaagaaaggcaaccgaacaccattccaatacttttcaagcagcgactcaaaaatatcctacgagattttcaagaaacacatactaaacctcgctaaaggcaaaggacgcatctctaaaaagaagaaagaatacttactcgaggaacgcgacataaatcgcttttcggtccaaaaatacttcatcaaccgcaacctcgtcgacacacgatacgccacccgtgagctcatgaacttactccgcagctacttccgcgtcaacgatctggacataaaagtgaaatccatcaatggagggttcacctcgttcctccgcaagaaatggaaattcaagaaagagcgaaacaaagggtacaaacaccacgccgaagacgccctaattatcgcaaacgcagacttcatcttcaaagaatggaagaaacttgacaaaacaaacaaagtgatggaagaccaaatcgtcgaagaacaacaggccgaaagcatgcccgaaatcgagacagagcaagagtacaaagaaatcttcattacaccccatcagatccaagacataaaagactttaaagactacaaatactcccacagggtcgacaagaaacctaaccgggagctagtcaacgataccctgtacagcacccgcaaagacgataaaggaaacacactcatcgtcaacaatctcaaaggcctctacgacaaagacaacgacaaactcaagaaactaataaacaaatccccagaaaaactcctcatgtaccaccacgacccacaaacataccagaagctgaaagttataatggagcaatactcgaacgaaaagaaccccctttacaaataccacgaagaaacaggcaactacctcaccaaatatagcaaaaaggacaacggcccagtcataaagaaaatcaaatactacggaaacaaattaaacgtatacctcgacatcacccgtgactaccttaaatcaaggaacaaaatcgttaaactgtccctcaaaccgtaccgcttcgatgtctacctcgacaacggcgtctacaaattcgtcaccgttaaaaacctggacatcatcaagaaagaagactactacgaagtagacagcgattcttacgaggaggccaagatcgtgaagaaagtctcagagcaagcccaattcgtcgcctcgttctacaataacgatctaataaaagtagacggcgaactcttcagagtgatcggcgtaaacaacgacctcctcaaccgcatcgaagtgaacatggtggacataacatataaagaatacctagagaacataaacgacaagaaaagctcaagaataatcaaaaccatcagcagtaaaacacagtcaatcaagaaatacagcacagacatcctcggaaacctctacgaagcaaaaagcaaacaacgcccacaaatgaccatgaaaggctga

SEQ ID NO: 6120 - RNA, 3162 nt, synthetic construct
  misc_feature 1..3162: note = Cas9 variant
  source 1..3162: mol_type = other RNA
atgaaacgcaactacatactcggtctcgatattggcattacctcagtcggctacgggatcatcgactatgaaaccagagacgtcatcgacgccggggtccgcctcttcaaagaggctaacgtggaaaacaacgaaggccgccggagcaagagaggcgccggccgcctcaaacgcagacgccgccacagactccagcgagtgaagaaactcctcttcgactacaacctcctcaccgaccactcggaactatccggtataaacccatacgaggcccgagtcaaagggctcagccaaaaactatctgaagaagagttctcagccgcactcctccacctcgccaaacggcgcggggttcataacgtcaacgaagtcgaagaagacacaggaaacgaactgagcacaaaagaacaaatatcgcgaaacagcaaagcgcttgaagaaaagtatgtggccgaactccaactagaacgcctcaaaactgacggagaagtgcgcggcagtataaataggttcaagacctccgactacgttaaagaagccaaacaactgctaaaagtgcaaaaagaataccaccaactcgaccaatccttcattgacacgtacatagacctactcgaaacgcgcagaacctactacgagggaccaggcgaaggctccccgttcggctggaaggacatcaaagagtggtacgagatgctgatgggtcactgcacttacttcccagaggaacttcgatcggtcaaatacgcttacaacgcagacctctacaacgcactgaacgacctaaacaacctggtcatagcccgcgatgagaacgagaagctcgaatattacgaaaaattccagatcatcgaaaacgtgtttaaacaaaagaagaaacccacccttaaacaaatagaaaaggaaatcctcgtgaacgaagaagacatcaaagggtaccgcgtcacatccacaggcaaacccgagttcagtaacctaaaagtgtatcacgacatcaaagatatcaccgcgcgaaaagaaatcatcgaaaatgccgaattgctcgaccaaatagcagaaatcttaaccatctaccaatcatcggaagacatccaagaagaactcgtaaaactcaacagcgaactcacccaagaagaaatcgagcagatctccaacctcaaaggatacacgggcacccataacctaagcctcaaagcaataaacctcatcctcgacgagctatggcacacaaacgacaaccaaatggcgatattcaaccgtctcaaactcgtcccgaaaaaggtagacctaagccaacagaaagaaataccaacaaccctcgtggacgacttcatcctctcacccgttgtgaagcgtagcttcatccaatccataaaagtcatcaacgccatcattaagaaatacggcctacccaacgacataatcatcgagcttgcaagagagaaaaacagcaaagacgcacagaaaatgataaacgaaatgcaaaagcgaaatcgacagacaaacgaacgcatagaagaaatcatccgcacaaccgggaaagagaacgccaaatacctcatagagaaaatcaagctccacgacatgcaagagggaaaatgcttatactccctcgaagccatacccctggaggacctcctcaacaacccatttaactacgaagtcgaccatatcatcccaaggagtgtcagcttcgacaactcattcaataacaaggtcctagtaaagcaggaagaaaactccaagaaaggcaacagaaccccattccaatacctcagcagctccgacagcaaaatcagctacgaaacattcaaaaagcacatactgaacctggcgaaggggaagggacgaataagtaaaaccaagaaagaatacctgctggaagaacgcgacatcaatcgcttcagcgtccaaaaagacttcataaaccggaacctcgtagacacccggtacgctacacgggagctaatgaacctgttgcgatcatacttccgtgtaaacaacttagacgtcaaagtcaaatcaattaacgggggattcacctccttcctaagacgaaagtggaagttcaagaaagaacgaaacaaaggatacaaacatcacgccgaggacgccctgatcatcgcgaacgccgactttatcttcaaagaatggaaaaagctagacaaagccaaaaaggtcatggaaaaccaaaccgtcgaagaaaaacaagcagagtctatgtcggagatcgagacggaacaagaatacaaagaaatcttcatcacgccccaccagatccaacacatcaaagacttcaaggactacaaatactcacacagagtagacaaaaagccaaaccgtgaactaataaacgacacgctctactccacccgcaaagacgacaagggaaacaccctcatcgtaaacaacctaaacggcctctaccataaagacaacgacaaactcaagaaactgatgaacaaatcacccgagaaactcctcatgtaccaccacgacccccaaacataccagaaactaaaactcatcatggaacaatacggcgacgagaaaaaccccctctacaaatactatgaagaaaccgggaattaccttacaaaatactctaagaaagacaacggaccagtcatcaagaaaataaaatactacggcaacaaactcaacgcccacctagacataactgatgactaccccaactcacggaacaaagtcgtaaaactcagcctaaaaccgtaccgattcgacgtctacctagataacggcgtctacaaatttgtaaccgtcaaaaacctaaatgtaattaagaaagaaaactattacgaagtaaactcgaaatgctacgaaaaagcgaagaaacttaagaaaatcagcgaccaagcagagtttatagcctccttctacaacaacgacctcattaaaatcgacggcgaactataccgcgtaatcggagtcaataccgacctgatcaatcgcatagaagtcaacatggtcgatataacctaccgggaataccttgagaacatgaacgacaaacggtcaccccgcatcttcaaaacaatcgctagcaaaacccagagcatcaaaaagtacagcaccgacattctaggcaccctctacgaggtgaacagcaagaagcacccccaaatgatcatgaaaggctga

SEQ ID NO: 6121 - RNA, 3162 nt, synthetic construct
  misc_feature 1..3162: note = Cas9 variant
  source 1..3162: mol_type = other RNA
atgagcggaatggtgttcggcatagacctaggcatagcaagctgtggatgggcagtattaagacaaccacaaagagacggagacccaggagaaatcgtagacctagggtcatggatgttcgatgtacccgagacagacaaagagcgaaccccaaccaaccaggtgcgcagaggaaacagactgctaaggcgggtgatccggcgacgagctcaaagaatggtggagatccgccgactcttccacgaccacggactactggcaggtcacgcacccgaagcactgaaaagagcggggctagacccatgggacttaagggccagaagcctcgacaaggtgctggaaccggccgccctggcagtcgcgctcggccatatagcgaaaagacgaggattcaaaagcgcagcccggaggaaagaagcaaacacggcgggagacgaccagaaaatgctgaaggccctagaagccacacacgaaagactagggcgctaccgcacgataggcgagatgttcgccagggatccagacttcgaaagtaggaaaagaaacagggacgggatgttcgacagaacgcaaggacgggacgacctcctacacgaggtaggggaaatattcaaagcacagaggagactgggctcggccctagcgacagcagagctggaacaagccttcacagcaatagcattccgacaactcccgatccaagacagcgaaaggctagtaggactatgccaattcgaaccgaaggagaaaagagcagccagattcgcacccagcttcgaacgattcaggctgctgcaaaggctcacgaaccttagagtagttacggtcgaaggggaacgaccgctaacagcagacgaaatagcagccgccgcggcagacctagggcgaacagccaaactatcggtaaaagaagtacgaaaacgcataggactcgccgccgatcaccgattcgcagcgttcaaagcggatgaagaggaccgagacataatcgcccggacaggagaagcgctccacggaacgtacagactaagaaaagctctcggcgagggactgtgggccgagatgctgccaggacagctggatgcaatagcacacgcactcagctttttcgaaacgcaagatgtaatactgaaagagttagacaagctagacctccctgcaggagtcagggacgcgatagccactggactcgacgcaggcgcattcgcgagattcaagggaacgggacacatcagtgcaagagccgcaagagcgttactaccgcacctggaggcaggcctcagatacgaccaagcctgcacgaaagcaggatatgatcacgcagcaagccgatgggcaaaaagggagcaagttgcagataaagcagcattcaacaggctagtaactgatatgggagcagaaatagcaaacccgatagcaagaaagagcctaacagaggcgttgaaacagctatgggcgatgagaaatcgatgggggctacctgacgcaatacacatagaactagccagagacgtaggaaacagcctagagaaaaggagggaaatagaaagggcaatcgagaaaaacaccgcggcccgcgaaagagaaaggggagaagcaagagacctcctaggcatagacgacgtgtccggcgatacactgctcagatacagactttggaaggaacaagcagggaggtgcccctatacggatgcccccatcccacccggcgcgataatagcgacggacaacagcttccaggtcgatcacatactaccgtggagccggttcggcgacgacagtttcgcaaacaaagttctctgcgcaacggccgccaaccaaaggaagaaagggcaaactccatgcgaatggataacagcggcccaaggcgaggaaggatgggcaactttcgtggccaggatagaaggaaacgccgccttcagaggccccaagaaaaggaattacgtactgaaaaacgccaaagaagcagaggaaagattcagagcccggaatctaaacgacacaaggtacgcagcacgactcctagcagaagcggtaaaacttttctacccagaaggggaaaggcaggacaaaggaggagtccgccgcgtgttcacaagaccaggcggactaaccgcggcattgagacatgcatggggcgtagaagccctcaagaaaagagacggaaaacgagtagacgacgcccgacaccacgcgctcgacgcgttagtagtcgcagccataggagaaggagaggttcagagactgacacgatcataccaagagtgggaacaacaaggcctggcccgaccactgcgcagagtagacccgccgtggggagacttccacagtttcagaagagaagtcaaagacgcttacgacggcatattcgtcgccaggcccgagaggaggagagcaagaggagaaggacacgcggcgacaattaggcaagtaagagagcgggatggagcggctgtggtgttcgaacggaaggcaatcgcggacttatcagaaaaacggctcgcagacataaaagacccggaaagaaaccaagcaattgtagaggcgataagacaatggatagtagacggaagaccggcagacagactacccagatcaccggccggagatgaaataagaaaagttcgcctcagaacgaaggggaaaccagccgtccaagtgcgaggaggcgcagcagatcgaggcgaaatagtcagagttgacgttttcacgaaacccaataagaaaggaaagaacgagttctacttagtacccatatacccacatcaggtgatgaacaaggcggagtggccgaccccgccaatgagagcagtggtagcatacaaagacgaaagcgagtggacgttacttgacgagaacttcggattcctattctcactgttcccaagaagttacgttgaagtgacgaaaccgggaggagaggtactatccggatatttccaaggcatggacagaagcacgggggcgataagcctattcaaccacagggactcccgatcccttactgacgacagcggcaactccacacgcgggataggagccaaaacactgttgacaatgaagaagtactcagtggaccgcttcggaaagagagcagaggtaaaatccgaagtaaggacatggcacggggtcgcatgcacgtacccaacaccaccaggatga

SEQ ID NO: 6122 - RNA, 3165 nt, synthetic construct
  misc_feature 1..3165: note = Cas9 variant
  source 1..3165: mol_type = other RNA
atgaaactaaccccgctaaactacatactaggactagaccttggcatagcaagcgttgggtgggcggtagtcgaaatcgatgaacaagaaaacccccttggcctcatcgacgtcggggtccgcaccttcgaccgagccgaagttgccaaaacaggagagagcctggccctggcaagacgtctcgcccggagcagccgacgactcgtaaagcgccgcgcggaccgaataaagaaagttaaacgcctattgaagtccgaaaacattctactcagtgcagacgaacagctaccaaacgacgtctggcagctccgggttaaaggactagatcagaaactcgagcgacaagaatgggccgctgtactactacacctactcaaacaccgcggatatctttcccaacgcaagaatgagtcgaaatcagaaaacaaagaacttggagcactacgaagcggcgtcgccgctaaccaccagatactccaaagcgccgagtacagaacccccgccgagatcgcggtgaagaaattccacgttgaagagggccacatcagaaaccaacggggagcctacacacacaccttcagcagattagacctccttgccgaaatcgaactactcttcacccgccaaacagaactcggaaacccccacacaagtgccaaacttctcgaaaacctaaccgccctactaatgtggcaaaaaccggcactcgcgggggaagccatcctcaaaatgctcggaaaatgcaccttcgaacccaccgaatataaagcagcgaaaaactcctacagcgcagaacgcttcgtatggctcacaaaactcaacaacctccgcatcctggagcaaggagcagaaagagccctaacagacaacgagcgtttcgctctgctggaccaaccctacgagaaagcgaagttcacctacgctcaggcacggaccatgctcgccttgcccgacgaagcgatctttaaaggcgtccgctaccaaggcgaggataagaaagcagttgagacaaaaacaatcctaatggaaatgaaagcataccaccaaatacgaaaagccctagaaaacgcagacctaaaggccgagtggaatgaactcaaaaacaacagcgaactcctcgatgacatcggaacagcattcagcctacacaaaaccgatgaagatatatgccgctatctcgacggaaaactgtcggaaagcatactgaacgcccttctcgaaaacctaaacttcgacaaatttatccaactctcactaaaagccctacaacaaatcctcccgctcatgctccaaggccagcgatacgacgaggcagtaagcgccatctacggagaccactacggtaagaaatcggcagagattaaccgcctactcccaacaatccccgcggacgaaatacgcaaccccgtcgttctacgaacactaacacaagcacgcaaagtaataaacgcggtcgtccgcctctacggctcacccgcacgaatccacatcgaaacgggccgggaggtaggcaaaagttaccaagaccgcaagaaactggaaaaacaacaggaggacaaccggaaacaccgcgaatcagcagtccaaaaattcaaagaatacttcccaaacttcgtgggcgaacccaaaggaaaagacattcttaagatgaggctgtatgaactacaacaggcaaaatgcctctactccggcaaaagtctagagctccaccggctcctagaaaaaggctacgtcgaggtagaccacgccctacccttctcacgaacctgggacgactcattcaacaacaaggtcctcgtcctcgctaacgaaaaccaaaataaagggaacctaacaccgtacgaatggctagacgggaaaaataactccgagccgtggcagaattttgtcgcgcgcgtccagacatcaggcttctcccacacgaagaaacaaagaatactgagtcacaaacttgacgagaaagggttcatagaaaggaacctaaacgacacccggtacgtagtgcgattcttgtgcaacttcatcgccgataacatgcttctaaccggaaaagggaaacgtaaagtcttcgccagcaacggacaaataaccgcactactaaggggaagatggggcctccagaaagtacgtgatgacaacgaccgacaccacgcgctcgacgcagtcgtagtagcatgctccacagtcgcaatgcaacagaaaatcacgcgattcgtacgatatgaagaaggcaacgttttcagcggcgagcgcatcgaccgcgagactggcgaaatcatccccttacacttccccagtccatgggctttcttccgagaaaacgtagagatccgaatcttctcggaaaacccaaaactagagctcgaaaaccgcctcccagactacccccagtacaaccacgagttcgtgcaacccctcttcgtgtcgcgcatgccaacacgcaagatgaccggacaaggccacatggaaaccgtaaaatcagcaaagcgcctggacgaaggactgtcagtcctgaaagtaccactcacacaactaaaactgaacgaccttgaacgaatggtaaatcgcgaacgcgaaatggcgctttatgaatcactcaaggttcgcctcgaacaattcgacaacgaccccgccaaagcgttcgcagaaccattctacaagaaaggaggcgcactcgtcaaagccgtgagggtcgaacaaacacagaaatcaggagtcctcgtccgcgacggaaacggagtagccgacaacgcaagcatggtaagggtggatgtcttcacgaaagctggcaaatactttctagtcccgatctacacctggcaggtcgccaaagggatcctacccaacaaagcggtaacagccaacgtcgacgaaatcgactggctcgaaatggacgaatcatatcaatttatcttcaccatgtaccccaacgacctcgtcaaagtaaaactaaagaaggaagagttcttcggatactatggaggcctagaccgggcgactggagctatcgtcataaaagaacacgacctagaaaaatcgaagggtcgccaaggcatatacagaataggggtgaaactcgcgctctcgttcgaaaaataccaagtggacgagctagggaaaaacatccgcccctgccgcccaactaaacgacaacacgtccgctga

SEQ ID NO: 6123 - RNA, 3165 nt, synthetic construct
  misc_feature 1..3165: note = Cas9 variant
  source 1..3165: mol_type = other RNA
atgagaatcctaggcgtagacctaggagtggcctcagtcggctgggcactcgtgaacgacaaaaacaacaaaataatagacagcggcgtaagaatcttcacccaatcgaccaaccgagaaggaaaaaccctggccgccgtccgccgatccttccgcggcggtagacgcgtactaagtcgccggaaacaacgactaaatcaactgaaaaagttgttcatagcgcacaaactcctaagcaaatccgagttcaaacatctcttcaactccaaaaacaggctcgacatctggcaactccgcgcgaaaggcctggagcaacagctcaacaacaaagagtgggcccgcgtgctataccacatcgccaaacggagagcctaccagtcaaacaggaagtcggaagagtcgggaaatacagacaaaaagaaggtactctccggaatcagcaaaaacgaaaagaaaatgaacgaactcggctacaaaacgataggagaaatgctgtacacggagaaccgataccccgataaccgcattagacgcaataagaaagaccagtacaaacacagcatcagcagggacctcctcaggaaggaaattgacgtcctcttcgaaagccaacgagatttcggcaaccaattcgccaccgacggactaaaggaacactacaaagacatcgcgttcacccaaaggccaatcaaattcaaagccgacctcgtaggtaaatgtactttcgaaacgcaagagtaccggggcgcaaagaactgcttctccgttgaaaaatcaacactcctaagcaaaatcaacaacaccgaccttatcgataagtccaccggggagatcaagcggctattcgagatctccgagttcgacaaactccttgacatcttctactcaatcaaagaggtgaaatacacaacactccgaaagcagctcaaaatcaccgacgcgttcaaatttaaacagctcgattaccaccagaacttcgagtataagacaaacatcaaggccaaaatcgaagacttctacaagctcgaggactggctaacccccgaacaaaaagtactcctagaaaaacaagtcctcgacgacaagaaagaaaaattcaaatgctacaaatacagctcaatccgctcgatcctatccctttccgagagccaaaaattcaatggggtcaaatacgacaccaaagtcgaaaacaccgtattcgggaaactaaatggttaccactccatcaagaaagagctaaacaaagaagtttttgacctactcttcatcgacaaagacaaattcaacaagatagccgagatactctcctaccaaaaagacgacaaatccgccacgcaggacttaaagaaacaagtcttcaacgacttcaatatggacaaaaccatagtgaacgaagcaatcaactccctactaaacatatccttcagtggcttcaactccctctccctcaaagccatcaacaaactcctgccctacctctgtcaaggattaaaataccacgacgctgtggcccactcggaatataaacaccactcccagttcaaagcagccaatccacagcagtacctacgacccctgaacaaagaagaaaactaccaaatcacctcgcctaccgtaaagcgcgtcttctcacaattccgcaaagtactcaacgcagtgatcagaaaacacggctccttcgatgcaatgcatatcgaaatggcacgcgagctcaagaacagcaaaaagataaagttcgaaattcagacgggacaaaaagaatatgcacaagagaaagaagccatccgcgtcaaattcctagaaatcttcaaatacgagggctccggccgcgacctactcaaactgcgcctatacgagcagcaacacgggaaatgcatatacagtaagaaagaaatcgagataaacaaactcctcgaggacggatatgtcgaaatagaccacattctaccatggagtcggacattcgataactcactaaacaataaagccctctgcctgagcgcggagaatcagaacaaagccaatcagactccgtttgaatacctcaccaactccgacaaaaacagcaaagactccaaagagtggcaggaatacaagaactacgtaagctcattcgcaggaatcaaacaggccaaaaagcacaagctcctcaacaccactctaccgccccggcgcggtaacgatttctccgacgacataaagaaccccgagtccggattcctcgcacgaaacctaaacgacactgcctacgcctccaggttcatcaagaacttcgtacagaaccatcttcaattctcgcagaacgacaccataaaacagaaagttaaagtgcggtctggcgcactcaccaaccagctcagatacaactggggcatcgaggaaaagaatcgtgataacaatctacatcacgcagaagacgccatcattctcgcgttcgccacacagggtgaagtacaacgcatgtcaacaataagcgcgaaacgcgaagacttcaaatatcagaccgcaaaggagcgcaaaatcaaatttacgccccctttctccgacttcaagtcagtcctggacgaatccgtaggcgacatcttcgtgagcttcgcaccccgccgcaaaatctccggcgccgcccataaagccaccatcaagccaaaggacaccggcggaaagtacaaatttcccgtaaacaacgggatggcagaaaacggtgtcatccagcgcgtagacgtcttcaaaaacgctaaaaacaagtaccaattcattgtgttctaccccgcagatttctacaaggacgacttccccgaactagacctaaaagggaacgaaatcgacaagaacgtacaattcctcttctccctgttcaaggacgacctaatcgagttcaagacaaagaaaaccaaaactaaagacagcaaacatctcctcgcatatttcaaatatatacgaagcgacggaaaaatcgccttccagcaaaactacaaagccgaaatcgaacgaaaggaatcggacaacaagaaaggctacaaagacatcctgctagcaaccggatccggcctggcatcactaaagaaataccaggtgagcgtcctcggcgacatcgccgaagtcaaaaacgaaaaacgactacccctgataaaacaaatgtataaatcaaaacccaaaaagaaatga

SEQ ID NO: 6124 - RNA, 3165 nt, synthetic construct
  misc_feature 1..3165: note = Cas9 variant
  source 1..3165: mol_type = other RNA
atgaaccagaaattcatcctgggcctagacatcggaataacctccgtcggatacggcctaatcgactacgagaccaaaaacatcatagacgccggggttcgcttgtttccggaggcaaacgtagaaaacaacgaaggcaggcggagcaaacgtggctcgcggcgcctgaaacgcagacgcatccaccgactcgaacgagtgaagaaactcttagaagactacaacctcctcgaccagagccaaataccccagtccacaaatccctacgccatacgagttaaagggctgtccgaggccctctcgaaagacgagctagtgatcgccctactacatatcgccaaacgccgcggcatccataagatagacgtcatcgactccaacgacgacgtaggtaatgagctgtcaaccaaagaacaactgaataagaacagtaaactcttaaaagacaaattcgtctgccagatccagctcgaacggatgaacgaaggccaagtgagaggagagaagaaccgattcaagaccgccgatatcataaaggaaataatccaactcctaaacgtccagaaaaacttccaccaactcgacgaaaacttcatcaataaatacattgagctagtagagatgcggcgcgaatacttcgaaggccccggaaaggggtcaccatacggctgggaaggagacccaaaagcatggtacgaaaccctcatgggtcactgtacctatttcccagacgaattgcgctccgtgaaatacgcatacagcgcggacctgtttaacgccctcaacgacctgaacaatctagtcatccaacgcgacggcctctcaaaactcgaataccacgaaaaataccacataatcgaaaatgtgttcaagcaaaagaaaaagcccaccctaaagcaaatcgcaaatgaaatcaacgtcaacccagaagatataaagggataccgcatcaccaagtcgggaaaaccccaattcacagagttcaaactctaccacgacctgaaatctgtcctattcgaccaaagcatcctcgagaacgaggacgtcctcgaccaaatagccgaaatcctaaccatctaccaagacaaggacagcataaaaagcaaactcactgaactcgacatcctgttaaatgaagaggacaaagagaatatagcccaactcacgggatacacaggaacccaccgcctcagcctaaagtgcatacgcttagtactcgaggagcagtggtactctagccgtaaccagatggaaatatttacgcacctaaacataaaacccaagaagatcaacctcaccgccgcgaacaagataccaaaggcgatgatcgacgagttcatcctatccccagtagtaaagcgcacatttggtcaagccattaacctcataaacaaaatcatcgaaaagtatggagtgcccgaagacattattatcgaactagctcgcgaaaacaacagcaaagacaaacagaagttcatcaacgaaatgcaaaagaaaaacgaaaacacacgaaagcgaatcaacgaaatcatcggcaagtatggaaaccagaacgcaaaacgcctcgtcgaaaagatccgcctccacgacgagcaggagggcaaatgcctctacagcctcgagtcaatacccctagaagacctcctaaacaatccaaaccactacgaagtcgaccacataatcccgcgcagcgtgtccttcgacaatagctaccacaacaaagtactcgtcaagcaaagtgagaactcgaaaaagagcaatctcacaccctaccaatattttaattccggaaaatccaagctctcttacaatcaattcaaacagcacattctcaacctgagcaagagccaagatcgcatcagtaaaaagaagaaagaatacctactagaggaacgtgacatcaacaaattcgaagtgcagaaagagttcataaaccgaaacctcgtagacacccgctacgccactagagaactcacgaactacctcaaggcatacttctccgccaacaacatgaacgtgaaggtaaaaacgataaacggctctttcacagactacctacgaaaagtatggaagttcaagaaagaaagaaaccacgggtacaaacaccacgcggaagacgccctcatcatagcaaatgcagacttcctcttcaaagaaaacaagaaactcaaagcggtaaacagcgtactagaaaaacccgaaatcgaatcaaaacagctcgacatacaagtagactcagaggacaactactcggaaatgttcatcataccgaaacaggtacaagacataaaagatttccgaaacttcaaatatagccaccgcgtggacaagaaacccaaccgacaactgattaacgacacactctactccactcggaaaaaggacaacagcacgtatatagtgcagactatcaaggacatatacgcgaaggacaacaccaccctgaagaaacaattcgacaaaagtccagaaaaattcctgatgtaccaacacgacccccgcacattcgagaaactcgaagtaataatgaaacaatacgcgaatgagaaaaaccccctcgccaaataccacgaagaaaccggggaatacctcacaaaatactcaaagaaaaacaacgggccaatcgttaaatccctgaaatacatcgggaacaagctaggaagccacctagatgtcacgcaccaatttaaaagctcaaccaaaaagctagtcaaattatcaatcaaaccataccggttcgatgtctaccttacagacaaaggttataaattcatcaccatctcctacctcgacgtgcttaagaaagacaactattactacatccccgaacaaaaatacgacaaactgaaactcggcaaggcgatcgacaagaacgcgaaattcatagcatccttctacaaaaacgaccttataaagctagacggcgaaatatacaaaatcataggcgtcaactcggacacccgaaacatgatcgaactcgacctcccagacatcaggtacaaagaatactgcgaactcaacaacataaaaggcgaacccaggatcaaaaagaccatcggaaagaaagtgaactcaatcgaaaaactcacgaccgacgtgctcggaaacgtgttcacaaacacacaatacacaaagccccagctactattcaaacgcggaaactga

SEQ ID NO: 6125 - RNA, 3165 nt, synthetic construct
  misc_feature 1..3165: note = Cas9 variant
  source 1..3165: mol_type = other RNA
atgaaactaaccccactcaactacatcctcggcctcgatctcggaatagcatcggttggttgggcagtcgtcgaaatcgatgaacaagaaaatcctctcggcctaatagacgtaggagtccgaacctttgaccgagccgaagtaccgaaaacgggagaatcactagccttggcaagacgccttgcccggagcgcaagacgcctcgtaaaacgacgcgcagaccggatcaagaaggccaaacgcctcctcaaagccgaaaacatcctcctctccgctgacgaacatctacccaacgacgtatggcaattacgcgtaaaaggtctggatcaaaaactggaaaggcaagagtgggccgcagtactcctccacctcctaaaacaccgtgggtacctgagccaacgcaaaaacgaatccaagagcgagaacaaagaactgggcgccctactttcgggggtcgaaacgaaccaccagattctccagtctgcggagtacagaacccccgccgaaatcgccgtcaagaaattccacgtcgaagacgggcacatccgaaaccaacgaggcgcgtacacgcacaccttctcccggcttgacctactcgccgagatggagctactcttccagagacaaaccgacctcggcaacccccacacgtcagccaaactactagaaaacctcaccgcacttctcatgtggcagaaacccgccctcgcaggagaggccatcctaaaaatgcttggtaagtgcacattcgaaccaacggaatacaaagccgccaagaacagctactccgccgaacgcttcgtctggctcacaaaactaaacaacctacgcatattagaacaaggcgcagaacgggcactaaccgacaacgaaagattcgctctactagatcagccgtacgaaaaagcgaaattcacctacgcccaggcaagaacgatgctcgccctcccagacgaggcaatcttcaagggcgtccgataccagggcgaagacaaaaaggccgtagaaaccaagaccatactcatggaaatgaaggcctaccaccaaatccgaaaagccctagagaacgccgacctaaaggcagaatggaacgaattaaagaacaattcggagctcctagacgacatcggaaccgccttctccctacacaaaacagacgaggacatatgcagatacctggacggcaaactcagcgagtcaatactgaacgcgttgttagaaaacctgaatttcgacaaattcatacaactatcgttaaaagcgctccaacagatcctaccgctaatgctacaaggccaacgctacgacgaagccgtcagtgcaatatacggcgaccactacggcaagaaaagcgccgagatcaaccgcctactccccacaataccagcagacgaaatacgtaaccccgtcgtacttagaacactgacacaggcacgaaaagtcatcaatgccgtagtgcggctgtacggatccccagcaagaatccacatcgaaaccggacgcgaagtcggaaaatcctaccaagaccgcaagaaactagaaaaacaacaggaagacaacagaaaacagcgcgaaagtgcagtcaagaagttcaaagagtatttcccaaacttcgttggagagcccaaaggcaaagacatactaaagatgcgattgtacgaactacagcaagccaaatgcctctacagcggcaagtcactagaactacacagactcctggaaaaaggatatgtcgaggtcgaccacgcactaccgttcagccgaacatgggacgactcattcaacaacaaggtccttgtactcgctaacgagaaccaaaacaaaggcaacctgacgccatacgaatggctagacggcaaaaacaactctgagcactggcaaaacttcgtcgcaagagtacaaacaagtggctttagtcacactaagaaacaacgtatcctaagccacaaactcgacgaaaaagggttcatagaacggaacttgaacgacaccagatacgtggcacgattcctctgcaactttatagccgacaatatgctactcaccggaaaaggcaagagaaaagtattcgcgagcaacggccaaatcacggcactcctcaggggccgatggggactccaaaaagttcgagacgacaatgaccgacaccacgcactcgacgcagtagtggtcgcatgctcaaccgtcgtcatgcaacagaaaataacccgattcgtccgatacgaagaagggaacgtgttcagcggtgaaagaatcgaccgcgaaaccggagaaatcattcccctccactttcccagcccatgggcattcttccgcgaaaacgtagaaataagaatattcagtgaaaacccgaaactcgaattagaaaaccggctcccagactacccgcaatacaaccacgagttcgtccagccactattcgtaagccgaatgcccacgcgaaaaatgaccggccagggacatatggagacagttaaatccgccaaacggctcgacgaaggactcagcgtactaaaagtcccgctcacccagttaaaactatccgacctagagcgcatggtaaaccgcgaaagggaagtaaccctctacgaatccctgaaagcgcggctcgaacaattcggaaacgaccccgcaaaagccttcgcagagcctttccacaaaaagggaggggcagtagtaaaggccgtgcgcgtcgaacaaacccaaaagagcggagtcctagtaagagacggcaacggcgtagcagacaacgcctctatggtacgtgtagacgtgtttaccaagggcggcaaatacttcctagtcccgatctacacatggcaagtggcaaagggtatactcccgaataaggcagtcaccgccaatgtggatgaaatagactggctcgaaatggacgaatcataccaattcatctttacaatgtaccccaacgacctggtaaaagtaaaactcaagaaagaagagttcttcggctactacggagggctagacagagcgacaggcgccattgtgataaaagaacacgatctcgagaaaagcaagggcaagcagggaatctaccgcataggagtcaagctggctcttagcttcgagaaataccaagtagacgaactagggaagaacataagaccatgccggccaaccaaacgtcaacacgtccgctga

SEQ ID NO: 6126 - RNA, 3165 nt, synthetic construct
  misc_feature 1..3165: note = Cas9 variant
  source 1..3165: mol_type = other RNA
atgaaagaaaaatacatcctcggtctcgacctcggcatcaccagcgtaggttacggcatcatcaatttcgaaacaaagaaaataattgacgccggcgtacgactattcccagaagccaacgtagataacaacgaaggcaggcggtccaaaagaggatcccgcaggctcaagcgccggaggatacaccgactggaacgcgtcaaattactcctcacagaatacgatctaatcaacaaagaacaaatccccacctccaacaacccctatcaaatacgtgtaaaaggcctctccgaaatactaagtaaagacgagctcgcgatcgccctcctacacctcgccaagcgtcgcggcatacacaacatcaacgtcagttccgaggacgaagacgccagcaacgaactcagcaccaaggaacaaatcaaccgcaacaacaaactgctcaaagacaaatacgtctgcgaagtacagctccaacgcctcaaagagggccagatacgaggagagaaaaaccgatttaaaaccaccgacattttaaaagaaatagatcagcttctgaaagtacagaaggactatcacaatctcgacattgacttcataaaccaatacaaagaaatcgtcgaaacccgacgcgaatacttcgaaggccccgggcaaggctcacccttcggctggaacggcgatctaaagaaatggtatgagatgctcatgggccactgcacatacttcccccaagaactccgaagcgtaaaatacgcatactccgcagacctgttcaacgcgctcaacgacctcaacaacctcatcatccagcgcgacaactccgagaaactcgaataccacgaaaaataccacataatcgaaaacgtgtttaaacagaagaagaaaccaacgctcaaacagatagcaaaagaaattggcgtcaaccccgaggacatcaaaggctaccgaatcaccaagagcggtacgccacaattcaccgagttcaagctctaccacgacctcaagtccatcgtcttcgataaatcaatcctcgaaaatgaggccattctcgaccagatagccgagatactcaccatataccaagacgagcagagcatcaaggaggaactgaacaaactacccgaaatcctaaacgaacaggacaaggccgaaatcgcaaagctcattggctacaacggcacccaccggctcagcctcaaatgcatacatctaatcaatgaggaactatggcagacttcacgtaaccagatggagatcttcaactacctaaacatcaagcccaacaaggtcgacctaagtgagcaaaacaaaatacccaaggacatggtgaacgacttcatactgtcaccagtagtgaagaggaccttcatccaaagcataaacgtaatcaacaaagtaatcgagaaatacgggatccccgaagacatcattatcgaattggcacgcgaaaacaactccgacgaccgcaaaaagttcatcaacaacctacagaaaaagaacgaggcgacaagaaaacgcataaacgaaataatcggccaaaccggcaaccaaaatgcgaaacgcattgtggaaaagatcagactgcatgaccaacaggaagggaaatgcctatactctctcgaaagcatcgcactcatggacctcctcaacaacccgcaaaactacgaagtagaccacatcatacctcggagtgtcgccttcgacaactccatccacaacaaagtcttagtcaaacaaatagaaaattccaagaaaggcaaccgcacaccataccaatacctcaatagcagtgacgccaaactctcatacaaccagttcaaacagcacatacttaacctgtctaaaagtaaagaccgaatttccaaaaagaagaaagattacctactcgaagaacgcgacattaataaatttgaagtacaaaaggagttcatcaatcgcaacctagtcgacacgcgctacgccacacgcgagcttacgagctacctgaaagcctacttctcggcaaacaacatggacgtaaaagtgaaaaccataaatggctccttcacaaaccacctccgtaaggtatggcgattcgataaatatcgcaaccacggctataaacaccacgcagaagacgcgctcataatagccaacgcggacttcctcttcaaagaaaataaaaagctccagaacaccaacaaaatattggaaaaacctacgatagagaacaacacaaagaaagtgacagtggaaaaagaagaggactacaacaacgttttcgaaacaccgaaactggtagaggatataaagcagtacagagactataaattctcccaccgcgtcgacaagaagcccaaccgccaactcatcaacgacaccctgtactccacgcgaatgaaagacgaacacgactacatcgtccagaccatcaccgacatctacggcaaagacaacaccaacctgaagaaacagttcaacaaaaacccagagaaattcctcatgtaccaaaacgaccccaaaacctttgaaaaactctcaatcataatgaaacaatactccgacgagaaaaacccgctagccaaatactacgaagaaaccggcgaatacctcacaaagtactctaaaaagaacaacggcccaatcgtaaagaaaataaaactccttgggaataaagtcggcaatcatctagacgtcacgaacaaatatgaaaactcaaccaaaaagctagtgaaactaagcatcaaaaactaccgattcgacgtttacctaaccgaaaaaggatacaaattcgtaactatagcatacctcaacgtattcaagaaggacaactactactacatccccaaggacaagtaccaagaactaaaggagaaaaagaaaatcaaagacaccgaccaattcatcgcctcattctacaaaaacgatctaatcaaactaaacggagacctatacaaaatcatcggagtcaacagcgatgacaggaacatcatcgaactagactactacgatatcaaatacaaagactattgcgaaatcaacaacataaaaggggaacctcgaatcaagaaaaccatcggcaaaaagaccgaaagcatcgaaaagttcacaaccgatgttttggggaacctctacctacatagcaccgaaaaagctccccaactcatttttaaacggggcttatga

SEQ ID NO: 6127 - RNA, 3165 nt, synthetic construct
  misc_feature 1..3165: note = Cas9 variant
  source 1..3165: mol_type = other RNA
atggaaaacaaaaacctaaactatatcctcggactcgacctcggtatagccagcgtaggctgggcagtagtagagatagacgagaaagaaaaccccttacgactcatagacgtcggagtacgcacattcgaacgcgcagaagtcccaaaaacaggcgagagcttagcactctcacgacgcctcgccaggagcgcccggcgactcacccaacgacgggtggcccgtctaaagaaagcgaaacgcctacttaagtcggaaaatatacttctatccacagatgaacgactaccccaccaggtctggcaactcagggtagaaggcctcgaccacaaactcgagcggcaggagtgggccgccgtcctcctccacctcattaaacaccgcggatacctcagccaaagaaagaatgaaagcaaatccgaaaacaaagagctaggggccctactctccggagtagacaacaatcataaactgcttcagcaagccacgtaccgaagccccgccgagctagcagtcaagaaattcgaggtcgaagaaggccacatccgaaaccaacaaggggcgtacacacacacctttagccgcctagacctcctagccgagatggaactcctcttcagccgacaacaacacttcggcaacccgttcgcatccgagaaactactagaaaacctaaccgccttactgatgtggcagaaacccgcactctccggcgaagcaatactcaaaatgctcggcaaatgcacttttgaagacgaatacaaagcagccaaaaacacgtattcggcggaacggttcgtttggatcacaaaactcaacaacctccgcatacaagaaaacggacttgagcgcgccctaaatgacaacgagcgcttagcactcatggaacaaccctatgacaaaaacagactattctactcacaagtccgctcaatcctcaaactcagcgacgaggcaatctttaaaggcctcagatactccggcgaggacaagaaggccatcgaaaccaaagccgtgttaatggaaatgaaagcctaccaccaaatacgtaaagtcctggaaggcaacaatctaaaagcagaatgggcagaacttaaagccaacccgactctgctagacgagatcggaactgccttcagcctatacaagacggacgaagatatctcagcgtacctagccggaaaactatcccagccggttttaaacgctctcctggagaacctcagcttcgacaaattcatccaactatccctgaaggccctatataagctgctccccctcatgcaacagggactcagatacgacgaggcttgcagagaaatctacggggaccactacggcaagaaaacggaagaaaatcaccacttcctgccgcagatccccgcagacgaaataagaaaccccgtcgtcctacgtacactcacccaagcaaggaaagtaatcaatggagtagtccgcctatacgggtcccccgcacgcatccacatcgagaccgggcgtgaggtcggcaaatcatataaggaccggagagagctcgaaaaacgtcaagaagaaaaccgaaagcaaagggaaaatgccataaaggagttcaaagaatacttcccccactttgccggtgaaccgaaagccaaagacatactcaaaatgcggctatataaacaacagaacgccaagtgcctatacagcggtaaaccaatcgaactgcaccgcttacttgaaaaaggatacgtcgaagtcgaccacgccttgcccttctcacgaacatgggacgacagcttcaataacaaagtattggtactagcgaacgagaaccagaacaagggcaacctcacccccttcgaatggctcgacggcaagcacaacagcgagcggtggcgagcgttcaaagccctcgtcgaaacctccgcgttcccgtacgccaaaaagcaacgaatcctatcccaaaaactcgacgagaaaggattcatcgaacgcaacctaaacgacacacgctacgtagcacgatttctctgcaacttcatcgccgacaacatgcacctcacaggcgagggaaaacgaaaagtctttgcctccaacggacaaatcacagcgctactacgcagccggtggggcctcgccaagagccgcgaggacaacgaccggcaccacgcactagacgcagtggtcgtcgcctgcagcaccgtagcaatgcaacagaaaatcaccagattcgtcagattcgaagccggagacgtcttcacaggcgagcggatagacagagaaactggggaaataatcccactacacttcccaacgccctggcaattcttcaagcaggaagtcgaaatccgaatattcagtgataaccctaaacttgaactcgagaaccgcctaccggatcgaccgcaagccaatcacgagtttgtccaacccctcttcgtcagccgaatgccgacaagaaaaatgaccggccaaggtcacatggaaacagtaaaaagcgccaaacgcctaaacgaaggtatatcagtcatcaaaatgcccctaaccaaactgaaactaaaggacctagaactgatggtcaacagggaacgcgaaaaagatctatacgatacactaaaagcccgcctagaagccttcaacgacgaccccgccaaagcattcgcagaacctttcataaagaaaggcggagccatagtcaaatcggtaagagtcgaacagatacaaaagtctggagtgttggtcagggaaggaaacggcgtggccgacaacgcctccatggtccgagtcgacgtctttacaaaaggaggaaaatatttcctggtccccatttacacctggcaagtcgccaaggggatactcccaaacaaggcagcaacccaatacaaagacgaagaagactgggaggtcatggacaacagcgccacctttaaattcagcctgcaccccaacgacctcgtaaagctagtaacaaagaagaaaacaatactaggatactttaacggcctgaaccgggcaaccggaaacatcgacataaaagaacacgacctcgacaaaagcaaaggtaaacaaggaatattcgaaggtgtcggcatcaaactagcgctctcattcgaaaagtaccaagtagacgaactgggaaagaacatccgattatgcaaaccaagtaaaagacagccagtaagatga

SEQ ID NO: 6128 - RNA, 3168 nt, synthetic construct
  misc_feature 1..3168: note = Cas9 variant
  source 1..3168: mol_type = other RNA
atgaacaactacatcctgggactagacatcggcatcacaagcgttggctacggcatcgtcgacagcgacaccagggaaatcaaggacgccggggttcgtctgtttcccgaggccaacgtcgacaacaacgaagggcgccgctccaaacgaggagcccgccgactcaagcgacgtcgaatccaccgactagaccgcgtcaagcacctcctggccgagtacaacctcctcgacctaaccaacatcccgaaatccaccaacccataccagatacgtgtaaagggcctgaacgaaaagctcagcaaggacgaactcgttatcgccttactgcacatcgccaagcgacgaggcatccacaacgtcaatgttatgatggacgacaacgactccggcaacgaactcagcaccaaagaccagctcaagaaaaacgcgaaagcactgtcggataaatacgtgtgcgagttacaactagagcgtttcgaacaagattacaaagtacgcggcgagaaaaacaggttcaagacagaagacttcgtcagagaagcacgtaagctcttagaaacccagtcaaaattcttcgaaatagaccaaacattcatcatgcgctacatcgatctcgtagaaacacgcagggaatattttgaggggcccggaaaaggaagcccctttggctgggaaggaaatataaagaaatggtttgaacagatgatgggccactgcacctatttcccggaagaactccgatccgtaaagtacgcctactccgccgaactattcaacgccctaaacgacctgaacaacctcgtgataacacgagacgaggaagctaaactaaactacggcgagaaattccagatcatcgagaacgtattcaaacaaaagaaaacccctaacctaaaacagatcgccaaagaaatcggtgtctccgaaaccgatataaagggctaccgagtcaacaagagcgggaagcctgagttcacccagttcaaactgtatcacgacctaaagaatatattcgaagactccaaatacctgaacgacgtacaactaatggacaatatcgccgaaataataaccatctaccaagaccccgaaagtataatcaaagaactcaacctcctacccgagttgttaagcgaaaaggagaaggagaaaataagcgcactctccggatacgccggcacccaccgactgtcccttaaatgcataaacctactcctagacgacctatgggaatcgagtcttaaccaaatggaactgttcacaaaactcaacctaaaacccaagaaaatcgacctttcacagcagcacaaaatcccaatcaagctggtcgacgacttcatcctcagccctgtcgtcaaaagggcgttcatccagtctatccaagtcgtaaatgcaataatagacaaatacggacttccagaagacataataatagaactcgcccgcgagaataacagtgacgaccgccgcaaattcctgaatcagctgcaaaagcaaaacgccgaaacacgaaaacaagttgaaaaagtcctacgcgaatacggaaacgataacgccaaaaggatagtacaaaagatcaagctccacaacatgcaagaaggcaagtgcctctacagcctcaaggacatacccctcgaggacctgctaaagaaccccaatcattacgaagtagatcacatcatcccaagatccgtagcattcgacaattcaatgcacaacaaagtactcgtccgagccgaagaaaacagcaagaaaggaaaccgcacaccctaccagtacctcaactcttcagaaagcagcctctcatacaacgagttcaaacagcacatactgaacttatcaaaaacaaaagaccggattaccaagaagaaacgcgaatatctcctggaagaacgcgacataaacaaatatgacgtccaaaaggagttcattaaccgtaatctagtagacacccgctatgccacgcgcgaactcacatccctcctcaaagcctacttcagcgccaacaacctcgacgtcaaagtaaaaaccatcaacgggtcctttacgaactacctccgcaaggtctggaaattcgacaaggaccgcaacaagggatacaaacaccatgccgaagacgccctgataatagccaacgccgatttcctcttcaaacacaacaagaaactacgaaacatcaacaaagtccttgacgcgccctcaaaagagatagacaaaaagcgagtcacagtccaatcagaggatgagtataaccaaatgttcgaagacacccaaaaagctcaagctataaagaaattcgaaataagaaaattctcccaccgggtcgacaagaaacccaaccgacaactgatcaaagacacactttacagcacccgaaacatcgacggcattgaatacgtagtcgaatctatcaaagacatatacagcgtcaataacgacaaagttaaaaccaaattcaagaaggacccccaccgactgctcatgtacagaaacgaccctcaaacattcgaaaaattcgagaaagtcttcaaacaatatgaatccgagaaaaacccattcgccaaatactacgaagaaacaggcgaaaagatccgaaagttctccaaaaccggccaaggcccctatatcaacaaaataaaatacctacgcgaacgcctcggccggcactgcgacgtcacaaacaagtacatcaacagtcgaaacaaaatagtccagctaaaaatatacagctaccggtttgacatataccaatacggcaacaactacaaaatgatcactatctcgtacatcgacctcgaacagaaatctaactactactatataagccgagaaaagtacgaacaaaagaagaaagacaaacaaatagacgactcctacaaattcatcggatccttctacaaaaatgacatcataaactacaacggagagatgtacagagtcataggcgtgaacgacagcgagaaaaacaaaatccaactagacatgatcgacatcagcatcaaagactacatggaactcaacaacatcaagaaaacaggcgtaatatacaaaactatcggcaaatccaccacccacatagaaaaatacacgaccgacatcctgggtaatctatataaggccgcaccgcccaagaaaccgcaactcattttcaagcgcggcatggaatga

SEQ ID NO: 6129 - RNA, 3168 nt, synthetic construct
  misc_feature 1..3168: note = Cas9 variant
  source 1..3168: mol_type = other RNA
atgaccccaatctcagaaagtctcctcttcgggttagacgtcggaatctcgagttgcgggtgggccgtcctcaaacactcagacacgactggccacatagaagcgctaggaagctggtgcttcaatgcccccgaaacgaagaccgaacgaaccccaaccaaccaaatacgacgttcgtcacgcctactacggagagtcgtaagacgaaggcgcaaccgcatgacagagatccgcaggctattcgcaagacacggcctcattgacaacgatcgtcccgacgcactccgacagccagcaatagacccatgggaaatgcgagggcaaggactcgaccgacaactcacccccgaagaatttgcggtagctctcgcacatatcgcgaaacacaggggcttcaaaagtagtgcaaaacgagtgaaatccaacgccagcccagacgactccaaaatgctagcggcactagagaaaacaaaagaactctcagcccaatacaggacaataggagaaatgttcgcgcgagacagcgcttacgtccagagaaggcgcaaccgagacggactatttgacagaaccatctcacgagacgacttgatcgacgaagcaaaaatactcttcgaccgacaaagaaagctaggaaaccccgtagccagcactgaaatagaagaagcattcacacgaatagccttctggcaaaaccccatgcaagactcaggcgtcctagtagcctcctgcccatttgaaccaaaagagaaaagaagcagccgcttcagccccagcttcgaacgcttccgcctcctatgcagactcattaacctacgggtgaccgacggacccgaagaaagacccctaacagaagaagaactcagattagcctacgaacacgccggcaaaacccggaagctcaccgccgccgcaataaggaaactcataggactacgagacgaccaacacttcactaccataccacccgagcaggaaaaacaggatataactagccgcaccggcgagaccttcgccggaacggccaccttcagaagcgtgctcggcgaatccctctggcgccaactactaccacaccctgagtggctagacaatgcagcgtggataatcagcttccatgaactcacggaaacaataatcaagaaactgggagaaatcggactacccgtagaggcatacgagctaatctgcgacgcactaaagagcgataaaagtcccttcgcaaaattcaaaggagccagctccctatccgacaaagccgtacgcgcacttataccatatctccagcaaggactcacctacgacaaagcctgccaaaaagctggttacgatcacgccgcatcaagattttcgggacgtgcaacaatcgacaccaaagcgaaattcaacgccctcatggccgaagtacgagacagtatcgccaacccaatagcgaggaaagcacttagcgaaggaatgaaacaattatgggccatgcgaaacagatggggcctaccaggggccatctgtatcgaactagcaagagacgtaggcaactccctcgaaaaacgaaaagaaatagaacgcaacctgaaaacaaccgccaaacaaagagctagagagagagaagaagcgtgcgagctgcttaacctaaaagaagtcagcagcgatatcctactccgataccgactctggaaagaacaaggaggtagatgctgctacagcgggaaaagcattacccccgacatgctcatggcgcaagacaaccgcatacaaatcgaccacatacttccttggagccggttcggcgacgactcatactccaacaaaggcctctgcctagctaaggaaaaccaggccaagaaaaaccaaaccccctacgaatggatccacgggcaaggcaccacagcacaaaaagagcagtgggacaaattcgtagccgacgtcgagagccggaaaaacacgaaaggcctgaaaaagcgtaacttcttgttaaaaggatcgaaagagattgaagaaagattccggagccgcaacctgaatgacacacgctacgccgctagactcatggtagaagcggcaagactcctctaccctgcaggccaacgcggcgaaaaaggaggcacacgacgcgtcttcacaagaccaggcgcactgaccgccgcacttcggcacgcatggggcgtcgaatccctgaaaaagatagatggggaaagactccacgacaaccgccaccacgccctagacgcagcaatagtcgcagccgtctccgaggcagaaatacaaaaactcaccaaatctttccaggaatgtgaacaaaagggcctcagtagacccatgcgcgacgtagccccaccctgggacggattccgagaccaactaaaagagaaatacgaaacaatattcgtagccaggccggaacgtcaacgggcccgcgggcagggacacgaggccaccatacgacaagtccgcgaagaggaaaccggcccagtgatatacgaacggaaagccgtaagcgccctaaccctagctgatctagccaagataaaggacccggaccgcaacgccggactcatagccagcttgcgacaatggatcgaagcagggaaaccagccgacaaaccaccccgtaccccatgccaccaaagcgccgccggacacgaaatcagaaaagtacgcctcgcgacgattatcacaccggcagtgcccgtccgcggcggcatggcaaaaagaggagaaatgacccgcgtcgacatcttcaaagttatcggcaagaaaggcaaacccgagtggtacatgatcccaatatacccccaccaaatcatgaaccgaagccaatggcccgcgccaccaaacaaagccgtggtagcaggaaaatctgaggcggactggcccattatgggcgccgaagcacaattccaattctcattgtacccatgcagctatgtcagactcttcaaagagggaacagtaatcgaaggatacttctgcggctgccacaggagccgtgcctatataaccctcgcacttagtacaggcgcagccccgcttcagaaaggaatcggcataaaaactcaagagcatatccagaaattcagcgtaaaccgcttcggagagctatcacccgtaaaacaagaaaccagaacatggcacggcgtagcctgtacctcgcccgatcaacacgactga

SEQ ID NO: 6130 - RNA, 3171 nt, synthetic construct
  misc_feature 1..3171: note = Cas9 variant
  source 1..3171: mol_type = other RNA
atgaaggccctaaactacatcctcggcttagacctcggcatcgcaagcgtaggctgggcggtcgtcgaaatcgaccagaacgagcttccaataaggctcatcgaccttggagtaagaaccttcgaacgtgccgaagtccccaaaacaggagattccctcgccctcgcgagacgcctggcccgatcatcccgccgactcgtacggcggcgcgcagtcagactactaaaagccaagcgcctcctaaaacaagagggcatcctccaagccgacgactttcactcatcacacctaaagcccctccctaacaacccatgggaactacgggtaaaaggcttaaaccacctcctcgatagaaaagaatgggccgccgtactcctacacctactaaagcaccgggggtacctatctcaaagaaagaacgaaagcaaaaccgacaacaaagagctcggcgcacttctaaagggagtgtccgaaaatcggcaactattacaagcccaggctttcagcactccggccgaaattgccatcaagaaattccaacaagaagaaggacacatccgcaaccagcgaggagcctactcccacaccttcgatcggaacgacctactagccgagctacgtctactcttccagaagcagagagagttcaacaacccctacacatcgcaaagcctcgaacaagcaatcgcggaactcttaatgtggcaaaaacccgccctgtcgggcgaagccatcctaaagatgcttggcaaatgcacgttcgaaccctccgaatacaaggccccgaaaaactcctacagcgccgaatattttgtctggctgaccaagctaaacaatctccgcatcttagaaaacggggccgaccgcggactaacggcagaggagcggcaactcctgatcaaccaaccattcgaaaaggcaaagttcacctacgcccaagcccgaaaactactcgaactgtcagacctcgccatattcaagggcgtccggtacgggaaagacaacgcagagagcgccacactgatggaaatgaaggcgtggcacgccatacgcaaagcactcgaatccaacggactcaaaacagagtggaacggcctaaagaccaaacccgaacttctcgacaaaataggcaccgcattcagcatctacaagaccgacgaagatatatctcaatacctaaacggagaactcagccccgcagtcctaaacgccctactcgaaaacctatcattcgataaattcatacgcctctccctacaatcactcgccaaaatactccccctgatggaacaagggctacgctacgatgaggcttgcaaacaggtctacggtgaccactacggcaagaaagaacagcttgaactccggttcctccccaaaattcccgtcgaagacatccgaaacccagttgttctccgtaccctatctcaagcccgaaaagtaataaatggagtcgtccggctatacggtagcccagcccgaatacacatcgaaactggacgagaagttgggaaatctttctccgaaagacgcgacataagcaaacgacaagaagaaaaccgcaatgaaaggcaacgcgcagtcgaaaagtttaaagaatttttcccccacttcgtaggagagcctaaagcgaaagacatactaaaaatgcggctttacgaacaacaacacggcaaatgcctatactcaggtaaagaactcgacctcaacaggctactcgagaaaggctacgtcgaaatcgaccatgcactgcctttcagccgaacgtgggacgactcgttcaacaacaaagtcctcgtcctagcgagcgagaaccagaacaaaggaaaccaaaccccatacgaatggctaaacggcaaagaaaacgccgagcgctggaagctgttccaggcactggtcaacggatccaggttcccatacagcaagaaacaaaggatcttgacaaagtatctggatgaagatggattccgagaacgcaatctcaatgacacccgctacgttgcacgcttcctctgcaacttcatagaggacaatatgcaactcgtgggccagggaaagaagcgagtcttcgcctccaatggccagataacagcactgctacgacgctcatggggaatccaaaaagtacgagaagacaacgaccgacaccacgccgtagacgccgttgtagtcgcctgctcaactagagcgcttcagaagaagatcactgactatgtaaggtacaaagagatgaacgtcttcacaggggagaaaatcgaccaagaaacaggcgaaatcatcaaattccacttccccgaaccctggaagttcttccgccaagaagtggaaatacgtgtcttctccgaaacaccagcagaagacgtagtaatagcactacccgaccgaccacaagcaaaccacgagttcatccagcccctatttgtctcccgggccccaacgagaaagatgacaggacagggccacatggaaaccatcaaaagcgcaaaacgcctcgcagaaggtctcagcgtaagccgggtaccactcacccagctcaaactcaaagatctagaaaacatggtaaacagagaacgcgaaaaagccctctacgaggcacttaaagtgcgactcgaaaagttcaataatgaccccgctaaggccttcgcagacccgttctacaagaaaggaggacagcaagtcaaagctgtacgcgtcgaacaagtccagaaaagcggggttctcgtccgacaggaaaacggggtcgcagacaacgcctccatggtaagagtcgacgtcttcatcaaaggaggaaaatacttcctagtaccgatttacacatggcaagtcgccaaaggaatcctacctaaccgcgcggcaacccaggggaaagaggaagaatattgggacataatggacgagacagcaatatttcaattcagcttataccaaaacgacctcatcaaactggtaaccaaaaagaaaacaatattcgggtacttcaacgggctcaacagagcaacaagcaacatcaatataaaagaacacgatctcgacaaatcaaaaggcaaagacgggatatacctcgaggtgggagtaaaactagccctctcactggaaaaatatcaagtcgacgagctaggaaagaacatccaaccttgccgctccatgaagaaaagaccccctgttcgatga

SEQ ID NO: 6131 - RNA, 3171 nt, synthetic construct
  misc_feature 1..3171: note = Cas9 variant
  source 1..3171: mol_type = other RNA
atgcccaaacagaaatcgacccggtacaggctagcgcttgatctaggcagcacaagtctcggctgggcggtcctcagactcaacgaacaacacgaacccaacgcaataatccgcgcgggggtaagaatattcagcaatggaagaaaccccaaagatggcagcagcctagccgtgacaaggcgtgcggcccgagctatgcgccgcaggagagacagactcctgaaaagaaaagcacgaatgatgaacaaactggtagagtacgggtttttccccgccgacgtcgcagaacgaaagaaactagagagaataaacccatatgaattgcgagccaaaggactagacgccccgttgacccccggggagttcgcacgcgccctattccacataaaccaaagacgaggattcaaatcaaaccgcaaaacagataagaaagaaaacgacagcggcgcgctcaaagccgcaatctcacacctccggcaacaactacacgaaagaaaagcccgaacagtgggagaatggctctggcaacgactacaagcaggtcttggcacaagagcgcgctatagagaaagtagagtcgcacaagcaaatggaaaaacccgaatagaaaaatcctacgacctctacgtagatagacaaatgatcgccgaagagttcgacgccctatgggcagcccaggccgcattcaacccccaacaattctcagaacaagctcgaggggaattacgcgacgtactgttattccagcgtgacctgcgaccggtacgtccaggacgatgcaccctactcccagacgaagaaagggcaccgctcgccctaccgtcagtacagaggttccgaatcctacaagaagccaaccacctcagactactacaccccgatctccgcgaagaacctctctcccttgcccaacgggacgccgtggtcgacgcattagaacacaattcaaaaaggacattcgaacaactaaggaaattactgaaactgaacggcactgtaaaattcaaccttgaagacgagaaacgaaaggagctaaaaggcaacgcaacgagcgccaccctcagcaaagacggcctcttcggcgagaactggtggaacctagacgaggcgctacaagacgcgatagtatggcaactcgtatcagagcaatccgaagaaaaactacagaactggctccaagccaacacgggagtcaacgcaacacaggcagagacgatcgccaacgcgggcctccctgagggctacggcagtctaagctacaaagcgctcgcaagaataatccctgccctacgaggcacagaagtagcaaacggaatcgacgtgccacgaacttacgaccaagcagtccaagcagcaggattcgcccaccactccgatctggacagcggcttcgatttcgaacacagccatgacgaagtggagagaataggcgagcgcgtcattgccagcacaggcgaagtaaaaccagtattcgcgtttaaacaactaccctattacgggaaagcactcaggcgacacgtcgcattcgcaaaagaacacccacgcaatgaagaggaacgctacggaaaaatagccaaccccaccgttcacatagggctcaaccaactacgggtagtagtaaacgcactaatccgaagatacgggcgtccaaccgaggtcgtagtagaactcgcacgcgacctaaaacagtcccgggagcagagacaagaagaacaaaagagacaagcggactaccaaaagagaaacgaacatatacggagagaaatcgcgagcatgcacgggtgcgccgaggaacgtgtaagccacgccgacgtacaaaaatggatcttatgggaagaactaagtttcgacgtcgccgaccgaagatgtccgtacagcggagtccaaatatcggcccaaatgcttctaagcaaccaagtagaaatagagcacatcctacccttttcccaaacactagacaatagcctaaataatcgaacggtcgcaatgagacaggcaaacagaatcaaaggaaacagaacgccatggcaagcgagggaggatttcgagaggcaagggtggtcatacgattccatactccaacgagcagaacggatgccaaaagccaaacgatatcgcttctcacgagacggatacgaacggtggttaaaagaggacaaagattttctcgcccgagccctaaacgacacccggtacctcagccgagtcgccaaaacatacatggagctagtatgtcccctgggcacacgggtcatccccggtcaaatgacagccctacttagagcgaaattcggcctaaacgatgtcctgggcctaaacggagagaagaaccgagacgaccacagacaccacgcggtagacgcctgcgtgatcggcgtcaccgaccaaggcctactccagagattcgcgcaagccagcgccgatgcccgaggcaacgggttggaaaaactcgtcgaaaacatgcccgtaccatgggcaacataccgcgaccacgtaaaacgagccatccaatgcatctgggtctcccacaaacccgaccatgggtacgaaggacccatgatggaagaaaccgcgtacggaatcagaaaagacggctcaatccgacagaaaactaaagccgacggctctaccgggcgagaaatcacacatctgatccgaatcacggagccaacacaaaacctgagacacggcgtggacgcacagggccaaccgttagcatacaagggctacgtcggaggatctaacgactgcatcgaaatcacgcagaacgaacaggggaaatgggaaggaaacgtcataacaacattccaagcctacgacatcgttcgcagactcggatcaaagcaaggacccagacgcctgcgccatccaaccctcgcccaaacactagacgtgtacggcaagccaaagaagctagtgatgcgattgatgatagacgactgcgtaagactggaactcgatggcaacaagaaaacactacgagtcgtcaaaataacaggcaacggacaagtttttatggcaccagttcacgaagcaaacgtggacaaacgaaacagcgacaaaacagacccattcgcgtacgtatcgaaatacgcaggctcattccaaaaagcaaaagcacgcaggataacgatctcccccatcggagaactacacgatcctggattttga

SEQ ID NO: 6132 - RNA, 3174 nt, synthetic construct
  misc_feature 1..3174: note = Cas9 variant
  source 1..3174: mol_type = other RNA
atgtcagacaaatcgaaaatactcggcttcgacataggaatcacctcgatcggctgggcctacgtcgagggggaagaactgatagattgcggcgtacggatattcaccaaagctgagaaccccaagaccaaagagtctctagcactgccccgcagagaagcacgaggagtccggcggcgcctggcgaggcgaaaggggcgactcaacgccataaaacaactaatctgcaaagagttcgggctcaactaccaagactacatcgcccaggacggcgagctcccaaaggcgtacgcaggaaagctcatcaacccctacgagctaagatcaaaggcactccgcgagaaactcgaaaaagaagaactagcccgcgtcatcctccacattgcaaaacaccgaggatacggaaacaaacacgcaaaagagacagacgacgccgaatcgggcaagatcaagaaagccatctcgaacaatgagaaaatacttaacgaaaaaggctaccagtccgccggagaatacctctaccaagagttcttccaaaaagaaaggcttcaggaagaaaagaaaggcaacaacaccacgaaagagttcaaaaacgtacgtaacaaagccggggactacgaacactgcatcgcacaaacgcaaatgcaaaacgaactccgcctcatcttcgaaaaacagcgagaatttggactaaacttctccgaagagttcaaaaagaaagtcctcgaaacggccttctttcagcgaccactcaaagacttcagcgacaagataggagactgcacattcatagaaggtgcgaagcgcgcgcctaaagacagcctcagcgccatagagttcgtcgccctaggtagaataatcaatacactcaaaaacctgcaaaacaccagcggcgaagtctacagccgagacaagatcaacgaaatcttgcagatagtactcgacaagggcgaaatcagctacaagaaactaagagaaatactagacatcgaatcctccgtgcggttcaaagactcaaaattagactatacgaaagaactaaaggaagccgagaaaaccaaactcttcgaatcgaaaaacctccagaaattcaagaaggcgctcggatcattcgaaggcatatcaagggaaatactagacagcatcgcgaaggaaataatgattacaaaagacaaagagaaattagcaaaagaactcaagaaattccccctagatgaaacccagatccagaacctctccaacctgagcttcagccaaactatcaacttaagcctggaggccctcagccaaatcctgccattcatgcgtggcgagcgggaggacaaatgcctccggtacgacgaggccgtcgagaaagccggcctaaaggaagtcgccaaaaacaaaagtaaagacgacttcctaccacccctcgaaaattacgaaccctacctcgcaaaccccgtcgtcgcaagggcgctctccgaatacaggaaagtcctaaatgccctcctaagaaaatacggaaaaatgcacaaaatccacatagagttcacccgagaagttggaaaaagcaaggaggaacgcaacaagatagaaaaagagcagaaggaaaacttcgccaaaaaccaggaggcacaaaaacaatgcgaaatcctaggacttccaataaacggcgccaacatcctaaaaatgaaactgtggcgcgaacaacaggaatcttgtgtatacagcggaaaagagatagccatagacgacctgaaaaaccccgccatcctacaagtcgatcacatatacccatactcgcgctccttcgacgactcctacaacaacaaagtcctagtgttcagtaaggaaaaccaaaacaaactaaacaaaacacccttcgaggccttcggagaaaataaagacaaatgggagaaaatcctgagccttgcctccaaactgccgaaacccaagcggcaacgcatatacaacatgcaattcaaggacaaggaacagggcttcctcacacgcaacataaacgacactggctacatcgcgagactcgtctcccaatggaccaagaactgcctcagcttcgaaaagctatccgaggacgaagtaagcatcgcaggagaaaaaggcagcaaggtccacgtggaggtaatcagcggaagcctaacggcgatgctacgccactactggggactgggcgacaagaaccgggacaaccatctccaccacgccgtagacgcaatcataatagcatactcaaacgagaaagtgataaaagcgttttcagactacaagaagcacagagaacaaaacaaagcgaagttctatgccaaagaaatcgccgaatccgaatacaagaaacaaaaagtattctttgaaccaactaaccacttccgccaaaaagtcctagagaaaattgactcgattttcgtcagcaaaccaccgagaaaacgagccaggggcgccctccacgaagagacattctacagcttcgagcgactatgcaacgacaaagaatacgccaagaaagaaaagatggactacggcggcaaagctggcatccagaaagcaatcgccctaggcaaaatccgacaagtaggcacaaaaatcgtctcaaacggtaccatggtccgggtagatatcttccaacacaaatcgaacggaaaattctacggcgtccccatctacacaatggacttcgctctcggcgtactcccaaacaaggccgtagtcagtggcaaagacaagcaaggcgtcataaaagactggctggaaatggactcaaactacgagttctgcttcagcctcttcaaggatgaccttatcctcgtccagaaaaaggaaatggagaaagccgaactctgctactacaccgacttcaacagcaacaccgcgggaataaaattcgaaaagcataacaacctctacgtcaacctaaacgaaaacgagcgaaagctgttcacaagcaaagaggtcgtcaaaggcggcaagaaaaacgtctggaaagacaagacacctaaagaaatcgagcaattggagaaaaatcgaaaaatcatagggggattcgtaacgatcgaagacctcaaaaccttcgaaaaataccaagtgagccccctgggcgaagtccaaaaggcagacttcgcgccacgacaagccatcacgctcaagtcctcgcccaaacaccgcatcaacaaatga

SEQ ID NO: 6133 - RNA, 3174 nt, synthetic construct
  misc_feature 1..3174: note = Cas9 variant
  source 1..3174: mol_type = other RNA
atgagcaatcgagttccataccgactagccctagacctaggaacaaacagcatcgggtggtgcctattagatctaaacggaaacggagacccgtgcggcgtccggcggatgggcgtacgaatattcccagacggcagagatccaaagagcaaggaaagcctagcggccgaccgccgactcgcgagaagcatgagacggcgcagagacagatatctgaggcgacgcagcgcactaatgaatgctctagtcgcagcgggactaatgccagcagatcgtgcaacgagaaaagcactagaaagcgaggacccgtgcgaactcagagcgagggccctgttcgaaccgctaacagcggggcaagttggacgggctctcttccacctgaatcaaagaaggggcttcaagtccaacagaaaagcggcgggggaagagaacgaagcagggaaaataaaggctggaataagcgcactaaaagcagaaatcgaagcaagcggagaaacaacactcggggcatggttagcagccagacatcgaaaaagagaaacagtcagagcccgactcgacggggccggggccaaagcctcatacgagttctacccggaacgcggactggttcatgacgaatttcaagcaatacggacagcccaagcactgcaccatccagcggttacagcagaacaatgggaccgagtagaaagcgtgatattcagacaacgaccactaagacccgtgcgaccaggaaagtgtacgctctttcccgatcaggaaagagcaccctgggcgctaccggtggcgcaagagttcagaatcctaacagaaataggaaatctaaagctatacagaccaggagaggaaccccgtgaactctcagcggatcaacatgcccaactattcgcaaaactctgtcggagcgcagacctgacattcgagaaaatccgaaaagaactaaaactagacccgggactcaaggtaaacctggaaggggaaaagagagataggctgaaaggggatgcagtcacatctgcactaagcgcaaagaaaagattcgggcccaaatggaacgcacttacgccagacgacaggagagacatagtagggagactaatagaagcggaagacgaggctgaactggcggggtggctagagagcgtacacggtctaccaagcgaaaacgcagcacatacagccgcatcgccaggactgcccgacgggtactgccgcctctccgagaaagcactggtcaaactggtaccactgatgcgcgaacaacgcctgcgatacgacgaagccgtattggcgctgaacctccaccacagcgattttaggccagaaggactgctagacgaactgccctactatggagaaccattggagagattcatagcatttggatcaggggagcccagcgacccaccagaacagcacctaggacgattccccaacccaacggtacacatcgggctaaacgagctaaggaaactggtaaaccggatcgtagaacgatggggcaaaccggcagacatcgtggtagagctcgcacgtgacctaaaaagaagcagagacgaaagagacacgattcaacgagaacaagcgcaaaaccaaagaaagaacgaggaccgattcgccaaaatcaaagaactggggatcgacccacgacccgactcaatgctcaggctcagactctgggaagaactaccgaaagtaggagtaggacacgtatgcgtgtacactggcgagccaatcggtataaggagactgctcgagggagacgtcgacatcgaccacatactgccgttcagccgaacgctaagcgacggcgcagacaacaagatcgtatgcgtgcgcagagcaaaccgcttcaaaagggaccgaagcccatgggaggcgttcggcgtcacggcagtagacggctacgactgggcagccatagcgcagcgggcggaggagcttcccaaaaataaacgatggcgcttcctgccagacgccatggatagattcgaaggcgagcggggcttcctcgacagacagctagtcgagactcgtcacttatcccgcgtggcaagacaatatctagcaagcatcgtagacctcaacaaagtaagggtagcaccaggcaagctgacagccatgctccgagcaagatggggactaaacaaaatactgagcgacggcaacctcaagaatcgctccgaccaccgccaccacgcgatcgacgcagcagtattgggcatgatagaccaacggctagtacaactggtagcacaagcggcagcgagggcggaagcaaacgaactagagagattattcgacggactgccagacccattcgacggactagccgcaacgagcttcggggatcaagtaagagaaaagatccgcgggatcacagtgagccacagagcggagcacggctggcaaggcagaatgcacaacgacacggcgtacggaccggtagaggcagtcaacggagtgcacacagtcgtaacacgcaaaccactatcaggcctaacggcaaaagacttcccgaacatacgagatagggtgctcgcaaaagcacttgaggaccacgtggccgcagaagccgcggccggtcgatcattcggggacgcgttagggagcttcaaatggggaggacaacccgtacgaagagtacgcatgctagacgtactaggaaaccccatcccaatccaagacccaagcggtacagtattcaaggtgtacaaaggagacagcaacgcatggtatgagatcctaagggaccccagagggagatggacgggaaagatcgtgagcacattcgaggcatacagactccacagggagtggctagcggaaactggtggcgacagcggaagggggagcggtgtgttcctagactgggcagccaaaagggttgtaggcgaagccggaaccccactcttccgattattcaaaggagacctcctcgctctgggagaagccccagacaggagaatcgtacgcgtcgtaaagttcagcgaaggccaggtagctctggcactacacttagaggccggaaacctaaaagcaagagatgccgacaaaggagacccgttcaagtaccaatactgtagccccgacagcctaagaaagcaggcagcacgccctgcaggggtagacttactcgggtacgtacatgacaaaggaccactagagtga

SEQ ID NO: 6134 - RNA, 3174 nt, synthetic construct
  misc_feature 1..3174: note = Cas9 variant
  source 1..3174: mol_type = other RNA
atgcgccgcctcggactcgacataggcacaaacagcataggatggtgcctcatagaagacgacaagaaaattgtggacataggggtacgaatattctcggacggccgcgaccccaaaagcggagcatcgctcgccgttgatcgcagagacgctcgcgctatgcgacgccgacgggacagatacctcggacgcagatcggcgttcctacaggcgctcgtcgtccacggtttaatgccagccgatgccgatgaggcaaaactggtcgccgatcgcgatccttaccaactcagagccaaagctctccacgtcgcactcgaacccttcgaaataggcagagcactttttcacctaaaccagcgccggggattcaaatcgaacaggaaagcagacagaaaagccaacgccggggaagacggcaaaatagccgaaggcgcaaaagctctggatcaagcgatgtcggaggccggtgtagacacactaggccaattcctcgcgcttaaagaaacaaagcgagttcgactcggcagcgacggacaggcctacgacttctacccccaaaggcgccacatcgaatacgagttcgacagaatatggaaagtccaatctgaataccacccagcgcttctaaccgaagccgcacgagccgcacttcaccgcatcctatttttccaaagacccctaaaagcacaagaagtcggcttctgtaccttcgcaggagttaacggaatagccgccaacgagagacgcctacccaaagcgcacccactattccaacaacgaagactctacgaagaagtaaaccaactccgcatagtctccgccggagctgccgaccgcccattaacactagacgaacgtgaccgcttaatactccggttacaagaccggaagaaagtgagttttgataccctggcaaagaaagacctccgactggccgatggcgagagattcaacaaagaaagcgaaaaccgaaaagaactcatcggggacgaggttcgcgcagaaatgtccgacaagaaaaggtttggaacgcgatgggtacacttcggcctcgatgagcaactccggatacttgcaaaactacaagacgaagaaaacccagaagcacttttggactggctccgaagcgagtatggtcttgacgaagctgccgcagaaagtgtcgcgaacgccagattacccgagggctatggcagattcggagaaaccgcaactcgactactgctagacgccctcaaagcagaagtcattacctatgacaaagctgccctacgcgctttcggacatcactcggacttccgtaccggagaagtcctagatcggctcccatactacggagaacttctcacacgcgaaatagcacctggcaaacctgaatatggcgaccccctggagcgccaatacggaaaaatcaccaacccaacggtacacatcggactccggcaactcgagaaactcgtcaatgcagtcatcgcagtacacggacgccccgatcagatagtagtagaactcgcacgtgaactgaagctcaacgaaaaggaaaaggacgaacacaaacgaagaatcaagagagataccgacgccgccatcgcaagggggcgaaaattagccagcgaaggcttcatagacaacggagcaaacagaatgctcatgcgcatctgggaagaactaaaccccgccaatcccctcgacagacgatgcccctactgcgccgaaccgatcggaatcagagccctattctccggagaggcagacatcgaccacataatcccctactcacgcagcctagacgacaacgtgggaaacaaagtagtcgcccaccggtcttgcaatcgcgccaagggcaacaagaccccatacgaaaaatggggcccccacatagaccccgaaagatgggaacgcataagtgaccaagtagcacgcctgcataaatcgaaacagtggcgcttcggcccagatgccatggagagaatagacagagacggcgggtttctcgcccgccaactgacagacacacagtacctaagtagagtcgccgggaagtacctacgctccctgtatccaacggcacagtcaggccgcgtagacgtaatcccaggaagaatgacagccatgctccgtcggaaatggggccttaacagcctcctccccgaccacaactacgtcgagaacgaacactcaaacgcacccaaaaaccgactagaccacagacaccacgccatcgacgccgcagtagcagccgtcaccacccttagcctaatgcaacaaatagcggacgccgcaggccgagctgaagacaagaacttagacagactattcgaagacataccacaaccgtggccaggcttccgcgaagaactaggagaggctttacggtcaacaacagtgtcgcacaaagccgaccatgggcggaaacgacgaccatcccgcgacagagatgtcaccgccgcaagactacacaacgacaccgcatacgggctgacaggagacgtggccgcagacggaaagactcccatcgtagtccatagagtaccactagcaagcctcaaacccgcagacctaatagacccactccgcataccagacccggtcctgagagacgcactttacgcagcaacccgagaccgcacgggcaaggagttcgaacaggcattaacccaattcgcccgccaccaccccctcttcaaaggaatcagacgagtaagagtccgggaaccactcaatgtcataccaataagagacgctgccggccgtgcgtacaaggcctataaaggagatgccaacgcacgctttgacgtgtggagactaccaaacggaaaatgggtatcagacatagtatccatgttcgatgcgcactgcatggctgacaaatcagaccgtaggccccacccagccgccaagaaagtcctctcactcaggcagaacgacatggtcgcaatagaaagaagtggagtaacacagatcgccagagtcgtaaaattctctaccaacggctccatcgcactcgccgccgacaacgaagccggagccttaaaagcacgcgacgccgccccaaacgacgttgaccccttcaaatacatattctcatctggaggaggcctcaaaaacctcaaagcacgccaggtacgcgtagatcccctgggccgcgtgtttgatccaggccctcgcgagtga

SEQ ID NO: 6135 - RNA, 3177 nt, synthetic construct
  misc_feature 1..3177: note = Cas9 variant
  source 1..3177: mol_type = other RNA
atgaagaactcctacattctcgggctggatgtagggatcgcaagcgtcgggtacggactaatccactctgactcaaaaagcgtcatcgatgccggcgtccgccttttcccggaagccaacgtagaaaataacgagggccgacgagcaaagcgaggctccaggcgcctaaaaagaagaagaatccatcgcctcgacagagtcaagtacctcctcgcgcagtaccacctcatcatcgacgacaaaattccaaaatccacaaacccctacgcgatacgtgtcaagggactctcctccgcactctccaagagcgagctcgtcatagcactcctccacctcgcaaagcgccgagggatacacaatgtaaacgttgtaatggacgaaaatgaaagcactaacgagctctctaccaaagaacagctaaaagaaaatgcaaagcagctggagaaccggtacgtgtgcgagctccaactggaccggctcaacgaacaatacaaggtgcgcggcgaaaggaatcgcttcaaaacagaggacttcgttcgcgaagcccgccagatactcaccacccaacaaaaataccacgatattgacgagcacttcatcgagcaatacactcatttactggaaacccgaagagaatactatgaaggacccggcaagggatcgcaatacgggtgggagggagacctaaaacaatggtacgaaatgctaatgggaagatgcacctatttccccgaggagctccgaagcgtcaagtacgcctacaccgccgatttgttcaacgcgctaaacgaccttaacaacctcgtaatagcacgcgacgaaaacgagaaactagaatactttgaaaaataccacattatcgaaaatgtattcaaacaaaagaaaagccccaccctcaaacaaatcgcgaaggaaattgatgtcaaagaatccgacatcaagggataccggatcacaaagaacggaaaaccccaattcaccagctttaaactctaccatgacctcaacaaaatattcctcgacaagaaaaacctcgaaaacatagagctgctggatgagatcgccttcatcctcacactctaccaagaccccctcagcatcaaggaagcgctcgatcaactccaagacctccttactgaaagcgaaaaagaggcgatcgcccaccttaacggctacaccggcacccatcgcctgtcgctcaagtgcctccacctactaatagacgaaatgtggcaaacatcccgcaaccaaatggaagttttcacggccctcaacctcaaaccccaaaaataccaactctctaaacaaaaacaaatccccaagaaaatggtggaagagttcatactctcccccgtcgtcaaacgtagcttcatccaatcaatcgaaatagtcaacaccatcataaagaagtacggtctcccggaagaaataataatagagctagcgcgcgaaaagaactccgaagacaggcgtaaattccttaaccgaatccagaaggaaaacgaaaacacccgcaagcaagtagaagaggtaataagagaatatggcaaccgaaacgccaaagggctagtagagaaaatcaagctacaccaaatgcaagaaggaaaatgcctatactcgctacagaacatacccctagatgacctcctccggaacccctcccactacgaaatcgaccacattatcccccgatcagtcagtttcgacaattcctttaacaacaaggtgctcgtaaaacaagaagaaaactccaaaaagggcaaccgcacgccgtaccagtacctcaactccaacgaaagcgtcctcagctacgtccaattcaaacaacacatcttgaacctcagcaagtcgaaagaaagaataagcaagaagaaacgagagtacctcctcgaggaacgggacataaacaaatttgaggtgcaaaaagagttcatcaaccgaaacctggtagacacacgctatgccacccgcgaactcgtccaactgttaaaatcatacttcagcgccaacgacctcgacgtcaaagtgaaaacaatcaacggctctttcacgaactacctcagaaaagcgtggaaattcgacaaaagccgcaacaaaggcttcaaacaccacgccgaagacgctctgatcatcgccaacgtatcctacctattcaaacaatcaaaagaactgaaagaagccaacgccatcctagaaaacaacaacctgagcctcaacaaaaacaaagactccaaaaacctcttgacggagcaggactaccgaaaaatgttcgaaatccctaagcaggtccaggacataaaggactacaaggacttcaaatacagccaccgtgtggacaagaaaccaaacagacagctgattaacgattccctctacagcacgcgagaggtcaacgaaaaccactacatcgtacaaacggtaaaagacatctacgcaaaagataacacaaagatcaaagaccttttcctcaaaacccccgaaaagctcttaatgtaccaacacgacccccaaactttcgagaagctcatgctcgtcataaaacaatacggcgaggagaagaatccgttcgccaaatactatgaggaaaacggcgaatacctcaccaaatatgcaaagaacgagaaaggaccaacaattaaacgtctgaagtacatcggcaaaaaggttggaacccaccttgacattagcacaaacttctcaggcgccaaacgcaaagtcgtacaactatcgataaagccctttcggttcgacgtgttccacagcaaagcaggctaccacatgctgacgctgacatacatggacatcaagaagaaagaaaaacactaccaaatactcaaaaacgaataccaagccctgaaagaacgctacaaagtaccctcagacgcgcaattcatcggcagcttctactataacgacctcatctcgatcaacgacgagctctttcgcgtcataggtgttaacaactccacccgcaacgtcgtagaactaaacatggtagatatcaactacaaagactactgcgacctcatggggatcaaaaagacaccacggatattcaaaaccatcaccaagaaaacgggaaaaatagagaagtacagcactgacatcctcggcaaccaattcaaggtcaagccctccaaaagcccccagctcatcttcaaacgaggtgtcctatga

SEQ ID NO: 6136 - RNA, 3180 nt, synthetic construct
  misc_feature 1..3180: note = Cas9 variant
  source 1..3180: mol_type = other RNA
atgcgtcgcctcggactagacattggtaccaactcaatcggatggtgcctaacgcaaggaccaggagacgaagccgacggaatagtagacataggagtaaggatattttcagacggaagagacccccaatccggcaccagcttagccgtcgacagacgagacgcaagagccgccagacgccgacgcgacagatacataggcaggagatccgcattcctagacacactcgtcgcccatggactcatgccagccgacgccgacgaagctaagctagtggcagctttagacccatacacactaagagccagagccctagaagccccactgacaccacacgaaataggcagagcactgttccacctcaaccagagaaggggattcaaaagtaacaggaaagcagaaaggaagaccaacgacgccgatgacgggaaaattgctaccgccgcatacgccctagacagagccatgctcgatggcggattcgacacgctagggcaattcctaaacgcccaagagacaaaacgtgtaagaatggacggcgaggcccaaggatacgacttctacccccaacgccgacacgtagaatacgagttcgatagaatctggacagaacaggcaaaacatcaccccgcactcttaaccgaaacagccagatacgccctccaccgcatcctcttttaccaaagacccctaaaggcacaggtcgtaggcaagtgcaccttcgtacactccgaggacagactcgcaaaagcacaccctctcttccaacaacgaagactatacgaagaggtaaaccaactagaagtaacaacccccggcgaagccaatcgcaaacttacacttgacgaaagagatcgcctggtcagagaactgtcccataagaaagcaatcgcttttaccagcctcgctgcaaaaataaaactagaacctggccaatccttcaacaaagcgtcagagaccaggacacaactggcaggcgacgaggtacgagccgtactaggcgacaagaaaaggttcggccccgcctgggagcacttcgaccgagaccgacaatggacaatcgtcgaacgtctcctcgaggaagaagacccagacgctctccacgcattcctcacccaagactgcggcctcgacgacgaacatgcagcagccacagcaaagaccagcctcccagaaggatacggccgcctcggcgcaaccgcaaccgcacgtatcctagcagaactgcaggccgaagtgatcacatacgacgaagccgtcagacgatgtgggtggcaccactcagaccaccgaacaggagaaatcctaccccaactcccatactacggagagctcctaacacgggatataccaccggggacacaagacccaaacgaccctcccgaaaaacgctggggccgaatcacaaatccaacagtccacatcggcctaaaccaggtcagacaattagtaaacgccatagtcgcagttcacggccgaccagaccaaatagtagtggaactcgcgcgcgaactaaaactcaacgaaaaagacaaagaagaacacaaccgcagaatcagacgggacacagccgccgctatcaaaaggtcggagaagttaacacaagaaggatttccagacaccggggcgaacagaatgttactaagactctgggaggacttaaacccagcaaacccactagatcgcagatgcccatactgcggagcgcccataggcatgcgagcgctattcgcgggagaagcagacgtcgaccatataatcccatactccagatcactcgacgactcagcaggaaacaaagtagtagcccaccggagctgcaacagagccaagggcaataggaccccgtacgagaagtggagcgatgacccagaccggtgggacgccataaccgcccaagtagcacgactacaccgcagcaagcagtggcgctttggaccagacgcaatggcccgcgtcgaaaaagacggcggatttctatcacgacaactaaccgacacacaatacctatcacggcttgccggacgttacctctcatccctgtacccgacaaaagaagaagggtcagtatacgtcatccccggaagaatgaccgccatgctgcgtcgtctatggggactcaacgacatactctccgatcacaacatagtcgagaacaaacattccaacgccccaaagaacaggctagaccacagacaccatgcaatagacgccgccgtggtagcagtctcaacccgatcactaatgcaacgaatagcacgaacagcagggcaagctgaagacaggaacctagacagactattcgaaggtctagatccaccgtggccagggtttcgtgaccaactcagagaccgactacttgcggtgactgtaagccacaaagcagaccacgggagaacaggcacccccgtcccaggcaaagatgctacagcaggccgactacacaacgacaccgcgtacggattaaccggggaaaccagcgccaagggactccccatagtggtccaccgagtccccctgacgagtctgaagcccgcagacatcacagaccccgaccgcataccagatccagtgctccgtgatgcaatagaacgcgcgaccgccgggaaaatgggcaaggacttcaccgatgctttggcaaaattcggccgctcaggggcccaagaaacagatcgaaaaggagaaagactgttcaggggaacaagacgggtccgcgtacgcgaacccttgggcgtaataccaatcgcagatgcatccggacgagtctacaaggcttacaagggtgacagcaacgcgagattcgacgtctggcgactccctgacggaaaatgggtctcagacatagtttccatgttcgatgcacacaggccagaccaaggagaccgacgcccacatcccgccgccaagaaagttctctcccttcgacaaaacgacatgatcgccatagaaagggacggcgcaccacgcgaaatcgtaagagtcgtcaagttcagcacgataggatctgtgcaactggccgcaacaaccgaggccggtccactaaaagctcgcgacgccagcccacccgatgtggacccctttagatacataaactcctcagccggcggactaaagaaaatcaaagccaggcaagtacggatcgatccactcgggaggatcttcgaccccggcccccgctga

SEQ ID NO: 6137 - RNA, 3180 nt, synthetic construct
  misc_feature 1..3180: note = Cas9 variant
  source 1..3180: mol_type = other RNA
atgatagaaagaatcctcggcgtagacctaggcatcagcagcctagggtgggcgatagtggaatacgacaaggacgacgaagccgcaaaccgcataatcgactgtggcgtacgcctctttaccgccgcagaaacccctaaaaagaaagagtccccaaacaaagccagaagggaggcccgaggcataagacgcgtactcaaccgacgaagagtgagaatgaatatgataaagaaactgttcttacgcgccgggctaatacaagacgtcgacctagacggcgaaggagggatgttctacagcaaagcaaatagagccgacgtatgggagctgcggcacgacggactgtacaggcttctcaaaggagacgaactcgcgcgtgtccttatacacatcgctaaacaccgcggctacaaattcataggggacgacgaagccgacgaagaatccgggaaagtgaagaaagcaggggtggttctccggcaaaatttcgaagcagcaggctgcaggaccgtgggcgagtggctttggagagaaaggggcgcaaacggcaagaaacgcaacaaacacggagattacgaaatcagcatccacagagacctgctcgtcgaagaagtagaagcgatcttcgtcgcacaacaagaaatgaggagcaccatcgcaacagacgcactcaaagcagcttacagggagatcgccttcttcgttcgacccatgcaaaggatcgagaaaatggtaggacactgcacctactttccggaagaacgaagggcccccaaatcagcgccaacggccgaaaaattcatcgccatatccaaattcttctctactgtaattatagacaacgaaggctgggaacagaaaatcatagaaagaaaaaccctcgaagaactattagacttcgccgtaagcagggaaaaagtagagttccgacacctaaggaaattcctcgacctatcagacaacgaaatcttcaaaggactgcactacaaaggaaaaccgaagaccgcgaagaaaagagaagcaactctgttcgaccccaatgaacctacggaactcgagttcgacaaagtggaagcagaaaagaaagcatggatcagcctgcgcggcgccgcgaaactaagagaagcactaggcaacgagttctatgggaggttcgtcgccttaggaaaacacgcagacgaagcaaccaagatactcacttactacaaggacgaaggccagaaaagacgcgaactcacgaaattacccctcgaagccgagatggtagaacgactcgtaaaaataggattcagcgacttcctgaaactcagcctaaaagcaatacgcgacatcctcccagcaatggagagcggcgcgcgctacgacgaagccgtcctcatgctaggggtcccccacaaagaaaaatcagcgatcctgccacccctgaacaagaccgacatagacatactcaacccgacggtcatccgcgcattcgcgcaattccggaaagtagccaacgcactcgtccgaaaatacggggccttcgacagagtacacttcgaactggcgagagaaataaacacaaaaggcgaaatcgaggacataaaagaaagccaacggaaaaacgagaaggagcgaaaagaagccgcagactggattgcagagacctcgttccaagtcccgctaacacgcaaaaacatcctaaagaaaagactatacatccaacaagacggcagatgcgcatacacgggggatgtaatcgaactagagagactcttcgacgagggatactgcgagatagaccacatcctaccacgatcacgatccgcagacgacagcttcgccaacaaggtgctatgcctagccagggcaaaccaacagaaaacagacaggacaccctacgagtggtttggccacgacgccgcccgctggaacgcattcgaaaccagaacgtcggcacccagtaaccgcgtgcgcaccggcaaaggcaagatagacaggctacttaaaaagaacttcgacgaaaactcagagatggccttcaaggaccgaaatctaaacgacacacgctacatggcacgggccatcaaaacctactgcgaacaatactgggtcttcaaaaactcacacaccaaagcacccgtacaggtcagaagtggcaaactaacgtcggtcctacgctaccaatggggcttggaaagcaaggaccgagaatcccacacacaccatgcagtagacgcgatcatcatagcattcagcacccaaggaatggtacaaaaactgtcagagtactaccggttcaaagaaacacaccgcgagaaagagagaccaaagctagcagtacccctcgccaacttccgcgacgcagtggaagaagcaacccgaatcgaaaacacagaaacagtaaaagaaggagtcgaggtgaaacgcctgctaatctcgcgcccacccagagccagagtaaccggacaagcccacgaacaaacagcaaaaccatacccccgcataaaacaagtcaagaacaaaaagaaatggcgactcgcgccgatcgacgaagaaaaattcgaaagtttcaaagcagaccgagtcgcctccgcaaaccagaaaaacttctacgaaaccagcacaatcccccgagtcgacgtctaccacaagaaaggaaaattccacctggtcccgatatacctacacgaaatggtcctcaacgaactaccgaatctcagcctaggcacaaaccctgaagcgatggacgaaaacttctttaaattcagcatattcaaggacgacctcatcagcatccagacacaagggacaccaaagaaacccgcgaaaataatcatgggatacttcaaaaacatgcacggcgcaaacatggtcctcagctcaatcaataactccccatgtgaaggatttacctgcacaccagtatcaatggacaagaaacacaaagacaaatgcaaactctgcccagaagaaaaccgcatagcaggaaggtgcctccaaggcttcctcgactactggtcgcaagagggcctgcgtccaccaagaaaagagttcgaatgcgaccagggtgtcaaattcgcgctggacgtaaagaagtaccagatagatccacttggatactactatgaagtaaagcaagagaaaagactgggaaccataccacagatgcgctcagccaagaaactggtcaaaaagtga

SEQ ID NO: 6138 - RNA, 3180 nt, synthetic construct
  misc_feature 1..3180: note = Cas9 variant
  source 1..3180: mol_type = other RNA
atgtcgaaaaggctcagatatagactggccctggatctcggaacgaactcgatcggattctgcctactggacctaaacggcgatggaagaccatgcggcgtgagaagaatgggcgtaagaatattcccggacttcagcaaactacaacaatcattagcagcagacagacgcttagcgcgaagtatgagaaggagacgagaccgctacctacgaaggcgaaaggctttaatgaacgcacttgtggcggcagccttgatgcccgcagaccctaaagcaagaaaagcactggaggcactagatccatacgaactaagagccgcagcagtagcaggaccgctgcccgcgcaccaactgggaagggcactattccatcttaaccaaaggcgcggcttcaagagcaacagaaaagccgcaggagacgagaatgaagcaggcaaggtaaaaagcggaatatccgcactaaaggcagagctagccgcctcgggagccgggacactagggcagtggctggccgccagacacgcaaatagacagcccgtgagagcacgcctcactggaacaggagcgaaggccacatactcattctacccagaacgcgcattagtacacgaagagttccaagcaatacgagcagcacaagctccacatcacccaggagtaacggccgaacaatgggaccgcatcgaaagcgtcatcttccaccaaagacccctcaaaccggtaaaaccgggaaaatgcacactgtacccagaagaagaaagggccccgtgggcgctgccgatcgcacaaagattcagaatcctgcacgaactccacaacctacgcatagtaagaccggggcagggagaggaggggctcagcccagctgacttcgaccgattcttcgacagactgtgtagaaaaggagacctaacctttaaaaccttagcaaaagaactcaaactcccacccgacgcaagaataaacttagaagacgacaaaagggacagactaaagggagacgcaacagcagacgccctaagcgcagaaaagggcaagcgacgaagaatcggagcagcctggcatagcttcccagccgaccgacaaagagaaatagtaggcagactaatagacgcggaagacgaaggggaactagcagcatggttagtcgaagaactcggactcccgtgggaggtagctatactgacagccgaaagaccgggcctacccgacggatactgccggctctcggagaaagcgctagagcaagtagtaccactaatgcacgaggaacacctcccctacgatgaagcagtacgcgcactcggattacaccatagcgaccatcgcacaggcgagttcctagacgaacttccctactacggattaccgctggaacggttcatagcattcggcaccggggaggcagacgaccctcccgaactaagaattgggagatttccaaaccccacagtgcatgtagcacttaacgaactcagaagagtggtaaaccggattatacgtcggtggggaaaacccgaggaaatagtcgtagagctggcaagagacctcaagcaatcgcgggccgacagggacaaaacgcaacgcgagcaagcagataatcaaaagaaaaactggacacgaacacaacaactcagagaattagggatggaacccacaggagaggccttactccgactccgcctctgggaggagctaccacgcatcggaagtgcgcacgtgtgcgtatacactggacaacccataagcatgacccagctcctccaaggggacgtcgacgtagaccacatcctccccttcagccgcacactcgcaaacggcgcagacaacaaaatagtatgccaccgccgggctaacaggataaaacggaacaggacaccctgggaagcatttggagtcgtaagcgcggacggatacgactgggcagcaatagcggaacgagcagaaagtttaccgaaaaacaaacgatggcgatttctaccaaacgcaatggaacgattcgaaacagaacgcggcttcatagacagacagctagtagaaacaagacatttaagccgagtcgcaagagagtacctaggctgcatcgtccccctagaaaaagtgcgggcagcccccggcagactaaccgcaatgctaagaggacgatggggcctcaacagcatactgagcgatgcaaacctcaaaaaccgaagcgatcacagacaccatgcagtcgacgcagcagttttaggggtaatcgaccaacgcttagtccagagagtcgccgacgccgcaaaaagagcagaggaaaaagaactagaaaaactcttcgacgggttgccagacccatttgaaggactcccagggcccagcttccgggaccaagtacaagaacgagcacaaggcataatagtgagccacaaaccagaacacggatggcagggacgaatgcacaatgacaccgcgtacgggcccgtagaacgcctaccagacggcactcacagagtggtcacacgaaaacccctcggaagcctagcagaaaaggacttcggaaacatacgagacagagcactcgcagccgcactagagagacacgtcgccgaacaagcagcacaggggcgaagcctaggcgaggcactctcatgcttcacatggacagggggagaagtaaggcgagtccgcatgcttgacaagctaggaagtccggtagccgttcaagacgacgacggacacaccttcaaactatacaaaggcgacagcaatgcgtggtacgaaatactacgcgacggcagagggaggtggacaggtcggatagtatcaacgtacgaggcttacagactgcacgcggagtggctcgcagaaagaggagacggcggcagatcggacgctgcatttccggactgggcagccaggagactctgcgcaggaatcggcaaacccttgttcagactcttcaaaggagatatgctagcgttcggaaccgcaccgaacagggaaatcatgaaagtagtcaaattctcagaggggcgtatagtgttcgccggccaccgagaagcagggaatttaaaagaaagagacgcagacaaagacgaccccttcaaatacagaacatgctcaccagaagcactgagaaaagcgcaggcccgaccagtaggagtagaccccgccggcttcgtacacgaccgcggaccactagaatga

SEQ ID NO: 6139 - RNA, 3180 nt, synthetic construct
  misc_feature 1..3180: note = Cas9 variant
  source 1..3180: mol_type = other RNA
atggggataaggttcgcgtttgacctaggcacaaacagcataggctgggcagtatggaggacaggccccggggtattcggcgaagacaccgccgcaagtctagatggcagcggagtacttatattcaaagacggccgaaatccgaaagatggccaatcactggccacaatgcgccgtgtaccgagacaatcgcgcaagagacgcgacagattcgtactaagaagacgagacttgctcgcagctctacgcaaggctggattattccccgttgacgtggaagaagggcggcgactagccgcgacggacccgtaccacctcagggcaaaagcactcgacgaatcgctcacacctcacgaaatgggcagggtgatattccacctaaaccaaagacgcggctttagaagtaaccgcaaggccgacaggcaagacagagaaaaaggcaaaatagcagaaggaagcaaacgacttgcggaaaccctagcggcaaccaactgcaggaccctgggagagttcctctggagcagacaccggggcaccccacgtacgcgatctccaacacgaatacgcatggaaggagaaggagccaaggccctgtacgccttttacccaacgagagaaatggtaagggcagagttcgaaagactctggactgcgcaaagcaggttcgccccggacctgctcaccccggaacgccacgaagaaatcgcaggcatactatttagacaacgagacctcgcgccgccaaagatcggctgctgcacattcgaaccaagcgaacgacgactcccacgcgccctgccatcggtagaagcacgagggatatacgaacgcctggcccatttacgaatcacaacagggccggtctccgaccggggactgacacggccagaaagagacgtgctagcaagcgcactactggcagggaagtccctaacattcaaagcagtacgcaaaacactaaagatactcccacatgccctagtgaacttcgaagaagcaggggaaaaaggcctcgacggagccctaacagcaaaacttttatccaaaccagaccactacggagcagcgtggcacggattatccttcgcagaaaaagacaccttcgtcggaaagctgctggacgaagccgacgaagagagactcataagaagactcgtcaccgagaacaggttatccgaggatgcagcccgtaggtgcgcctcaataccactagcggatggatacggccgacttggccgaacagcaaacaccgagatcctcgccgccctagtcgaagagacagatgaaactggaaccgtagtgacctacgcagaagccgtccggagagcaggggaacgaacaggacgaaactggcaccactcagacgaaagagatggcgtgatactcgacaggctgccctactacggcgaaatactacaacgacacgtggtgccaggaagcggagaacccgaagagaaaaacgaagccgcacgctggggaaggctagcaaacccgacagtccacataggcctaaaccagctaagaaaggtggtcaaccgactaatcgccgcccacggaagacccgaccagatagtagtcgaactagcaagagaactcaaactcaaccgggaacagaaggaacgactagaccgcgaaaataggaaaaaccgcgaagaaaacgaacggcggacggcaatactagcagaacacggacaaagggacacggcagaaaacaagatacgcctcagactattcgaagaacaagcgcgagccaacgccggcatagccctatgcccgtatactggcagggccatagggatagcagaactcttcacatccgaggtcgaaatagatcacatactaccagtctccctgaccctagacgatagcctggcaaaccgcgtactgtgcagacgagaagcaaaccgcgaaaaacgtagacaaacacccttccaagcattcggagcaacaccagcctggaatgacatcgttgcgagggctgccaaacttccacccaacaaaagatggaggttcgatcccgccgccctagaacggttcgaacgagaaggaggctttctcgggagacaactaaatgaaaccaaatacttgagccgacttgcgaaaatatacctaggcaaaatatgcgaccccgacagggtatacgtcacacccggaaccctgacaggactactacgagcacggtggggcttaaacagcatcctgagcgatagcaacttcaaaaacaggtcagaccaccgacaccacgcagtagatgcggtagtaataggggtgctgacgcgaggcatgatccaacgcatcgcccacgacgccgcacgagcggaggatcaggacctcgacagagtattcagagacgtaccagttccctttgaggatttccgagatcacgtccgcgaaagggtgagcacaatcaccgtagccgtaaaacccgaacacggaaaaggaggcgccctccatgaagacacaagctacggactggtaccagacactgaccccaacgctgcattaggcaatcttgtcgtgcgaaaaccaatcaggagcttgaccgcaggagaagtagatcgcgtacgagaccgggcactacgagcaaggctcggcgcattagcggcaccgttcagagatgagagcggacgagtgagagacgccaaaggacttgcgcaagcactagaagcgttcggagcagaaaacggaatacgaagggtaagaatcctgaagccagacgcttcagtagtcacaattgctgaccgccgaacgggagtcccctaccgcgccgtcgcacccggcgaaaaccaccacgtagatatagtccaaatgagggacggcagctggagaggattcgcagcaagcgttttcgaagtaaacagaccgggctggaggcccgaatgggaagtaaagaaactaggcggaaaactggtcatgcgcctacacaagggagacatggtagaactgagtgataaagacgggcaaagaagagtaaaggtggtgcaacaaatcgaaatcagcgccaacagagtcagactgagcccacacaacgatggcggcaaactacaagaccgacacgcagatgcagacgaccctttcagatgggaccttgcaacgataccgctgctaaaggaccgaggttgcgtggccgtccgcgtcgatcctataggcgtggtgacactaagacggagcaacgtatga

SEQ ID NO: 6140 - RNA, 3183 nt, synthetic construct
  misc_feature 1..3183: note = Cas9 variant
  source 1..3183: mol_type = other RNA
atggcggtcaagtctcttaactacatcctaggtctagacctcggcatagccagctgcggttgggcagtcgtcgagatggacgaacaagaaaaccccctccgtctcattgacgtaggcgtaagaacattcgaagaagctgaaaacccgaaagacggcagctccctcgcggaaacaaggcgactcgcacgagcccaaagaagacttatcagccgccgtgcaaaccggatgaacaagctcagacggctcctcaaacaggaaaacgtcctccaggccaacgactacgacgaaaagggcttaatcatcgggctccccaaccaagcatgggagctcagagcccaagggctagaccgcaagctcgaacccaaggaatgggctgcagtcctcatccacctagtaaaacacaggggctacctctcacaacgcaagaacgagagccagaccgcagataaggaactcggcgccctgctatccggcatgaaccacaaccaccaactcctccagtcccaatcaaaccaataccgcaccccagcagaactagcaatcaagcaattcgcaacacaagacggccacatcaggaaccaaagaggcgcctacacccacaccttcaacagactcgacctccaaaacgaacttaaccaattattcgatgcacaaactcgactgggcaacccccacgtatcaggctccctgaaaacagccataaacgacctcctgatgaaccaaaaagcagccctgagcggagacgccatcctcgagatgctagggcgatgcaccttcgaaccctcagagtacaaagcagccaaaaacacatacagcgcagagagatttgtatggctcggcaaactgaccaacctgcggatacaagacaacggcctagaatccgcactgagccgagaacagcgagagctcctactaaacgagccctacaacaaaacgaaactaacctaccagcaagtacgcaaactgctgcgcctccccgaaacagcattctttaaagggctccgatacggtaaagacaatgctgaaagcgcgaccttaatggaaatgaaatcatatcatgccatacgaaaatccctagaaaacaaatccctcaaatccgaatgggaaaagctcaaaacccagccgaagctattagacctaatcgggaccgccttcagcatctacaaaacagacgacgaaatcgccggctgccttaaaaaccaattaccagagaacgtcatcatcgccctgcaggaacaactaaacttcagcaacttcatggaactctccctcaaagctctagaaaaactccttcccctcatggaacaaggactacgctacgatgaggcttgcacccaaatatacggcaaccgccacgagaaaatcgcagacaagaccgaaaaattcctacccaacatccctgctgacaaacttcgcaacccagtcgttctgagaacactcacacaggcccgaaaagtcatcaacgccatcatccgccgctacggcagccctgcacgagtacatatcgaaacgggcagggaagtcggaaaatcattcagcgacagggacaaactcaaaaagcaacaagaagaaaaccaagaacaaagacgcagagcaatagatgaatggaagcaatttttcccaaacgccgcccacgaacccaaagccgtcgacatactcaaactcagactctaccagctacaacaaggcaagtgcctctacagcggactgccaatcgacgtcagacgcctcccagaaaagggctacgtagaaatagaccacgcactacctttttcacggacctgggacgactcattcaacaacaagatccttgtattagcctcagaaaaccaaaataaaggcaaccaaacgccctacgagtacctgcggggagcggacaactcggaatcatggcgactcttcgtagagaacgtacaaaactgtcaattctccccaaacaagaaacagaaaatcatggcaaaacaactcgacgagaaaggcttcctagaacgcaacctcaacgatacccgctacgtcagccgtttcctctgccaattcatcagtgaatacctacaccttaccggaaaaggcaagaaacgcgtattcgcgagcaatgggcaaataactgccctccttcgcgggcgatggggcctatctaaaaaccgggaagagaacgacagacaccacgcagtcgacgccgtggtcgtcgcgtgcagcaccgtcgccatgcaacagaaaataacccagttcgtgagataccaaaaaggcaacgtctttacaggtgaacggatcgacaaagaaaccggcgaagttatttccatccacttcccgaccccctgggaacacttccgagaggaagtcatgatcagagtcttcgacgataacccgctacgcacactccccgagaaactccctaaccgtcccgaagccctccacgaatacgtcatgcccctctttgtcagtcgcatgccaaccaggaaaatgacaggacaagggcacaaagaaaccatcaaatcggcgaaacgcctggatgagaaaatctcagtcttgagggtacccctcacacaactcaaactaaacgatctagaaaacatggttaacagagaacgggagccggccctgtacgaggccctaaaggcaagactcgaacagttcaaaaacgacccggcaaaagcattcgcagaaccattcttcaaacaaggcggacaacaggtcaaggcagtccgggtcgaaatcgtgcagaaatcaggcatgctcctccgaaaaattaacggcgtcgccgacaacggcagcatggtccgagtagatgtcttcgaaaaatctggcaaattctatctcgtcccaatatacgcctggcaggtcgccgagggcattctcccgaaccacgcagtcgtccactcgaaggacgaatccgattggatcctcatggacgaatcctaccacttcaagttcgccctctacaaaaacgacctgctagaagtccagacgaagaaagggtgcataatgggttacttcgccagcctcgatcgagcaacgggtgcgataaccatccgcgaacacgaccgcgacaagaagaaatgcaaagacggagaacaccgcagcataggtgtgaaaatggcttcatcattcaagaaactccaagtcgacgagctcggcaaaaacatccacgaaacaagatcccgaaaacgcccaaacattggttga

SEQ ID NO: 6141 - RNA, 3186 nt, synthetic construct
  misc_feature 1..3186: note = Cas9 variant
  source 1..3186: mol_type = other RNA
atgcacacattaccctacaccctcggcctcgatatcggaatagcctcagtaggagccgccctcctaagcgacgaaagcatactcggaatgcacgtccgcacattcagcgccgccgagaccgacaaagaaggcgacccactcaacaaaatacgtagagaagcacggtccgcgcgccgcagaatacggagacgagcccaccgcctactacgtctacgacgactcctcaaacgtacaggactcatatccgacaccagcctagaagttctgaagacctcaaaaaccccatggcaacttcgttcggagggactcgacagactcctaagcccctcggaactagccgcggccctgtaccacattgtcaaacaccgaggtttccaaagcaaccgaaaagctgaactaaaaactgatgccaaagccggccaaatgctttcaggcgtctccgcaaaccaacagctcatgcgagataaatcttaccgcactatcgccgaaatggtgtgtaaagacgacgcctttaaagaccataaacgaaataagggcggttcatacaggaacaccttcgcccgatcagacctcgcagacgaactaaagactctactcaagaaacaacgcgaatacgacaaccccctcgcaactccagaactcgaagaagccgtacacacgcttctcatggctcgacgacccgtcttcaaagacgacgacatcgaaaagctagtcggcttctgcaccttcgaacacggggagaaacgggcacccaaagccgccttttcgtcagaacgcttcatctggctaggaaaactaaacaatctcagactaatctatccaggcgaacaaaggtccctcacaccagaagaaaggtcccaaatcatcaacctcccattcacacaagccagcgtaaaattcagccaaatccgaaagaaactagacctgccggaatacgtacgcttcaatctggtccgctacaaaccaggcgaagaaacaagcaaaagcgaaaccgccaccttcttcgaagccaaagccttccacgagctccgaaaaacatatcgcgaaagcggaataagcgagctatgggagcgagaccagcacgacccgcagaggttagaccaaatcgcaaccgccattgcagtgtaccgcgacgacgaacgcatacgaaacgaactctcccctcacacgatcgaaaacgaagtcgtagaagctgtcctaaactgcgacttcacccaatttataaacctcagtctaaaagccctcaacaaaatcctaccatacatggaacaaggacaacgatacgacgaggcatgtacctcagccggctaccaacatcacagcccccaacaaaatgaagagaaaagcggacgcatacccccacccgacaaaaatgttatccgcaaccccgtagtatataggtccctaaaccaggcccgcaaactaattaacgccatcaccaaacgatacggtgcccctgcagctatccacctggaaatggcccgtgacctatctaagcccttttctgaacgaaagtcaatagaacgggaacaagaaaaatatcgcaagcaaaaggttcaactcagaaacgagtacatagaacacttcggcaccgaaccaaacggactcaatctactaaaatttcgcctctacaaagagcaagacgcccaatgcgcctacacacagaaagccctcgacctctcccgcctcaacgaagccggctacgtagaagtcgatcatatccttccatactcccgctcctacgacgactcactcctcaacaagaccttggtcctcacagaggccaacagagacaaaggaaaccgaacccctttcgagttcatgggcggagacgatcaatcccagcactggcaaaaattcgtaagatgggtccaaatgaaccctaaaatacgacaagccaaaagaaaccgctacctccgcaaagacttctccgaaaaagccgcccgagagttccgagaccgacacctaaacgacactcgatacattggaagagaattgaaagccatgatcgaaagccacgtacaatggcaccccgactccaaatccaaagattgctgcgttgtacttagcggacaacttacagcacttctacgcggacgctggggatttaacaaagaccgagccgcaggggacctccatcacgccgtcgacgccgcagtcgtagcagccgccacacggggaatgatacaaagaatggcccgacactccaaatttcacgagctcaagaacgtgagaaccagctacgccgacccagataccggagaagtcgtcaacttggcggccgcccgagaccttgaaaaacacttcccactcccctgggacaactttagaaacgacaccctcgcatacctaaacccgagcgcaatcagcgcggacgagagcgcacaagaagggcaccgtggagtccgcgtatctcgcgcaccaacaaggcggaagctgggagccgcgcaccaagaaaccataaggagcaaaggcaaagataacattctactcgagcaaggcctctcagcagtaaagaccccgctctccaaactcaccctcaaaaatatcgaaaacatggtcgggtacgaggacccacggaatgccgccctagtcaaagtcctacgagagcgcctggaagccttcgggggcgacggcgcgaaagcgtttgcaccaaaccaacccccggtgtacaaaccctccaagcccggaaagcaggccccagaaatacgcagcgtaaaaatggcctccaaaagcaaaggcgcactacacgtcagagagggactggcagactccggacgaatgataaggatagacatctacgaaacaaagaatggctacgtaggggtaccaatttacgtcagtgacaaagcccgcagcaagctccccaaagcatacccaaagaaaggcgaagaccgcgccaactggccagaagtcgatacaaacgacaactttctttttagcctatactccactgactggatcgaggcgaaaacaaagaaagagacaattgcaggctacgtcaaaagctacgacatcttcgacggcagactcctcgtctacgctcacgacaataagaaagtagtgcgaaaactaacactttcggccctcgcagaccttcaaaaactccacgtctcaattctaggcgacctctacaaaggaggcaccccaaaatgtagcccactccgaaaaggacaggagctctga

SEQ ID NO: 6142 - RNA, 3186 nt, synthetic construct
  misc_feature 1..3186: note = Cas9 variant
  source 1..3186: mol_type = other RNA
atgctccgactaggactagacataggatcaaccagcataggctggttcttataccgcatcacaaacggaatgatcgccgaaataatagactgcggggtcagactattcagcgatggccgagatgcaaaaacaggcgtatcaagcgcggtcgaacgaagaaacgcacgcgcattacgaagacgtcgggaccgatacctccgcagacgggcagcactcatgagacgactcgccgcagcaggccttatgccagaagacccatcccaggcaaaaccactcgaactgctcgatccataccgcctacgcgcggacgctctggaccgccgactcgaactaacagaactgggcagagcactgttccacctcaaccagagacggggattcaaaagcaaccggcaaaccgacagaggtaacaacgagggcggcaaaattatagatggctccgcgcgcctcgaccaagcaatgatggcagtgggcgcacgtacctacggagaatttctccacctgaggcgtagtcaagccgaggacctgcgccgggtgccctccgtaagaacccgcctgacgctacggtcagtggacggcggaaaggctgaaaccggatacgacttctacccagaccgccgacatctcgaagaagagttcaacaaagtttgggcggcacaagccgcacaccacccggttctgacggactcacttcgacacgaagtattcgaaaccattttcttccaacgcccactaaaggccccagcggtaggtcgttgtctattctttcctgagccccggctcccaagggcacaccccctgacccaacgccgcgtactttacgaaaccgtgaacgcgctaagaatacgaacggaatccggcgcagcagtgcccctcggcaaagaacagcgagacaaggtaatcatgctcttagacggaaaagctcctgttaaagcaatagcctcggctaagttatcactcaaagcgatagccaaacacctaaaactccgcgacggtcaaacatttaccctcgaaaaaggaagagattacatagcctgcgaccccgttcgcgcaagcctatcccatccagaccggttcgggcccagatggtccgttctcgaggcagaggtgcaagcagaaatagtaggccgaatccgggacgacgacgacaccatggcgctcgtggaatggctcaagcaagtccacggcctagacgacgcacacgcccgtgccaccgctgacgcgccactccccgagggatacgggcgactaggcgaaaccgcaacacgaaaactactcgactgcctcaaagcagaagtactgacctacagcgaagcagtaggtaaagcactggaccaacaccactcagacagacggacaggagaaatattggaaagcctaccgtactacggagaggtactacaagcccacgtaataccgggcacgggagaaccccaccacgacgacataaccagattcggcagaatcaccaaccccacagtacacatcggcctaaatcaactaagacgcttagtaaacagaatcatcgcgcgctatggcaaacccgctgaaatcgtagtagaactagcccgcgacttaaaacaaagcaccggccaaaagaaagccgccatcgcactaaacctcaaaaaccgcaaagcggcagaagcaaggagcgccctcctgaccgaatggggcgtcccagataccggggcgaaccgtatgtatgtacgtctgtggcaagagctgcacgaagatcccatgatgagacgctgtccatacaccggaacaataatctcgccaagcctactgttctcgggagccatcgacatcgaccacatcctcccgtattcacgcacgctagacgacagcacagcaaaccgcaccttgtgcatgaaagaagccaaccgacaaaaacgcaacaaatccccatccgaagcacgccgcgacggcatgagaatatgggcactcgaagacgacaatctccgacacatccctgagttcaaacgttggcgcttcgcggaagatgccatggcgagattcgaaggcgaacgagacttcgaagcgagagcactggtagacacccaatacctaagccgcataagcaaagcatacctagaaacactctacgacggcgccgacggcaaaagccacgtatgggtcgtcccaggacgcctgacggaaatgcttcgcagacactggggactcaacggcatcctaaccgatccactacgcgacgtgacaaaagaaaagaatcgaatggaccaccgacaccacgccatagacgccgccgtcgtcgcagcgacagacagaggcctcatcaaggctatggccgaacaagcccgcactgacgtcgaccaagggagagaagcactcgcctcctcaataatgccaccttggccaggattccgcgaagcagtcgccgcacaagtcgaccgcataatcgtatcccaccgacctgaccatggacgaatagatctcaccacccggatgaagggacgagatcagacaacagggccgcttcaccgcgacacagcatacgggctaacaggacagtccgaaaaaggcgtcccactcgtagtcacccgcgagccattcgacaacctcaccccaaccatgataggaaaaataagagacgagccgctcaaagcagcactcgcagcggtgaccgcaggcaagaaagacgacgcctttgcggaagccctagcacacttccgcgaccgcccgggaccataccatggcatccgacgagtacgactgatagaaccaataagcgtcgtagaaatacgcgacgcaagtggccgcgcctataaaggctacaaaggaaacagcaatcactgcttcgaggtatggcgcctacccgggggcgcaataacagaacacatcgtcagcacattcgacgcccaccaacccggccctgaaccacggccccaccccgccgcgaaacgactccttcgactgttcaaaagtgacatggtgaaacttgacgactcgaaattcggacccgttatcgccacagtagtgatgttcgaccgaaacggaaaaatctctctcgttccacacactgcatccaacgcacgaaaaagatgcgaaaaatacaaagaggacctctacctacggttcaccgcacgcacactaatcgaggccggagcccggaggataatagtagacgaaaccgggcatttccgggaccctggacggaaaggatga

SEQ ID NO: 6143 - RNA, 3189 nt, synthetic construct
  misc_feature 1..3189: note = Cas9 variant
  source 1..3189: mol_type = other RNA
atggccgagaagcaacacagatggggactagatataggcacaaactcaataggatgggcagtcatagccctcatcgaaggacggcctgccggcctagtagccacaggcagcagaatattctccgacggacgaaaccccaaagacggcagctcactagcagtcgaaagacggggaccgcgacaaatgcggcgacgacgagaccgctacctccgacgtagagaccggtttatgcaagccctaataaacgtaggcctgatgcccggcgatgcagcagcgagaaaagcactcgtgacagaaaatccctacgtcctccgccagcggggattagaccaggctctcaccctaccggagttcggacgcgccctattccacctcaatcaaagacgcggcttccaaagcaaccgaaaaacggaccgagcgaccgcgaaggaaagcgggaaagtcaaaaacgccatagcagcgtttcgcgcaggcatgggaaacgccaggacagtaggagaagccctcgcacgacgcctggaagacggtaggccagtacgagcaaggatggtcggccagggcaaggacgagcactacgaactctatatagcgcgagaatggatagcacaagagttcgacgctctgtgggcctcacagcagaggttccacgcagaagtcctggcagacgccgcacgcgacagactgagggccatactactattccaacggaaactcctaccagtccccgtcgggaaatgcttcctcgaaccaaaccaaccccgagtagccgcagcactaccaagcgcacaacgcttcagactaatgcaagaactcaaccacctcagagtaatgaccctagcggacaaaagagaacgacccctgagcttccaagaacgaaacgacctcttggcacaactcgtggcacgaccaaagtgcggcttcgatatgctgaggaaaatcgtattcggtgcaaacaaagaagcgtaccgattcacaattgaatccgaaagacgtaaagaactgaaaggctgcgacaccgcagcgaaattggcaaaagtcaacgcactaggcacaagatggcaagcattaagcctagacgaacaagaccggcttgtatgcctactactagacggagaaaacgacgcagtcctagcagacgccctcagagaacactacggcctcactgacgcacagatcgacaccttactcgggctctcgttcgaagacggccacatgcggctaggccgcagtgccctcctaagggtgctagacgcactagaatccggtcgagacgagcaagggctacccttatcctacgacaaagcagtggtagcagcgggatatccagcgcacacggccgatctggaaaacggagagcgggacgccctgccctactacggagaattactgtggcgatacacacaagatgcaccgacagcaaagaacgacgccgaacgaaaattcggaaaaatagcaaacccaacagtccacatcggactcaaccaactacgcaagctagtgaacgcgctgatacaaagatacggaaaaccggcacagatcgtagtagaactagcaagaaacctgaaagcagggctagaagaaaaagaacgaatcaagaaacaacaaacagcgaacctcgaaagaaacgagcgcatacggcaaaaactccaagacgcaggagtccccgacaaccgagaaaaccgcctacgcatgagactcttcgaggaactcggacaaggaaacgggctcggaacaccatgcatttactcggggagacaaatctcgctgcaaagattattctcaaacgacgtacaagttgatcacatattacccttctcaaaaacactcgacgactccttcgcgaacaaagtactcgcacaacacgacgcaaaccggtacaaaggaaatcgagggccgtttgaagcgttcggagccaatcgggacggttacgcgtgggacgacataagagccagagcagcagtgctaccccggaacaaacgaaaccgattcgccgaaaccgcgatgcaagactggctacacaacgaaacggacttcctggccaggcaactgaccgacacagcgtacttatcacgggtggccaggcaatacctcacagcaatctgcagcaaagacgacgtgtacgtaagcccaggccggttaaccgccatgctgcgagcaaaatggggcctaaacagagtactggatggagtcatggaggagcaggggcggccagccgtcaaaaacagagacgaccaccgacatcacgccatcgatgccgtagtaattggcgcaacagacagagcaatgctccaacaagtagcaacactagcggcacgagccagagaacaagacgcagaacgactaataggagacatgccaactccatggccaaacttcctcgaggacgtccgcgcagccgtggcacgctgcgtcgtaagccacaaaccggaccacggaccggaaggaggcctgcacaacgacacagcctacggaattgtcgccggcccattcgaagacggaagatatcgagtccgacacagagtaagcctgttcgacctaaaacctggcgacctatccaacgtccgatgtgacgcaccactacaggcggaattagagcctatattcgaacaagatgatgccagagccagagaagtagccctaaccgcactcgcagaacgataccggcaacgaaaagtctggctagaagaactaatgagcgtcctacccatacgaccaagaggcgaagacggcaaaaccctgcccgatagtgccccctacaaggcttacaaaggagacagcaactactgctacgaactgttcataaatgagagaggtcgatgggacggagagctgatatcgacgttcagagcaaaccaggccgcataccgccgattccggaacgaccccgcgcgcttccgcagatacacagccggagggcgtccgttactaatgcgcctgtgcataaacgactacatagccgtgggaacagccgccgagagaacaatatttcgggtcgtaaaaatgtcagaaaacaaaatcaccctcgctgagcactttgaagggggcaccctaaaacaacgggacgcagacaaggacgacccgttcaaatacctcaccaaaagcccaggcgcgttacgagatttgggcgcccgcaggatatttgtcgacctaatcggacgagtgctggaccccggcataaagggggactga

SEQ ID NO: 6144 - RNA, 3189 nt, synthetic construct
  misc_feature 1..3189: note = Cas9 variant
  source 1..3189: mol_type = other RNA
atgaacctcaactacatcctaggcctcgacctcgggattgcctcggtcggatgggcggtggtcgagatcgacgaacaggaaaatccgcagcgcctaatcgacgtcggcgtacgaacctttgaccgagccgaggtcctcaagaccggagaatccctcgcactcgcaaggagactcgcacgatccagccgaagactggtcaaaagacgagccgaacgtatcaaaaaggccaaacgactgctaaaagccgaaaacttactactctcagcagatgagatactccccaacgaggcatggcagcttcgcgtaaaagggctcgaccaaaaactcgaacggcaagaatgggcagccgtactcctgcacctactcaaacaccgcggatacctcagccaacgaaagaacgaaagcaaaagcgagaacaaagaactaggcgccctgctcagcggcgtagcaataaaccaccaaatcctacaatctgccgaataccgtacaccggccgaaatcgcggtaaacaagttccaggcagaagaaggacacatccgcaatcaaagaggcgcatacacccacacatttagccgactcgacctccttgcggaaatggaactactcttccagagacaagcgacgctcggcaatccccatacgagcaccaaactcctagaaaacctcacagccttactaatgtggcaaaaacccgccctcgcaggagaagccatcctaaaaatgctcggaaaatgcaccttcgaacccaccgaatacaaagcagcgaaaaactcctacagcgcagaacggttcgtatggctcacaaaactaaacaacctccgcatacttgaacagggcgccgaacgggctctcacggacaacgaaaggttcgccctactagaccaaccgtacgaaaaagccaaactcacatacgcccaagtccgcacactcctaggactatccgacgaggcgatattcaaaggcctacgttaccagggagaggacaagaaagccgtggaaaccaaaacaacgctcatggaggtcaaagcctaccaccagatcagaaaggccctcgaaggcctcgacctcaaggccgaatggaacgagctgaaaaacaatcccgcacttctggacgagatcggcaccgcgttctctctctacaagacggacgatgacatacaccgatacctagacggtaaactctcagagtcagtcctcaacgcactactcgaaaaccttaacttcgacaaattcattcagctcagcctaaaggccctacagcaaatcctccccctcatgctccaaggacaaagatatgacgaagccgtgagcgccatatacggagaccactacgggaaaaagtccgatgagatagaccgacttttacccaacatacctaccgacgagataaggaatcctgtagtcctcagaacattaacgcaggcgaggaaagtaataaatgccgtagtacgactatacggatcccccgcccgaatccatatcgagactggacgggaagtagggaaaagctaccaagaccgcaagaaactcgaaaaacaacaagaagaaaaccgaaaacaaagagagaacgctgtcaagaaattcaaagagtacttccccaacttcgtcggagaaccgaaaggaaaagacatcttgaaaatgcgactctacgaactacaacaagccaaatgcctgtacagcggcaagtcactggagctctaccgcctcctagaaaaaggctatgtcgaagtagatcatgcactgccattctctaggacctgggacgactcattcaacaacaaagtattggtgctagccaacgagaatcaaaacaaaggcaacgcaacgccgtacgagtggctggacggcaaaaacaatagcgaaggatggcaacacttcgtagcacgcgtccaaacctccggattctcgtacgcaaagaaacaaagagtcctaatccaagaactagacgaaaagagcttcatagagcgcaacctgaacgacacccgctatgtcgcccgattcctgtgcaaccacatcgccgacaacatgctcctcactggcaaaggcaagagaaaagtcttcgccagtaacggccagataacggcactgctcagaggatgctggggcctacagaaagtacgcgagaacaacgaccgtcaccacgcactcgacgcggtcgtggtcgcatgcagcaccaaaagtatgcaagacaaaataacgaaattcgtcaaatacaaagaaggacgcctattcaaagacaagaaagacggagtctacaaaggggaaagaataaaccgagagacaggcgaaatcatctcgctacacttccccaccccctggaaattcttcaaagagaacgtcgaaatccgcatcttcagcgaaaacccgaagctggaactggagaacaggctgcccgattacccccaatacaaccatgagttcgtacaaccgttattcgtcagccgtatgcccactcgcaaaatgaccggccaagggcacatggagacggtgaaatccgcaaaacgcctcgacaaaggcttgtccgtactaaaagtgcccctaacccaacttaagctctccgacctagaacgcatggtgaacagagagcgcgaaatggcactatacgaagcccttaaagaatgcctggaacagttcggcaacgaccccgccaaagcatttgcggaacccttctacaagaaaggaggcgcgctagtcaaagccgtccgcgttgagcaaacccagaaaagcggtgtccttgtccgcaacggcaacggagtggcggacaacgccacaggctccatcgtacgggtcgacgtcttcacgaaaggcgggaaatacttcctcgtgcccatatacacatggcaagtggccaaagggatcctccccaacaaagcggtaatccagggcaaagacgagagcgaatgggaagaaatggacgaaaacgccgtcttccaattctcgatgcacaaaaacgacctgataaaagtaaaaacgaagaaaggcgaaatattcggctatttcaacggactcgacagagcaaccggatccatagaaatcgaagaacacgacctcgagaaaagcaagggcaagaatggatcacaccgcggactaggggtaaaaaccgcattcttcctagaaaagtaccaagtcgacgaacttggcaaaaacatacggccgtgcagacccaccaagagacaacacgtaagatga

SEQ ID NO: 6145 - RNA, 3192 nt, synthetic construct
  misc_feature 1..3192: note = Cas9 variant
  source 1..3192: mol_type = other RNA
atggaaaaccacatcaactaccgcctcgggctcgacatcggaatagcaagcgtaggctggtcagtaataaacctcgacaagaaacgaatcgaagacctaggggtacgcatattcaacgcggcagagcaccccaaagacgggagctcgctcgcactcccaagacgaattgcccgagggcgacgccggctactacgacgcaaagcctacagagtgaaaagagtccgcaaactgatcgtggactacaatatactaacgaaggaccaactaaacgacctgttcaagcaaaaatgccaaaactccgtgtgggaaatacgcgttaaagccctggacaacaaagtcaccaacgaagaatgggcccgcctgctaatcaacctctgcaaacgccgggggttcaaaagcaaccgcaaaaacgaggccgacgacaaagaaacaaagaaagtcatcaacagcatcaaaagcaacatcaaagggatgaaagagagcggcagtcgcacaataggcgagtacatctacacccaaactctctcatcgggcgatataagtaaaagtttccgcaacaaagacggccaatataacaactgcgtttcacggaaaatgatagaggaagaaatcaaaatcctattcaagaaacagcgtgagctgggctgcgagttcgcaagcgaagaaattgaggaaaaatatctggccatattcaactcccagaggccattcagcaaattcgaagacctagaaaagatggtgggcttttgcacgtttgagaaagcatccaaagagcgacgcgcgcccaaatgcagtatcagcgcagaggagttcgtcctctacgacaacatgaacaaactctccatcctcaacaaaggagatacacgaaagctgacaaacgaagaacggaaaataatagtcgaaaatgccttcaaaaacaaagaaatcaaatactcaaaactacggaaaatactaaacttaagcaatgacgaacggttcagcacgctcagctatagcaacaaaaccgaactgagcaagaccgagaactcgaaattcgtcgcgcttaagggataccacgagattaaatcggcaatcgaaaaatcatttgggaaagacacatggaatcgcgtgaaaaacaaccgtaccatgctaaacgacatcgcatacgtccttagcatcgcgaagaccgacgaagacatcataaaacaactctcgctccgaaacatcccccgcgagatcattgacgcagtcctcggcctatcgttttcaaagttctcgaacctatccataaaagccatcgagaaaatactcccgtatctgaaagacggtcaacaatacaacgaagcatgcaagtcagccggctacgacttcaaagcaacctacaacggcgagaagtcgtacaaactaccgctaatagacatagacgaaatagtgaatccggtcgtaaaccgagcgctaagccaaacgagaaaagtgatcaacgctgtgatcgaccgctacgggagcccgataggaataaacatagagcttgcccgcgacctcgccaaaaacttcaaggaccgctcaaaaataaagaaagaacaagaagagaacagggccaacaaagagaaaatcaagaacgaactaaaaatgctcatgaacaaagaaccaacttcctcggaaatcctcaaataccggctctggaaggaacaacgcgaagaatgcgcctacagccaggagagaatttacattgaagacctattcaaggtgggccagtacgaaatcgaccacatcatcccattcagtcgcagcttcgacgactcactgaacaacaaagtactggtaaaggccgcggagaaccaaagaaaggccaacagaatcccatacgagtacttcggaagcgacgaagaccgctggtaccgcttcgaagtatgggtcgaacaatcaagtttgtcattcaagaagaagaacaacctcctcaagaaacggttctcaagagaagactccatcgagttcaaagaccgtaacctagtcgacacccagtacatctccagatacatatcgaactttataaaatcccggctaatcttcaaggaatccgactccaaacaaaaagtaatcaccatcaacggccgcgcgacctcatacctacgcgcgaagtggggcttgctcaaggtcagagaaaacggagacaaacaccacgcgctcgacgccacagtaatagcagtcgcaactcaaggaatggtacaagaaatctcaaagtatagcaaggctcacgaactgaaatacatccgacaaggggacgaatttatcgacatagaaacaggcgaaatagtcaaagtcaaggaccacaaacacctaagcaaagaccgcctccccgaaccatggctcggcttctcatccgaactgcgactgcgcctctccgaaaacccgatagaggaactcaagaaaagtcccatctccacctacgacgaagagttcatacgcaaaacagtccgccctattttcgtgtccagagtaccctacaggaaagtcaccggacgcctcttcgaagaaaccgtatacagcccgaaagcattcatagatgaaggcttcatcgctaaaaagaaactccaggacctcacactcaaagacttcgagaacatttacaactacaacagcgataagaaactctacgatgcgctacgggagcgactcgaggaatacggaggaaacgcaaagaaagccttcgccgaagagttccggaaaccaaccaaaaccggcaaactcggccccatcgtaaaatcaataaaagtcaaaaccaagatccctttcaaagacggaattgacctaaacggtggcaaagtcaaaaaggatggactcgtacgaatagacatatatgaaaaagaaggcaaatactacgtagtacccgtgtaccggctcgacatacaacagggcaatatccccaaaaaggcggcggtagctaacaaagaagagaaagactggatcctcatggacgaatcgtacaacttcaaattctcgctgtacaaaaacgacctcatctacataaaatacgatagcaagggcgagtactttggatactatgacggcttcgatcgccacaccggcgcaatcacgctcgaacggcatgacaactcggagagatatcgcgggatagggatcaaaacaggcgtgaaagagatattcaagtacaatgtcgacgtgctcggtaggtactacaaagtcgccaaatga

SEQ ID NO: 6146 - RNA, 3192 nt, synthetic construct
  misc_feature 1..3192: note = Cas9 variant
  source 1..3192: mol_type = other RNA
atggagaaatttcactatgtcctcgggttagacctgggaatcgcctccgtaggctgggccgcaatcgaaatcgacaaagagacggaaacctcgatcggtttattggactgcggagtccgcaccttcgaacgcgccgaagtcccaaaaacaggagactctctagccaaggcacgacgagaagcccgttcgactcgccgcctgattaggcgcagaagccatcggctgctgcgactaaaacgcctcctcaaacgagagatctttaggcaaccagagactttcaaagacctccctatcaacgcatggcaactaagagtgaaagggctcgactcccgcctcaacgaatatgaatgggcagcggtcctactccacctcgtgaaacaccgcggctacctcagccaacgcaaatcagaaatgtcagaaaccgactccaaatccgaaatgggccgcctccttgccggagtagccgaaaatcaccagctcctacaacaagaacaatacagaacacccgctgagctagcgcttaagaaattcgtcaagcactttcgcaacaagggaggagattacgcacacacattcaaccgtctcgacctgcaagcagaactacatttactattccaaaagcaacgtgaattgggcaatcccttcacatcacccgagttagaaaggcaggtcgatgacctgctaatgacgcagcgctctgccctccaaggcgacgcaatcctcaaaatgctcggccactgcggcttcgaaccagaacagttcaaagcggccaaaaacacattctcggccgaacgattcatatggctcacaaagctcaataacctgcgcatacaagaccaaggcaaagaacgcgcactaacggccgacgaacgaaccaaactcctcgacgagccctacaaaaagagcaaattaacgtatgcacaagtacgtaaacttctaagtctcccacaaacagccatcttcaaaggcctaaggtacgacctagagcacgacaagaaagcagaaaactcaaccctcatggagatgaaatcctaccacaacatccggcaaacgctcgaaaaatctgggttaaaaacagaatggcagtcgatcgccacccaacccgaaatcctcgacgcaattggaacagcattctcgatatacaaaacggacgaggacatcagccacgaactgaaaacatgcaggctacccgaaaacgtactcaacgagctactcaaaaacataaacttcgacggcttcatacagctatcgctcactgcactgagaaaaatcctgcccctcatggaacaaggatacagatacgacgaagcctgcacccaaatctacggtaaccaccactcaggatcactgcaacaagaaagtaagcaatttctcccacacattccaatagacgatgtcagaaaccccgtcgtatttcgaacgctgacccaagcacgaaaggtcgtcaatgcgataatccgacgctatggaagcccagcccgagtacacatagagatggcaagggaattaggcaaaagtaagagcgaccgcgaccgcattgaaaaacagcagcagaaaaacaagaaagaacgagaaaacgcagtcgccaaatttaaagaagacttccccgatttcgtaggcgaaccccgagggaaagacatcctcaaaatgaggctttacgaacaacaacacggtaaatgcctctactcgggacacgacatcgatatcaacagactcaacgaaaaaggctacgtagagatcgaccacgccctaccgttttcgagaacatgggacgactcgcaaaacaacaaagtcctggtgctgggctcagaaaaccaaaataaacgcaaccagactcccgacgaatacctagacggcgccaataattcacaacggtggcttgagttccaagcccgcgtccaaacctgccacttctcatacgggaagaaacaaagaatccagctagccaaacttgacgacgaaaccgaaaaaggttttctagagcgcaacctaaacgacacacgctacatcgcacggttcatgtgccaattcgtgcaagaaaacctctacctcacaggtaaaggaaaaagactggtattcgcctcaaacggaggcatgacagccaccctacgtaacctctggggactccgcaaggtccgagaagacaacgaccgacaccacgcgctggacgccatagtcgtagcctgcagcacagcctccatgcaacaaaagatcaccaaggcctttcaacgacacgagagtatcgaatacgtagacaccgaaaccggcgaggtcaaattccgcatcccgcaaccctgggacttcttccgacaagaagtcatgatccgcgtcttctcggaccagccttgcgaagacctcgtcgaaaaactctccgcgagaccggaggcactacacgacaacgtcaccccactattcgtctcccgtgccccaaatcgaaagatgtccggccagggccaccttgaaaccataaaatccgccaagcggctcagcgaggagaacagcatggtcaagaaacccctcaccacccttaaactcaaagacataccggaaatcgttggctacccctcccgcgaacctcaactgtacgccgccctgaaaacacgactcgagacacacgatgacgaccccatcaaagcattcgcaaaaccattctacaaacccaacaaaaacggggaactaggcgccctcgtccgatcagttcgagtcaaaggtgtgcaaaacaccggagtaatggtacacgacggaaaaggaatcgctgacaatgccacgatggtccgcgttgacgtatataccaaagcgggcaaaaactaccttgtacccgtgtatgtctggcaagtcgcccaaggcatcctcccaaacagagctgtcaccagcggcaaatcagaagcggactgggacctcatcgacgaatcattcgagttcaaattctccctttcacgcggcgacttggtcgaaatgataagcaacaagggacgaatatttggatactataacggcctcgaccgcgctaacggctcaataggaatacgcgaacacgacctcgaaaaatccaagggcaaagatggtgtccatcgcgtcggcgtaaaaaccgccacagcattcaacaaataccacgtcgatccgttaggaaaagagatccaccgctgctcctccgaaccacggccaacccttaaaatcaaatcaaagaaatga

SEQ ID NO: 6147 - RNA, 3192 nt, synthetic construct
  misc_feature 1..3192: note = Cas9 variant
  source 1..3192: mol_type = other RNA
atggagaaagactatatacttgggttggacatcggtatcggctccgtcggatacggcctaatagattacgacacaaaaagcatcattgacgccggcgtcagactattccccgaagccaacgccgacaacaatctcggcagacgagcgaaacgaggcgcccgacgcctaaagcgccgccgtatacacagactcgaaagagtaaagagcctactaagcgagtacaaaataatctcgggcctcgccccaaccaacaaccagccctacaacatccgggtcaagggactcacggaacagcttacaaaagatgaactggcagtggccctattacacatcgcaaagagaagaggcatacataacgtggatgtcgccgccgacaaagaagaaactgccagcgacagcctctcaacaaaagaccagatcaataaaaacgccaaattccttgagtcgcggtacgtatgcgagctacaaaaagaacgtctcgaaaacgaaggtcacgtaagaggcgtagaaaaccgcttcctcaccaaagacatagtccgcgaggcgaagaaaataatagacacccaaatgcaatactatcccgaaatcgacgagaccttcaaagaaaaatacatttcgctcgtcgagactcgcagagaatactacgaaggccccgggaaaggttccccctacggctgggacgcagacgtcaagaaatggtaccaactgatgatgggccactgcacatacttccccgtcgagttccggagcgtcaaatacgcttataccgccgacttgtacaatgccctaaacgatcttaacaacctgaccatcgcgagggacgacaaccccaaactggaatatcacgagaaataccacataattgagaacgtgttcaaacagaagcgcaacccaacactcaaacaaatcgccaaagagatcggcgtgaacgacatcaatatctcaggctaccgtgtcaccaagagcgggaaaccccaattcacctccttcaaactgtttcacgatctcaaaaaggtcgtgaaggaccacgccatcctcgacgacatcgatctgcttaaccaaatcgcagagatactcactatataccaagacaaagactcgatagtagcggaactcggacaactagagtatctaatgtcggaagctgacaagcagtccatcagcgagctaacgggatacaccggcacgcacagcctaagcctaaaatgcatgaacatgataatcgacgaactatggcacagctccatgaaccaaatggaagtgttcacatacctcaacatgcgccccaagaaatacgagctaaaaggctaccaacgaatacccaccgacatgatcgacgacgccatcctgtccccagtagtcaaacgcagcttcaagcaagcgatcggtgtagtgaacgcaatcataaagaagtacggccttcctaaagatatcataatagaactcgcccgcgagagcaactccgcagaaaagagccgataccttcgcgcgatccagaaaaagaacgaaaagacccgagaacgcatcgaagcaatcatcaaagaatacggcaacgaaaacgctaaagggctagtccagaaaatcaaactccacgacgcgcaagaaggaaaatgtctatactctttaaaagacatcccactggaagacctcctccgcaacccgaacaactacgacatagaccacataatacctcgatcagtcagcttcgacgacagcatgcacaacaaagtcctcgtacgccgcgaacaaaacgcaaagaaaaataaccaaacaccctaccaatacctcaccagcggctacgccgacatcaaatactccgtctttaagcagcacgtactaaacctcgcagaaaacaaggaccggatgaccaaaaagaaaagggaatacctcctcgaagagaggaacatcaacaaatatgacgtccaaaaagagttcatcaaccgtaacctcgttgacacgagatacacaacacgagaactgaccacactcctgaagacctacttcaccatcaataacttagacgttaaggttaagaccataaacggcagtttcaccgacttcctacgaaaacggtggggctttaagaaaaacagagacgaagggtataagcaccacgcggaggacgccctaattatcgcaaacgcggactaccttttcaaagaacacaaactactaaaagaaatcaaggacgtcagcgatctcgcgggcgacgaacgcaacagcaacgtaaaagacgaagaccaatacgaagaggtattcggagggtacttcaaaatcgaagatattaaaaagtacaaaataaagaaattctcccaccgagtcgacaagaaaccaaaccgacaacttatcaacgataccatctactcaacacgagtcaaagacgacaaaagatacctgatcaacacattaaagaacctatatgacaaaagcaacggcgacctcaaagagcgcatgcaaaaagatccagaaagtctcctcatgtaccaccacgaccctcagacattcgaaaaactcaaaatcgtaatgtcccaatacgaaaacgagaaaaacccgctcgccaagtacttcgaggaaaccggtcaatacctgacaaagtacgctaaacacgacaacgggccagcaatccacaaaatcaagtactacggcaacaagctagtcgaacacctagacataaccaaaaactaccacaacccccaaaacaaggtagtacagctctcgcagaagtccttccgcttcgacgtctaccaaaccgacaaaggttacaaattcataagcattgcctacctcacactaaagaacgagaaaaactactacgcaatctcacaggaaaagtacgaccaactaaaatccgagaaaaagatcagcaacaacgcggtgttcataggctctttctacacgtccgacatcatcgaaataaacaacgaaaaattccgagtcatcggagtgaacagcgacaagaataacctcatcgaagtcgatcgcatagacatccgacaaaaagagttcatcgaactagaagaagaaaagcaagtaaactacatgaatagcgacagctacttgaaaaacaatcgcatcaaagtaacaataggccgaaaaacgaccaacatagagaagttccacacggatatcctcgggaacatgtacaaaagcaagcggcccaaagcaccccaacttgtctttaagaaagggtga

SEQ ID NO: 6148 - RNA, 3195 nt, synthetic construct
  misc_feature 1..3195: note = Cas9 variant
  source 1..3195: mol_type = other RNA
atgagcgaatgcgtgacacgacggatcctaggaatagacctggggatagccagctgcggatggggagtaatagaagtaggagaagcaagtggatcaataatcgcaagcggcgtgagatgctttgacgcacccctgatcgacaaaaccggggagcccaagagtgcaacaagacggacagccaggggacagaggcggataatacgcagacgaagacaaaggatgaacgccgttagaaggctactagcagagttcggagtactgacgggcagaagccccgacgcactacaccaagcattactaagactctcccaaagcgtggccggatcacaagtgacaccctggaccctacgcgctgcagcacacgaacgaaagctaacgaacgatgaactagcagtagtcctagggcacatcgccaggcaccgggggttccgaagcaactcgaaaaacgacggaggggccaacgccgccgacgaaaccagcaaaatgaaaaaggcgatggaaaccacgcgtgaaggactagcaagataccacagtttcggggctatgatcgcaagcgacccaaaattcgcagaccgaaaaagaaaccgagacaaagactactcgcacacagcaaagaggtccgacttagaagacgaagtacggacgatcttccgcagccaaacacgcttcggcagcctagttgcatcagagaaattatcgcaagcattcgcggacgcggcgttcttccaacgaccgctgcaagacagcgaagacatggtcgggtcatgcccattcgagcccggacaaaagcgaaccgccaggagagcaccgagcttcgaactgttcagattcttaagcagactcgcaaacctgaaactaaccgtaggcagagccccagaaagacgactcacgccagacgagatcgcactagccgccaaaggtttcggagaaacaaagaaatcgataaccttcaaaagcctccgagaggcactagaccttgaccccaacgcaaggttcagtggggtggctaaagaaaaagagtcaaccctcgacgtggcagcgcgcaccggaggtgccgcatacggcacaaaaacactaaaagacgcactaggagacgccccctggaggtcgctcagcaggatgccagaaaaactcgacagaattgcagagatactatccttcagagaggacatgaaagctatcagaaacggcctggaagaagtcggactcgacggcctagtcgtggacgcattaatgcaagcaacagcaaacggagacttcaaggactttaccagagcagcccacatatcagcgctagccgcaaggaacataataccaggactacgggaggggctggtgtacagcgacgcatgcacaagggtaggatacgatcacgcggcccgacccgcagtaccactgtcacaaatagggtcacccgtaacaagaaaagcactgtccgaagccctgaaacaagtacgggccgtagcccgagagtacggaccgatagactacttccacatcgaactagcgaggagcatagggaaatcagcagaggagagaaagaaactcacagacggtatcgaagcgcgaaacgtggaaaaagagaagcgcagaaaagaagcagcagaacacctcggcagagcaccaagcgacgacgaactcctcaggtacgaactagctaaagagcagaacttcaaatgcatctacagcggagacccaattgacccagccggcatatcagcaaacgacacgagataccaagtggaccacatcctcccatggtcaagattcggggacgacagttacgtaaacaaaacactatgcacagccagaagcaaccagaacaagaggggcagaacgccattcgaatggttcgacgcggacaaaaccgaagccgaatggatggaatacagcgcccgcgtagaggacttaaaagaagtaaaagggagaaagaaacgaaactactcgatcaaagatgccgcaagtgtagaagacaagttcaaggcacgcaacttaacagacacgcaatgggcgaccagactactagcggacgagctaaaaagaatgtttccaccaagagagtgcgaaagagtagtcaccgtaagagcagacggtggcaatgacggcctcagcatagtagaggaaaggagggtatttacgagaccaggcgccattacatcaaagctaaggagagcgtggggactagagggtctcaagaaacaagacggcaaaagagtcgaggacgacaggcaccacgccgtagacgcgctagtcctagcggccactacggaatcactactaaacaggctcaccgtggaggtacaacaacgcgaaagggaaggacgacaggacgacatattccactgctcccaaccatggccaggcttcagagtcgacgttcagcgaactgtatacggcagcgaaacaatgcccggcattttcgtgtcaagagcagaaagaaggcgcgcaaggggaaaagcccacgacgccacagttaaacagattagagatatagatggcgaaaggatagtgttcgaaagaaaaccgatagagaaactcacagacaaagacctggagagaataccagtccccgaaccgtacggaaaagcagcagaccccaagaaactacgagacgaacttgtcgaaaacctgcgggcgtggatagcagccggaaaaccgaaagataaacccccacggagtccaaaaggagacataataaggaaagtgaggatagagaccaaagacaaagtcgccgtagagataaacggcgggaccgtcgatagaggggacatggcgagagtagacgttttcagaaagaaaaacaagaagggagtgtgggagttctacgtgatcccaatctacccgcatcagatagtcgcgagcgcactcccaccaaatcgagcagtaatagcatacaaagcagagagcgaatggacagcgatagacggatgcttcgagttcgcatggtccctgaaccctatgagctatctcgagctagtaaaatcaaacggggaactgatagaagggtacttccgtagcatggaccgaacaacgggcgcaatcaacctgagtccgatgtcaacaaacagcgaaaccatccggagcataggcgtaaaaacactcagctccttccggaagtttacagtggaccgactggggcggaagttcgaaatcccaagggaagtacgaacgtggagaggtgaagcctgtacatga

SEQ ID NO: 6149 - RNA, 3195 nt, synthetic construct
  misc_feature 1..3195: note = Cas9 variant
  source 1..3195: mol_type = other RNA
atgaagagaacatcactaagagcgtaccgactcggagtcgacctcggggccaactcactaggctggttcgtcgtctggctcgacgaccatggacagcccgaagggctaggcccgggtggagtcaggatctttcccgacggcagaaacccccaaagtaaacagagcaacgctgcaggacgccgcctagcccgatcagcacgccgccgaagagaccgatacctccaacggcgaggaaaactgatgggactcctcgtgaaacacggtctcatgcctgcagatgaacctgcacgcaaacgactagaatgcctagacccgtacggcctcagagccaaagcgctcgacgaagtactccccctccatcacgtaggccgagcccttttccatctaaaccagagacgcggattgttcgcgaaccgagccatcgagcaaggtgacaaggacgcatcggcaatcaaggcggccgcaggacgcctccaaacaagcatgcaagcatgtggagccagaaccctcggcgaatttctgaacagacgccaccagcttcgcgccaccgtccgggcacgaagccctgtcggaggcgacgtccaagcccgatatgaattttacccaacaagagccatggtggacgcggagttcgaagcaatctgggcggctcaggctccccaccaccccacgatgacggccgaagcccacgacacaatccgagaagcgatcttcagccagcgtgccatgaaacgcccctcaataggcaagtgcagcctcgatcccgccacctcacaagacgacgttgacggattcaggtgcgcttggtcacacccactcgcccagcgcttcagaatatggcaggacgtacgaaacctagccgtagtcgagaccggaccaacgagctctcgactgggcaaagaagatcaagacaaagtagcccgagcccttctccaaaccgatcaactatccttcgatgagattcgaggactactaggactccccagcgacgcacgattcaacctagaaagcgaccgcagggaccatctcaagggggacgccactggtgcaatcctaagcgcacgacgccatttcggcccagcctggcatgaccgatcgctcgacagacaaatagacatagtagcattgctcgaatccgcactagacgaagcggcgataatcgcttctctcggtaccacacactcactcgacgaagctgcggctcagcgtgccctctcagcactattaccagacggatactgtagactaggcctacgcgcaatcaaaagggtactacccctgatggaagcgggacgcacctatgcagaagcagcgtctgcagccgggtatgaccacgcactactacccggaggaaaactctcgccaaccggctatcttccctactatggccaatggctacaaaacgacgtcgtaggatccgacgacgagcgcgacaccaacgaacgacgatggggcaggctaccgaaccccacggtccacatcggcatcggtcaactcagacgtgtcgtaaatgagctaatacgctggcacggccctccagcagaaataacagtcgaactcacaagagacctgaaactctcaccacgcagactagcagaattagaaagagaacaagccgaaaaccaacgcaaaaacgacaaaagaacaagcctccttagaaaacttggactccccgcatcaacccacaacctcctaaaactacgcctatgggacgaacaaggagacgtagcctcagagtgcccgtacacaggcgaagccatcggcctagaacggctagtctcagacgacgtcgacatagatcacctcatcccattctccatatcgtgggacgactccgccgcaaacaaggtagtctgcatgcgatacgccaaccgggaaaaaggaaaccgcacaccattcgaagccttcggacatagacagggccgaccatacgactgggccgacatagcagaaagggcggccagacttccaagaggcaaacggtggcgattcggaccaggcgcaagagcacaatttgaagaacttggcgacttccaggccagactactgaacgaaacctcctggctcgcgcgcgtcgccaaacaatacctggccgccgtaacacacccccacagaatccacgttctaccaggccgattaacagccctactccgggctacgtgggaactaaacgaccttctacccggttcagacgacagagcagcaaaatctcggaaagatcacagacaccacgccatagacgcgctcgtcgcagcactaaccgaccaagccctgctacgaagaatggctaacgcacacgacgacacacgccgaaaaatcgaagtcctcctgccatggccaaccttcaggatcgacctagaaactcgacttaaagcaatgctagtctcgcacaaaccagaccacggcctccaagcacgactccacgaagatacagcatacggaaccgtcgagcacccagagacagaagacggcgcaaacctcgtctaccggaagacattcgtggacatctccgagaaagaaatagaccggatacgcgacagaagactaagggacctggtcagagcacacgtcgctggcgaacggcaacaaggcaaaacactgaaagcagccgtactcagctttgcacaacgccgagacatcgctgggcacccgaacgggatcagacacgtacggctaacaaaaagcataaaaccagactacctggtcccaatacgagacaaagccggccgcatttacaaatcatacaacgccggggaaaacgcttttgtagacatactacaggcggagtcaggacgctggatagcaagagcgaccaccgtattccaagcaaaccaagcaaacgaaagccacgacgcccccgcagcacaacccatcatgagggtattcaaaggggacatgctaagaatcgaccacgcaggagccgaaaaattcgtcaaaatagtcagactgtccccctcaaataacctcctatacctcgtcgaacaccatcaagccggagtcttccaaacacgccacgacgatcccgaagactccttcagatggttattcgcatccttcgacaaattacgcgagtggaacgcagagctagtcagaatcgacacattgggacagccatggcgtcgaaagagaggacttgaaacagggtcagaagacgcaacaagaataggctggacaagacccaaaaagtggccgtga

SEQ ID NO: 6150 - RNA, 3198 nt, synthetic construct
  misc_feature 1..3198: note = Cas9 variant
  source 1..3198: mol_type = other RNA
atgaacaaagacatcaactacgccctcggactagacatcggcatcacctcagtgggatgggcagtaatcaatcttgacctcaaccgcatagaagacttaggggtcagaatcttcaacgctgcagaaaacctaaaagatggcagctcattagcactcccccgacgcctagccaggggtcggcgcaggctcctccgcagaaaagcctaccgggtagaacgagtgcggaagctaatactcaaaaacaatatactcacgaaagaagaactagagggactgttcaaaaacaaagaggtgatcgacgtgtgggaagcgcgcgtgaaagggctagactacaaactcagcagagaggagtgggccaagatcctcataaacttctgcaaacgacgcggtttcaagagcaatcgcaagaacgaggcgaaagacaaggaagcagggcaaatactgtcctcaatcagctacaacatcgagaaaatgaaagaaaccaactcgaggacgatcggcgaatacatatacaatgaagtgaagaacagcgaagactcatacgcacccctacgcaacaaattcggagagtacaagatgtgcgtaagccgagatgtcatccgagaggaaatccacacactgttcgaaaaacagcgggaactaggaaacaactttgcgtcggacgaaatcgaggacaagtacttcgaaatattcaacagccaacgaccgttctcaaacttcgaggacctagaaaagctagtggggttctgtactttcgagcgaaagaagcacaagagagcaccaaagcactgcatcagcagcgaagagttcaccctctacgaaggaatcaacaaactatcgatcataaaagacggagaaaaacgaaaacttagcgaggaggaacgcaccctagtagtcaacgaagccttcaacaagaaagaaatcaagtatacaaccctccgcaaactactcggactttcagaagaggagttgttctccacactaacgtactccatagacaaagacataagcaagaccgagaatacaaaattcgtgtcgctgaagggataccacgagatcaaacgagccatcgagaagggcgtctccaagaaagcctggcaagacatagagaacaacagaaacctcctgaacgacatagcctacgtactcacgctcggtaaaacggacgacgagatcgaaaaacaattacgcctccggaacgtaccagaggaacttttcgaatcgcttttggacatgtcattcaacaaattcaataacctcagcatatacgcgcttgagaaaattctcccgttcatgaaagaagggtaccagtacaatgaagcgtgcgagaaagccggatacaacttcaaggcaatctacgagggggtacgcacaaagaagctcccagtcatcgaaatagacgaaatcgtgaacccagtcgttaacagagcattggcacagacgcgcaaagtcataaactccgtaatcgacaaatacggtagccccgtgaggataaacatagaactcgcaagagacttagcaaagaacttcaaagaccgcaaactgattgagaaggaacagaaagagaacagagcaaacctcgacaaaatccgcgagaacctgcgcgaattaatggacaaggaaccgaccgtagtggaggtccttaagtaccggctctgggagcagcaacgaggcgagtgcgcatacacccagagtcaaataccgctagagcgactatttagccccgggtactgcgaaatagaccatatcatcccattcagtaggagcttcgacgacagcctgagcaacaaaatcctcgtacttggaagcgagaaccagcgcaagggcaatcgcacgccgtacgaatacttcggagaagacagcgaaaggtggaacagtttcgaaatctgggtcaaaggatcatacctcaattataaaaagaaagccaacctactcaaaaagaagttcagcgaagaggaacaacgcgactggaaagccaggaacctccaggataccaaatacatctgccgctacataagcaacttcgtgaacaaccgactagagttcaaggagagcgagaacaaacaaaaagtaatcactgtaaacggccgtgcgacggcctacctacgaagccggtgggggttgaacaaagtccgagaagacggagataaacatcacgccctcgacgcggccgtcgtcggcgtcaccacgcagggaatggtccaaaagatcagcaagtatagcaaggcacacgaactctacaccgtaaggaaaaacgacgagttcgtagacgtcgaaacgggcgagtgcgtagacgtggacgagtacaaagaaatccgaaaagacatactaccgaggccatggcgaggcttctcggaagaactcaagctacgcctcagtgacaatcccctcgaggagctcaagaaaagccccattgagacctataacgaagagttcatcaaagaaaacgtcaaacccattttcgtgagccgagtcccgttcaggaaaatctccgggaagctatttaaagaaaccatctacagcgaaagggcgttcaaagacggatacttcgtcagtaagaaaagtctagtcgacctgaaacgaggggatctcgacaacttctacaactacgaatgtgacaagaaactgtacgatgctatcagcgaacggatgaaagagttcaactacaacggaaagaaagcctttgaaagcccctttaggaaaccgacaaaaagcggaaaagaaggcccagtcgtgcgaagcgtgaaaatcaaaagcgcagtgccattcaaagacggaatcccgatgaacgaagggctagtggccaaagaaggaatggtccgcatagacatttacgaaaaggaaggaaagtacttcgtcgtgcccgtttacagataccagcttgcaaaaggaatcgtgccgaagcgcgcagcaatagccaagaaggacgaactaaaatggcccatcatggaccaaacctacaacttcaaattttcaatatacaaaaacgacctaatcgaagtaaagtacgacaagaaaggagtgtactttggatactacgacggcttcgacaggaacagcgcctcgcttacgatagaaaagcacgacaatagcgagcgataccgctcaatcggcctcaaggtaggcgtcttggaaataaacaagtacgaggttgacgtcttaggcaactaccacaaagtcaaactaggaggaaactga

SEQ ID NO: 6151 - RNA, 3198 nt, synthetic construct
  misc_feature 1..3198: note = Cas9 variant
  source 1..3198: mol_type = other RNA
atgaacaaggacatcaactacgccctagggctcgacatagggatcacaagcgtgggctgggcagtgatcaacctcgacctcaaccggatcgaagacctaggcgtacgcatattcaacgccgcagaaaacccgaaagatggatccagcctggccctgccccgacgcctagccaggggccgacgacgactgcttcgcaggaaagcgtacagggtcgaacgcgtccgaaaactcatagtgaaaaataacatattaaccaaggaagaacttgaaggcctgttcaaaaataaagaagtgatcgacgtatgggaagcgagggtcaaaggcctggactacaaactgagccgcgaggagtgggcaaaaatcctaatcaacttctgtaaaaggcgagggttcaaatccaaccgcaaaaatgaaaccaaggacaaagaagcgggccaaatcctgagttcgatctcatacaacatcgagaaaatgaaggagacaaactccaggacaataggcgaatacatatataacgaagtaaagaactccgacgactcatacgctcctctacgaaacaagttcggcgaatacaaaatgtgcgtaagccgagatgtactgcgcgaagagatacacacactcttcgaaaaacaacgagagctgggcaacaacttcgcctcggatgaaatagaagacaagtactttgaaattttcaacagtcaacgcccattctccaacttcgaagacctcgaaaaactggtcggattctgcaccttcgaacggaaaaagcacaagcgagcgcccaaacactgcatctcgagcgaagagttcaccctatatgaaggcatcaacaaactatcaatcatcaaggacggggaaaagagaaaactaagcgaggaggaacgcaccctagtggttaatgaagcattcaacaagaaggaaataaaatacacgactctcaggaaactactcggactcagcgaagacgaactgttcagcacgcttacctacagcattgacaaggatatatcgaagacggagaacaccaagttcgtcagcctaaagggctatcacgagatcaagcgcgctatcgaaaaaggagtcagcaaaaaggcgtggcaggacatcgagaacaaccgcaacctcctaaacgacatcgcgtacgtactcacattaggcaaaacagacgatgagatagaaaagcagctacgcctacgaaacgtcccagaggaactgttcgaatcactactagacatgtccttcagcaagttcaacaacctgagcatatacgcactagagaagatcctgccattcatgaaagaaggataccaatataatgaagcctgtgagaaagcaggctacaacttcaaggcgatctacgagggagttcgaaccaagaaactacccgtcatagaaattgacgaaatagtgaacccggtggtcaaccgagccctcgcgcaaaccagaaaagtgatcaacagcgtaatcgacaaatacggctcccccgtacgcatcaatatcgagctagcgagagacctggccaagaacttcaaagacaggaagctaatagagaaagaacaaaaggaaaacagggccaacctcgacaaaatcagagaaaacctgagagagctaatggacaaagaaccgacagcagtagaagtcctaaagtacagactctgggagcagcaacgtggggagtgtgcttacacacagagccaaatcgcactcgaacgcctcttcagtcccggatactgcgagatcgaccacatcataccgttcagccgcagcttcgatgacagcctaagcaacaaaatcctagtactcggaagcgaaaaccagcgaaaaggcaacaaaataccctacgaatatttcggagaagacagtgagcgatggaacagtttcgaaatatgggtaaagggcagttatctcaactacaaaaagaaagcaaacctgttaaagaagaaattcaccgaagaggaacaacgagactggaaagcgaggaatctccaagataccaaatacatatgcaggtacatatccaacttcgtaaacaaccgactcgagttcaaagaaagcgaaaacaagcaaaaggtcattaccgtcaacggacgagcaaccgcctatctacgaagccgctggggacttaacaaagtcagagaagacggggataagcaccacgccctcgatgccgcggtagtaggcgttacgacacagggcatggtgcaaaagatctcgaaatactcgaaagcacacgaactgtacaccgtaagaaagaacgacgagttcgtagacgtcgaaacaggcgaatgcgtggacgtagacgaatataaggaaatacggaaagacatattaccgagaccttggcggggcttcagcgaagaactgaagctaagactaagcgacaacccgctagaggaactgaagaagctcccgatcgaaacctacaacgaggagttcataaaagaaaacgtcaaacccatattcgtatctcgcgtaccattcaggaaaatctcggggaaacttttcaaggaaaccatctacagcgagcgagcattcaaagatggatacttcgtatccaaaaagagtctagtcgatctaaaacgcggggacctcgacaacttctacaactacgagtgcgacaagaaactatacgacgcaatctcagagaggatgaaagagttcaactacaatggaaagaaagccttcgaatcacccttccgcaaaccgaccaaatccggcaaagagggacccgtggtgcgcagcgtgaagatcaagagcgcagcaccgttcaaggacggaataccaatgaatgagggacttgtggcaaaagaaggaatggtaagaatagacatatacgaaaaagaaggcaagtacttcgtcgtacccgtgtaccgataccagcttgcaaagggcatagtccctaagcgggcggcaatcgcaggaaaaagtgagctgaagtggccaatcatggaccaaacctacaatttcaaattctcgatctttaagaacgacctcatagagatcaaatacgccaagaaggacggctactttggctactacgacggcttcgaccggcacacggcatccctcgtaatcgaaaaccacgacaactccgaccggtatcgaggcataggggtcaagacaggagtcgttgagttcaataagtacgaagtcgacgtgctgggcaactaccacaaagtaaacctgggcgggaattga

SEQ ID NO: 6152 - RNA, 3201 nt, synthetic construct
  misc_feature 1..3201: note = Cas9 variant
  source 1..3201: mol_type = other RNA
atgtcagaaagagtagtgcggagaatcttagggatcgacctcggaatcgcaagctgcgggtggggagtggtagatataagcggggcagggggtgggataatagcgacgggggtacggtgctttgacgcacctttaatcgataagacaggagagcccaaatctgcgacaaggaggacagcccgagggcaacgacgaatagtaagaaggcgaagacagaggatgaacggagttcgtcggcttttatgcgagttcggactgttacccgacccaaggcccgacgcactaaatcaggcgatgagacgcatctcgacggcgagcgcagcggcccaggtcacaccatggacactaagggcagcagcgcatcaaaggctactaagcaatgaagaactcgcggtcgtgctcggacatatagcaagacacagaggattccgaagcaatgcgaaaaacgaagcaggagcaaatgcggccgacgaaacgagtaagatgaaaaaggcaatggaagccacaagagaaggattggcaaaataccatgcgttcggagacatgatagcaaacgacccgaagttcgcgaatcgcaaaagaaaccgggacaaggattactcgcacacagccaaaagaagtgacctcgaagacgaggtacgagccatattgcgagcgcagctaaggttcgggagcgcagcggcaacagaaacgctggcccaaacgttcgcggatgtagctttcttccagagaccactgcaggactcagaggacagagtgggcgactgcccatttgagcccgggcagaaaagagcggccagacgagcgcccagctttgaactattcagattcctcagcagactagcaaacctcaaactcgcggtaggacgtagtccggaacgaagactaactgcggaagaaatcgccctagcagcgaaaggattcggggaaaccaaaaagaccataacattcaaatcactacgggaagcgctagacctagaccccaacgcaaggttcagtggaatcggaaaagacaaagaagcaagcctagacgtcgtagcacgaacaggaggggcagcatacggtaccaaaacgttaaaggatgcactaggagacgccccatggaggagcctaagtaggacaccggaaacactcgaccgaatagcggagatattatcattcagagaggacataacaagcattaggaacgggctagaagatttaggcttagacagcctggtagtagaagcactgatgcaagccgccgcgaacggagacttcaaggagttcactagggcaggacacatcagcgcgagagctgcaaggaacatcataccagggctcagagaaggattagtatacagcgaagcgtgcgcaagagtgggatacgaccacgcagcacgactcagtgtacccctcgaccaggtagggtcaccggtaacaagaaaagcactgagcgaggcgctaaagcaagtaagggcggtcgcgagagagtacggaccaatagactacttccacatcgaactagcacgaagcgtcggaaaaagcgcagaggaaagaaaacaactaacagacggcatagaggcacgaaacgtagagaaagcaaaaaggcgaaagcaagcagaggaacacctcggacgggcaccgtcggacgacgagctattaaggtacgaattagcaaaagaacaaaatttcaaatgtatctactccggggacgcgatagacccagcaggggtggcagccaacgatacgaggtaccaagtagaccacatcctaccgtggagcagattcggcgacgacagttatctaaacaaaacactctgtaccgcacggagcaatcagaacaagagggggcgtacaccatttgaatggttcgaggcagataagacagacgtggaatggatggagtacgtcgccagagtcgaaaacctacaagaagtaaagggaaggaagaaacggaactactcgatcaaagacgcagcggcaatagaggacaaatttaaggcaagaaacctaacggacacacaatgggcaaccaggctcctcgcggatgaactgagcagaatgttcccaccgagggaatgcgaacgggcgatatgtggcagagcggacgggggaaatgacgggctaacaatagtagaagaaaggagggtattcacacgcccgggcgccataaccagcaagctaagacgagcatggggactggagggactaaagaaacaagacgggaaaagagtcgaagacgaccgacaccacgcggtggacgccctagtactcgcagcaaccacagagagcctactgcaacgcctgacagtagaagtacaaagacgagagagagaaggacggccagacgacatctttcactgcgcggaaccctggcggggattccgcgccgacgtgcgcaggaccgtatacggttcagaaacaatgccgggaatatttgtgagtcgagcagagaggagacgagcgagggggaaggcgcacgacgcaaccataaagcaaattagggaaatagagggggagaggctggttttcgagaggaaaccagtcgagaagctaacagataaggacctcgagaaaattccaataccaaaaccttacggacaagtaagtgacccaaagcgcctgagagacgaactcgtggagagcctgagagcgtggatcgcagcaggaaaaccaaaggatcggcccccgctcagcccgaaaggagacgtgataagaaaagtaaggattcaaactaatgacaaggtatcggtagaaatcaacggcgggacagtagacagaggcgacatggcacgagtagacgtgttccgaaagaaaaataaaaaggccgtatgggagtactacgtggtaccgatctacccgcatcaaatagtagcgctaaacgacccgcccgacagagcagtcatcgcttacgccgaagacaaagactggaaggaaatagacagtagctacgagttcctatggagcctgttcggactatcatacgtcgagataagcaaagcaaacggggaatgcatagacgggtatttcagagggttacacagaggaacaggagcggcatcagtatgcaaacatatcagtctagggaaggacgccacagtgagcggaatcggactaaaaactctagccagtttcaaaaagttcacaatagaccgactgggacgaaaattcgagataccgcgagaagtccggacgtggagaggagaagcctgtacgtga

SEQ ID NO: 6153 - RNA, 3201 nt, synthetic construct
  misc_feature 1..3201: note = Cas9 variant
  source 1..3201: mol_type = other RNA
atgagccacctcgttctcggcctcgacctcggacccaactcgataggctgggcattagtaaacgacgaccccgaacacccagtcgaaagcaagctcgtagacctaggagtaagagtcttccccgaaggtgtagacaatttcgacacctcaaaggaactgtcaagaaacgaggacaggagggtagcaagaggcatgcgaagacaaattcgcagacgagccagacggcgccaacaattaaagcaagcactaatcgactccaaactgtggcccagcgacccaaacgacgaagtcgtattatacaacacgaacccctacgaacttagagcacgcgctctcaaagagaggttagaaccacacgaagtcggccgagtactactacacctcaaccaacgaaggggcttcctgagcaaccgcaagaaagaccggggcgacaaagaagtacaaggaatgcttgccgaaatcaacgaaaacgaacaacaatgcaaagatggaggctttgacacaataggcgcatggctcgcggacaaacaggcaaacatagaccatgcaaacagagaagaaaacgatcacgtccggaacagacacctcgccaggtcccaatacgtcgatgagtttgaggcgatctggagcgtccaagccaaacaccacccaaaactgctgaccgaggagctaaaagtcggaaaactaggaaaacagacgtacccagtcaagccgataccaagatggcatgaacaccgacaaggactcagcccgctcgagagcttcggcatctacggcctcatattcttccaacgacccatgtactggcccaagagcgtcgtcgggctatgcgagctagagccgaaagagcgaaggtgtcaacgcagcgacagaagacaacagagattccgactactgcaggaagtgaacaatctgaagtacgtcgaccccgacacgcacctagaacaaaagctcgacgacaaacaacgccggctactgctggacaaactaagccacaccaaagaaatgacgttcgaccagattcgaaaagccctggatttcctagaatccgtcaaattcaatctcgaacggggtgaaagaagccgcctcaagggcgtgccaatcgacgccctgtttgccgcaaaggatgtcctagggcaagaatggtacgacagaccagaacaacagaagacggagatagtggcagtgctcttggataacgaacgggatgacgaccgcatcatagcacgagccgttgcagaatggggaatgaccgcaaaagaggccgaagcaatgctcggagtagacctgccagcaggatacgcaaacttaagctgcaaagccattgaaaagctacttccgcacatggaaagaggacttctttacatggatgacgacgaaagcaactcggctatgcacgccgccggatacctccgcagagaccaactaagacgacgaatattcgacgttctcccggatccggccaggaccccaaactgccccatcggggacataccaaacccagtcgtcaagagaaccctaaccgagataagaaaagtagtcaatgccatagtcagagagtacggaaaacccgacgcgatccacctggaactcgcaagatccgtacaaatgggaaaagagaaaaggtcggaatacagtaaaatgatacgagacagagaagcggagagagacggcatagtcgaaaaactgagggagagtggggtccgagtcacgcgagacaacatactcaagtaccaactatgggaacaacaaaaccaggaatgcatatactcaggtaaacccatcagcttcgagaaactcttcggggaagggggcggcgtcgaagtagaccacatactaccgcgcagcagaagcctagacgactcacaagcaaacaaaatcgtatgcctcagaaccgcgaacgccggaaagggcgaccaaaccccctatgaatggctcgcagacacccagcccaaacaatacgaacaagtatgccaaagggccggaatgctcatgcgttccgggagaatgccctacgctaaataccggagattcatacaacgcgaactcgagctcgacaaattcatcgccaggcaactcgcggacactggctacataaccaaagcaacaatggaatacctcagatacctattcgacaaagaccacgacgtgctaggattgaaaggccagcttaccgcggaactaagataccactggggattggaaacgatactggaagaactcccagattcacccgcctggcacgaggcggacagcgggaaactacgacccggagagaaaaaccgagcagaccaccgacaccacgcaatagacgccgtagtcatagcattgaccaaccgaagacgattagtacaactatccgacatcgtgaaacgcggcggcgcgcgcgcgcacggagaaatactagaagacccgtggccgaacttccgagaaaacgtcgtccaagcgataaagaaaacgaatgtatcacacagagtcgaaagaaaagtagcaggaaaattacatgaagaaactctatacggaccgaccagaactcccggcgagtgggtacttagaaaaccagtgatagccctatcagcaaatgaagtggagaggatccgggacgcaaccataagacaaatcgttgtcagcgcactcgcggatgccggcatagacgtcggacgcggaaagaaaccagacgccaagaaaatgaaagaagcgctgtcgaaactcaaaatgccatcgggcgttcccatacgaaaagtccgcctaacaaaacccgagcaaacaatccagcccgtgcgggcaggcagacccgaccaggccttcgtaaagcctggttcaacgcaccacctatgcatattcgagttcaccgaaaacggaaaaacgaaacgagacgcagttttcgtgaccatgctagaagcaatgaatagactaaaacgaagagaacccgtcatccaacgcacgcacccagagcgaccagactccagattcgtcatgagtctgagcgcgcgcgaaatgctcctcgccaactggaaggacggcgagagactactcacctttaaaacagcttcctccacacaagggcaaatatggttcgcggaacacacagacgcaagaaagtccgccgattacaaacagttcgtcgcgaacgcaaacacattagacgccaaaaaggtcaccgtagacccactgggacgaataagatgggcaaacgactga

SEQ ID NO: 6154 - RNA, 3204 nt, synthetic construct
  misc_feature 1..3204: note = Cas9 variant
  source 1..3204: mol_type = other RNA
atgggaacaaggctgggactcgacataggcaccaactcaataggatggtgcctgttcaacctcgacggcagcggtcgcccgatcggaataagggacatcggagtccgaatcttctcggacggcagagacccgagaagcggtgcaagcctcgcagtagaacgaagagtcgcgagagccatgagaagacgacgcgaccgatacatccgccgccgaagtgcgctcctcgaagcattaatcaacaccggactaatgccagcggacgtacaggaaagcaaggccctgaccggttgcgacccctacgtactaagagcacaagccctcgacagggccctagacgcccacttactaggccgagtactcttccatctgaaccagcgcagaggattcaagagcaacaggaaagcagaaagaaaagcgggagatgacaaggaaggcggcaagatagccgacggagccaaagcactcgacctagccatgcacgaagccggcgcacgcacgtacggagagttcctcgccggccgtgactcgcgacgcgtacgactaagagcggaaggagatggctacgacttctaccccgaaagacgccacctagaagccgagttcgacgccatctgggacgcacaggcggcatacaaccccgcgctcctaacggacgtcgtacgcgatcgcctccggagaataatcttcttccaacgcccactaaaagcaccaaaagtaggcggatgcaccttctttaatgaagaaccgaggctacccaaagctcacccacttttccaagaacgacgtctatatgaagaagtgaaccaactagaaataacccgggcaggggccccttcacgcaaactgactctcgaccaacgagacaaaataatccgcaaactcaaaagcgcaaaaacggccagcttctcgggactagcccgcctcctgaaacttgccgacggcgaaagtttctccagagtgaccgaaaaccgaaccggactcgccggagacgacatattcacatcattcagcgacaaacgatgctttggcgaccgctgggctcactttgaccccggagtgcaatggagtatcatcgaaaccgtcaccgaagaagaagacccggtccgcctgcgggactggctcatggcaacgcacggcgtcacagtagaacaagccgaagctatcggccgagtccgcctacccgagggccacggaagactcggggaaaccgcaagtcgactcatactagctcaactaaaaagtggaagcaaagacggccaccccctcacctacaacgaagccgtcgaagctgccctcggtaagagccactccgacttcaggaccggtgaaatacttgaacaacttccctactacggagaaatccttagccgagaaatcccacccggaagcctggaccccgacgacgatgacgaaatcagatggggaaagataaccaaccctaccgtccacataggcctcaaccaactgagacggctactaaacgcacttatcaaagcacacggccggccagacgagatagtagtcgagctagcacgagaactgaaactctcagaaaaggacaaagccgagcacaaccgaaggataggcgcaaacacccgagcagccgaagcacggtcaaagaaactcctagagtcgggccaacctgacacaggagctaatagatccctcttgaaactttgggaggacttaaacccaaacaacccactcgaccgatgttgccccttctgcggccgacacattggacagatggctctattctccggtgagaccgaaatcgagcatataatcccatacagtcgatcactagacgattccgcggcgaataaagtaatcgcccaccgcagctgcaacagagaaaaaggaaaccgaacaccatgggaagcgtggggccacacagagagatgggcaataatcgccgagcaggtatcgcgactgcacaaatcaaaacaatggcgcttcgccccagacgccatagagcgattcaaccaagaaggcggatttatcgcgcgacaattatccgatacccaatacctgtcacgtatggcccgcacatacttatcatcactctaccctgataccgcaggggtctacgtaatacctggcagaatgaccgcaatgctccggcgcctctggggccttaacgaactcttaccagaccacaactacgtagaaaaccctcactcaggcgcccccaaaaacagactggaccacaggcaccatgccatcgacgccgcggtagtcggggtaacgacacggggactgctcaacgaaatctcacgagccgccggcagagccgaacgccaagacctagaccgcctcttcatcgacctacctaaaccatgggaaaccttccgggaggacctacacgagagcctcgcccgagttgtagggtcccacaaagcggatcacggccgaaaaggagtcccagccaagggaaaggacgccaccgcggcacgactacacaacgagacagcgtacggcctaacaggcctaacaagcgaaagcggactacccatagtcgtccatcgcgtccccctactatcacttaaacccgacgacctgtccaaccccatacgcatcccagacgcggcactccaaagagccctcagggaggcgaccgacggcaaaagcggaaaggacttccaagaagcactggcccaattctcaaaatcagaccccgtcttcaagggcatccgccacgtccgcgtccgtgaaaccctaaaagtcatccccatacgagacgcctcaggtcacgctttcaaggcctacaaaggcgacgccaacgcccgctacgacgtatggagaatgccggacggcaaatgggtgagctcatggagagacagagacggaaaagcccacagcggcattatcacaatgttcgcagcccaccaagccggtcaaccagtccaacgaccccacccagccgccaaaagagtgctctcccttcgacagaacgacctagtggccgtagaaccacaaggacaacctagaaagatcatgcgagtggtaaaattctcatctggcggccaaataacctttgccgaacaccaagaagcgggccccctaaaagcccgcgacgccacctcgccggacattgaccccttcaaatacttctacagttccgccggcggcctacagaaagcgcgagcgcgacaaataagaatagacgaactaggcaggatattcgacccaggaccacgctga

SEQ ID NO: 6155 - RNA, 3207 nt, synthetic construct
  misc_feature 1..3207: note = Cas9 variant
  source 1..3207: mol_type = other RNA
atgaaatacgtcttaggactcgacatcggcatcgcatcctgcggctgggccgtcatcaaccaggaaaaacaccgcatagaggacctcggcgtgcgcatcttcgataaggcggaaaacccgaaagacggcaagtccctcgccacccccagacgcgacgcccggtccacaagacgcacgctaaggcgaaagaaacaccgcatgcaacgtataaaaatcctgctagtaaaacacggcctattgagcaaaacggaaatcgaccacctttacgaatcagcaacagagatcgacgtctggtacctaagactgaacgcccttgaacgaagactcaaccccaaggagttcgcaagggtcctgatacacctgagcaaaagacgcggattcaagagtaaccgcaaggaaacgaccctatccgagaacgggcaaatcctcgaaaacatctcagaaaacctccaaataatggaacaaaagaactacagaacggtcggagaaatgatcctcaaagacaaaaggttcgaaaaccacaagaggaacaaagacggcacctacatcgggaccgtaacccgacagcaactacaagaagaaatccaaatgatatttaacgcgcaaaggctctacaaaaacaaccacgctacggagaagttcgaaagctcatatttagaaatctgggctagccagcgcccgtacgcaagcaaggaccaaatcgaaaagatgatcggatactgcaccctggaaccaaaagaaaaacgcgtacctaaagcctcctggtcgttccagtacttcgtagccctacagacaataaacaacctccggctgatttccaaagaccgaatagaagaactctccttcgaagagaaaaagaggatcatgaacctcgcgctcgaaaaatcaatcgtcaaatacatcgacatccgaaaactcctctccgtcccaaaagaatttcaattcaactcactcagttactcggcagacatcgtcgacaccaccgttgaaaacaagaaatgtatagaactcaaagagtatcattcaataaacaaagtatataaacaaatatacgggcagaatgctctaaacctactcccaaaagactacgacaccatcgcgtacggattaactatcttcaaggacgacaaagacatccaagagtacctacagaataaatacgtaaacgctaaaggcaagccgatctcgaacctagcaaacaaaacatacgatgacacattcatccaagtgctgctaaccctcaacttctccaaaatgggacacctgtccttcaaagccctcaaaaacataatacccttcctagaagaaggcctgtcctacgacaaggcctgcgaaaaagcaggatacaacttcaaaggcacgtcatacacgaagaaaacaaagtacctcccggtcataccacaaaacaccaacccggtcgtccaccgagccctatctcaaacaagaaaggtcatcaacgccatcattaaaaagtacggctcgccgaacgcgatacacatcgaaacagcgagagaactatcaaaaaccttccaggaacggaaagaaatagacagcatgtaccaggacaactccaaaaagaacgaacacgcaatctgcaaactcaaagaactcggaaacatcaacccatcgggaataaacatcgtaaaattcaaactgtggaacgaacaagacggccgctgcatgtacacgggaaaatacatcgagccccatcggctgttcgaagaagggtacacagaggtcgaccacatcctcccgtacagccgatccctagacgactcttacaacaacaaagtactcaccctaggcaccgaaaaccagagaaaaggcaacaaaaccccctacgaatacatgcgcaacaacagcatatgggacgagttcgaaacccgcgtccagtccaacaagaaaataaataaaaagaaacaacaaaaactcctactgcaaaacttctcccacgcgcgcgaacaagagttcatagaacgcaacctcaacgacacccgatacgctacaatttatctgtcgtcgcttatacagcaacatctaatcttctcagaaagcagcagagagaagaaagtccacacagtctcagggatcataacctcccacctccgatcccggtgggggttcaacaaagacagaaaagagggccacatccaccacgccctcgacgccgtcatagtggcggttacatccgaccatatgatccaacgcgtcaccaaatactacaaactgaaagaactcaaccgcaatcgccaagctaagcgtatgcagttccccgaaccatgggaaggattccgtcttgagcttgaagcaagaatatcccccaatacccaacagtatctcaaagggatacgcttcaaaaactacgccgacgtcaacctaagcgaaatcaaacccatattcgtcagccgtatgcccaaacgaagcattacgggagaactgcaccaagaaaccatccgaaaattcctaggctataacgaaaagggaaaagtccttacagccacaaaaaccaaactggaagacatcccgttcgacgccaacggagacttccccatgttcggcaaagaaacagacctatacacctacaacgcaataaaggaaagatacctctcacacaaaaaggacaaatccaaatcctttcaagaacccctctacaaacccaccaagtccggcggaatcggccccctaataaagtctataaaaatcatggacacacgcaccatcgtcaaccctgtcaaccagggcaaaggggtggtctataactccaaaatcgcccgaaccgacgtgttcaagaaaggcgaaaaatattacttaatacccatctacaccatcgatctcatgaaaaatacgttaccacaaaaagctatcacggccggcaaaggctacgaagactggaccacaatcgacccgtccttcacgttcctgttcagcctattccccaacgacctcatacaaatagtgccctccaaaaacaaaacaataaaagccagaacgactgtctccaaaaaggaagtcctcctaccctcactaacaggctacttcaaaggcgtccactccggcaccgccggcatcacagtcgaaacccacgacggatccatcatcgccaacgtaggctccaaacagttacttagcttcgaaaagtaccaagtagacgtactagggcactacaccaaaatcaaaaaggaaaaacgcataggcatggccatatga

SEQ ID NO: 6156 - RNA, 3207 nt, synthetic construct
  misc_feature 1..3207: note = Cas9 variant
  source 1..3207: mol_type = other RNA
atgaacaaagccgtagcataccgcctcgccctcgacttaggatctacaagcctagggtgggcaatattcagactaaacgaagcaagagaaccaactgcaataatccgcgcgggcgtacgaatattcagtgatgggcgaaacgcaaacagcgaaccactcgcggtacatcgcagagtagcgcgggccatgagacgtcgacgggacagactactgaaacgaaagaagcgaatgcatgaccaactcgttcaacacggctttttcccagccgaagtagccgaacgtaaggagctcgaaagactgaacccctatcaactaagggcgaaaggacttcacgaagcactaacgcctggagagttcgccagggccctcttccacatcaaccaaagaagaggattcaagagcaacaggaaaaccgaccgaaaagacaacgactcaggcgcattaaagcaagccatatccgaactcagaaagaggatacaagacagcgactgcgcgaccgcgggggaatggttctggaaggaaagaatgcagcagaaacctgagggagtacgagggcaatgggtaagagcaagatatagaaagaccccaagcaccacagacgagggcaagaaaagaatcgggtatgacctatacgtcgatcgcgcaatggtggaacaggagttcgacgctctctgggccgcccaggcggcgctacaaccggggttattcacggaagcggcccgagctgaactcaaagacacgctactataccaacgtgacctcagacccgtgaaacccggacggtgcacgctcctacccgcagaggaaagagccccgctggcactgccaagcacacagcgcttcagaatactgcaagaggtaaacaatctaaggctcttagacgaagctctgcgagaagtaccgttgaacctagcgcaaagggacgcggtcgtaagcgcgcttgagggcaagaaagaactcagcttcgctgcgatacgcaaactattgactctaagcggcaaattcaacctggaagacgaaaagagagcagaactaaaggggaatgcaacatcggtcatactcgcacgcaaagacctgttcggagacgcgtgggcaggattcgatgcggccgtgcaagatgagatagtgtggcggctcgtcagccaagaaagtgaaggcgcgctcatagcctggctacagcaacatacaggagtcgacggggtgtgcgcagaggcgatcgtaaacacgcgactgcccgacggctacgggcgcctctcgcgaaaagcgctggaaagaatagtaccggcgttacaacgagaagtctgcacatacgacaaagcagtgcaagcggccggattcgcacaccacagcgacctaggattcgacttcgactacgcagaagacgaggtacaacaggtgggggaacacacaatcgcctcgacaggcgaagtacaggcacaatacgccttcaagcaactaccatactatgggaaagccctgcaaagacacgtggcttttggctcaggcgacgcaaaggaccacgaggagaaatgctacgggaaaatcgctaacccaacggttcatatagggctcaatcaagtaaggacagtagtaaacgcacttatacgacgctacggacacccaacagaagtagttgtagagctagcaagagacctcaaacagtcgagagagcaaaaacaacagacccagcgagaacaagcggacaatcagaaaagaaacgaagacatccggaaacggatagcccccatattagagacctcgccagagcgggtgagagatcgcgacatcaaaaagtggatcctatgggaagaattaaacaagaaagatatcgctgacagacactgcccatatagcggagaacgcataagcgcaacgatgctactatcggaagcagtcgagatcgaacacatactcccattcagccgaaccctcgacgactcactcaacaacagaacagtagcgatgcgccgtgccaatcgcattaaaggggacaggacaccttgggaggcgagagccgacttcgaggcgcaaggctggcggtacgaagcgatactacaaagagctgagggcatgccaccacgcaagcgctacagattcgccgaagacggctatcaaagatggttagggaaggaccgcaattttctagcgagagccttgaacgacacaagttacctcagtagactcgcagcaaactacctaagattagtctgtccacaaggagtaagagtaataccgggccaaatgacagataagctaaggggcaaattcggactcaacagtgtgctagggctcgacggcaagaaaaacagaaacgaccaccgccaccacgcagtagatgcctgcgtaatcggagtgacagaccaaggactaatgcaacgattcgcaaatgcgagcaaacaagcgcgagaaaacgggctaacacggttggtacaggacatgctcctgccgtggtggccgagttactacgaccacgtcgaacgggcagtccgccacataagagtcagtcacaggcccgaccacggcttcgaaggcgccatgatgaaagggaccgcacacggcataagagaggacggcatccgagaagacgggcgaataaaacaacgaccgaaagcaaaaggaagcgcagaccacaaaacaatcacactcataccgatagacgagccgagacaactggcgagacatggggtcgacgccgagggcaagccgctgccttacaaaggatacgcgagtggaagtaattactgcatcgaaataacgaagaacggaaaaggcaaatgggagggacaagtcatcagcacgtttgacgcctaccggataaaagcagcggcagacgcagcagcccgcgcaggacaagtcataagcacggttgaagccgacagcatagtaagaaagtcaggatgggaaagactccgcggagcacaaagccaaaacggccaacccctagtcatgaggctagtgattggagatagcgtacgcatggaagtcgacggtcgagatgaagtaatgagagtagtgaaaatgtccgggaaggagatggtcttcgcgccagtacgagaggccaacgtggacaagcgcaacaacatgccagacgagcaggacccattcacctatacctacaaaagggccgatcagctgaggaaggcgaaagcgcgacaagtaacgattagcccaataggcgagttacgcgacccaggattcaaaggctga

SEQ ID NO: 6157 - RNA, 3207 nt, synthetic construct
  misc_feature 1..3207: note = Cas9 variant
  source 1..3207: mol_type = other RNA
atgcaatatgtcctaggtctcgacatagggatagccagctgcggctgggccgtgatcaaccaggagaaggaacgcattgaagacctcggcgtgcgaatcttcgacaaagcggaaaatcccaaagacggaaaaagccttgcagccccacgccgcgatgcgagaagcactcgacggactctccgccgcaaaaagcaccgcatgctccgtataaaaatattactcgtaaaacaaggattattaagcaagaacgagctcaaccatttgtacgaatcaaccaccgaggtcgacgtatggaacctgcgactcgacgcacttgaacgaaagctgaaccccaaagagttcactcgggtcctaatccacctggcaaaacgcagagggttcaagagtaaccgcaaagaaactacactgtcggaaaacggccaaatcctcgagtccataagcgaaaatcaacaaataatggagcagcaaaactaccgcacagtaggcgaaatgatcctaaaagacaagaaattcgagaatcacaaacgtaacaaagacggcacctacatcggtaccgtcacgcggcagcaactgcaggaagagatccaaatgatcttcaccgcccaacgcctctataaaaacgactacgccacagaagagttcgaaatctcatacctcgaaatctgggcctctcaacgaccgtacgcgagcaaagaccagatagaaaagatgataggttattgcaccctagaaccaaaagaaaagcgagtcccaaaagcctcatggagcttccaatacttcgtcgcgctgcagacgattaacaatctccgcctaatcagcaaagaccgcatagaagaactcagcttcaaagagaagaaacaaatcatgaacctagccctcgaaaaatcaatagtaaagtacatcgatatacgaaagctactaagcataccaaacgagttccagtttaactccctttcctactcggcagacacagttgacaccaccctggaaaacaaacgctgtatcgagctcaaagaatactactcaataaacaaagtatacaaacaaatatatgagaagaacgcactcaacctgctaccaatcgactacgacacaatcgcctacggccttaccatcttcaaagacgacaaagacatcctcgaatatttacaaaacaaatacgtaaacgcaaaaggcaaaccaatcaataacctggccaaaaagacttacgactacacattcatacaagcattgttaaccctcaatttcaccaaaatgggccacctatcctttaaggcactgaaaaacattattcccttcctagaagaaggcctatcctacgacaaagcctgcgagaaggccggttacaacttcaagggaacctcctacacggagaaaactaaataccttcccgtcatcccgcaaaacacaaatcccgtcgtacaccgggctctatcccaaactcgcaaagtaatcaatgccatcatcaaaaagtacggatcccctaacgccatccacatagaaaccgcccgagagctctcgaaaacattccaggaacggaaagagatcgactctatgtaccaagacaactccaaaaagaatgaacacgcaatccacaaactaaaagaactcgggaacattaacccgtcaggcatcaacatagtcaaattcaaactatggaatgagcaagacggccgatgcatgtactccggaaaatacatagaaccacacagactcttcgaggaaggctacacagaagtcgaccacatcctgccgtactcccgctcactcgacgactcctacaacaacaagactctcacacttggcacagagaaccaacgtaaaggaaacaagacgccatacgagtatatgggcaacacatccatatggaacgacttcgagacccgcgttcactcaaacaagaaaatcaacaaaaagaaacaacaaaaactactcctacagcatttcagctacgcgcgggaacaggagttcatcgaacgtaacctcaatgacacacgctacgccacgatatacctctcttccctcatacaacaacacctcatcttctccgaatccagccgaaagaagaaagtgcacacggtctccggcatcataacctcccacctccgctcccgatgggggttcaacaaagaccgtaaagaaggacacatccaccacgccctcgacgccgtaatcgtggccgtaaccagcgaccacatgatccaacgggtcacaaaatactacaaactcaaagaactgaaccgaaacctccaagccaaacgcatgccctttcccgaaccatgggaaggattcagactggaactcgaggctcgcatctcacccaacacccaacaatacttaaaaggcttccgattcaaaaactacgcagacgtgaacctctcagaaataaaaccaatattcgtgtctcgaatgccaaagcgcagcataaccggcgaactccaccaagagaccatcagaaaattcattggatacaatgaaaaaggcaaagttctcaccgccatcaaaaccaagctcgaagacatccccttcgacgcaaacggcgacttccccatgtacggcaaagagacagacttatatacatacaacgccatcaaggaaaggttcctatcccacaagaaagacaaacgcaaatccttccaagagcccctctacaaacccacgaaatcgggcggaataggccccctcataaagtcaataaaaataatcgacacgcggaccatcgtaaaccccgtaaatcaaggaaagggcgtagtatacaactcgaaaatagcccgcaccgacgtatttaagaaggacgaaaaatactacctcatcccaatctacacaatcgacctcatgaaaaacatcctcccacaaaaagccataactgcaggcaaaggttatgaggactggacgaccatcgatccctcattcacgttcctcttcagcctcttccccaacgacctgatccaaatcgtccccagcaagaacaaaaccatcaaagcccgaacaaccgtgagcaaaaaggaagtccttctccccagcctcaccggctacttcaaaggcgtacacagcggtaccgcaggcataacggtagaaacccacgacggcagcgtgatcgctaacgtcggcagcaaacaactcctcctaatcgaaaaataccaggtcgacatcttaggacattacacaaaaattaaagaggagaagcgcattgggatggccatatga

SEQ ID NO: 6158 - RNA, 3207 nt, synthetic construct
  misc_feature 1..3207: note = Cas9 variant
  source 1..3207: mol_type = other RNA
atgccaaaatctgcaaaaccccaacaagcatacacattagggctcgacatcggaatcgcaagcgtcggcgcagccctcctcggccaacagcacatcataggcctccacgttcgcaccttcgacagggccgaaactgccaaggaaggggaacccctaaacaaaattcggcgagacgcccgcctaacacgacgccgtctccaacgccgcgcccatagactgctgcgactacgcagactattcaaacgacacaacctaatcccggacaccgacacctcaaccttcataagcggtcagagcccctgggaactgcgcgctcaggggctcgacagacagctaacatcagcggaatggacaaccgtgctctaccacatagtcaaacatcgcggcttccacagcaaccgcaaaagcgaagtcaaaaccgatgaaaaggctggacaaatgctgagtggcgtcaaccaaaaccaagctctactaaaacaatcaggcctacgtaccatgggggaactcgctgccagacacgaagccttcagagaggccaagcgcaacaaaaagggcgcatacaaccacactttctcaagacacgacctagaggacgaactacacctcctcttcagtaggcaacgcgaactcggcaacccctacgccacaccagaactagaagacgcggtccacaccctactaatgcaacggcgaccagcactatccggcacaaacctgctcaaaatggttggacactgcaccctagagccagacgagttccgcgcaccgaaagcctcctacaccgccgaacggttcatatggctcaccaaactcaataacctacgcgtatccggaagcggcgaaaccagaccgctcaacgaatcagaacgacaagccctcctcagcaaacccttcagccaaagcaaactcacctacaagcaggtccggaaaatcctggaactcccggacaacatacgattcgttggactacactaccacccagcgcaagacaacggaaagtcccccgaaaaccgcgtcttcttcgaagccaaagcattccacgcactacgaaatgtttacaagaaagccggcctcaacctcgaatggcagcgggactcacaaaaccccgaaaaattagacaacatcacgtacgcactaaccgtattcaaagaggacaaagaggcaaaacagtggctcatcgagaaaggagtcgaagcaagcgtaatagaagcagtcctaaacgagtccttctcggagttcgtccgattatccatcaaagcgcttcgaaaaatcatcccgcacatggaaattggccaccgctacgacgaagccgtaaaactagccggctactcgcaccactcccatctcccacaacccagcaagaccccttacatcccaaggttttcgaaacaaagtatagcgaatcccgtagtgtcacgagcgctcaaccaagcgcgcaaactcgtgaacgcaatcgtacgtgaatacggaccccctgatgcagtgcacatagagctagcccgcgacctgaacaaaccgttcgacgaacgacgaaaaattgagaaggaccaagaaaagtaccaaaaagacaaagcccgcgacatagaaactttccaagaaaacttcgggttcaccccaaaaggactccagctcaccaaatggcggttgtacagggaacaatccggaaaatgcgcatattccctaaaacccctggacataaaccgattattcgaagacggctacgtcgaaatcgaccacgcattgccctactcccgatcattcaacgacgggatgaataacaaagtactcaccctaacaacggaaaaccgcaacaaaggaaatcaaacaccatacgaataccttgacggagcctcaaactcagcccaatggcgcaacttcgtggcatgggtaaactcaaacaaatcgtaccgagcatctaaacagagaaacctcctgcgaaaggactttgccgcccaagccgcaaccgaatttagagaacgccacctcacggacacaaggtacatcgcccgggagttcaaacggatggtcgaaactcacctaaaactcaacaagccaaaccaacgctgcgtagttgtcagtggccagctaaccgcgtacctgcgcgctcgttggggacttatcaaggtgcgcgaaaacggagacctccaccacgccctcgacgccgccgtagtcgccgcctgcagccacgccatggtgaagcgcctcgccgactactcaagacgcggcgaactgcaatacgcccgcggacaccacttcgacccagaaaccggcgaaatcatagacataaacgctctacgcaagttagacgaccatttcccccaaccgtggaccgacttccgacgtgaactcctagcctggctgtcgccagaccccgcacaacaactaaagaacttagcatactatacagacgaacgcctgaaacaagtcaaacctatccgagtatccagggcaccaaccagacgcggactcggagccgcccaccaggaaactatcagaagtgccaaatatctcggagaaaatcgctccaccgtgaaaactcccctagagaaactaaagctcaaggacatcccaaacatagtcggctacgaagaccctaggaaccatcaactcatacaagcaatatcacaacgactaacagagcacggcgacgatggaaagaaggccttcaaagaaccactctacaaaccaggcaacaataagtccacggctccagtagtaagatcggtcaaactcttcaccgtccaaaagagcggtattccagtccgaggaggcatagcgaacaacggtaacatggtcagagtcgacatcttcaccaagaaggaacgctacttcgccgttcccgtctacgtcagtgacgccgcacgtaacgaactacccaacaaagccgtcgccagaggaaaagatggctggattgacattgacgactccttcagcttcctcttctccctctacccaaacgactgggtctcggtcgtcgttaaaccacacgaggccccctgcgaaggctactacgcagggctagacatctcgaccggcgccatacacatatgggcacatgatcgcaatcgctcggtcgggaaaaacggactaatgagaagcatcggcataaagaccgcacattctgtcgagaagtaccacgtagacctccttggaaacttataccgcgtagtccacgagacccgcaaaccgctccgagcagggaaatga

SEQ ID NO: 6159 - RNA, 3207 nt, synthetic construct
  misc_feature 1..3207: note = Cas9 variant
  source 1..3207: mol_type = other RNA
atgcaatacgtcctcggcctcgacatcggcatagcctcatgcggatgggctgtcatcaaccaagaaaaagaacgaatcgaagacctcggcgtacgaatcttcgacaaagcagaaaacccaaaagatggcaagtccatggcaacacctcgccgcgacgcacgatctacccggcgaactcttcgaagaaagaaacaccgaatgcaacgcataaaaataatcctagtcaagcaaggcctactatcaaaaaccgaactagaccacctatacgaatccgcaacagaagtcgacgtatggaaccttcgccttgacgccctcgaacgaaaattaaaccccaaagagttcacccgggtactgatacacctcgcaaaacgccgcggatttaaaagtaaccgcaaggaaacgacactgagcgaaaacggccaaattctggagagtataagtgaaaaccaacagataatgggccagaaaaactaccgcacagtaggggagatgatcctgcaagacaagaaattcgagtcccacaaaagaaacaaagacggaacttacattggcaccgtcacgagacaacaactgcaagacgagatccaaatgatattcaacgcacaacgcctctacaaaaataactacgccaccgctgagttcgaaaactcttacctcgaaatctgggcgtcccaaaggccctacgcctccaaagatcaaatcgaaaagatgataggttactgcaccctggaacaaaaagaaaagcgagcccctaaagcctcgtggagctttcaatactttgtcgccctccaaacaatcaacaatctacgactgatatccaaggatcggatcgaggaactctccttcgaagaaaagaaacagatcatgaacctcgcactagagaaaagcatagtcaaatacatcgacatccgcaaactactatcagttccaaacgagttccaattcaacagcctttcatacagcgcagacaccgtcgacataacggtagaaagccgaaaatgcattgaactcaaagaataccacagcatcaacaaagtttacaaacaaatatacgagaaaaacgcgctgaacctactccccaaagattatgacacgatcgcctacggcctcaccatattcaaagacgacaaggacatccttgaatacctacagaacaaatacgttaacgcaaaaggtaaacctatctccaacttcgccaacaagacatacgacgacaccttcatccaggccctcctaaaccttaacttcaccaaaatgggtcatttgagcttcaaagcactcaaaaacatcatccccttcctggaagagggcctttcctacgacaaagcatgcgaaaaagcaggatacaatttcaagggaaccagctacacagaaaagactaaatacctaccagtcatcccccaaaacaccaaccccgttgtccaccgagccttatcacagacccggaaggttatcaacgcgatcatcaagaaatacggatccccaaacgccatccacatcgaaaccgcccgcgagctcagcaaaaccttccaagaacgcaaagagatagactcaatgtaccaggacaactcaaagaaaaacgagcacgccatatgcaaactaaaggaactcggaaacatcaacccatccggcataaacatagtcaagttcaaactgtggaacgaacaagacggtcgatgcatgtactccggtaaatacatcgagccccatcgtctattcgaggaaggatacaccgaagtggaccacattctcccgtactcgcgcagcctagacgactcttacaacaacaaaacactcaccctggggaccgaaaaccaacgtaagggaaacaaaacgccctacgagtacatgggaaacacaagcatatggaacgacttcgaaacccgggtccaatcgaacaagaagatcacgaaaaagaaacaacaaaaactattacttcagcacttctcgtacgcacgcgagcaggaatttattgaacgaaaccttaacgacacgcgctacgccacgatctacctatcctcactcatacaacaacacctaatattctccgaatcatcgcgcaaaaagaaagtgcatacagtgagcggcatcataacctcacaccttcgctcaaggtggggttttaacaaagaccggaaagaaggacacatccaccacgcacttgacgccgtgatcgtcgccgtgacctccgaccacatgatacaacgcgtgaccaaatactacaaactaaaagaactcaaccgcaacctccaagcgaaacgcatgccatttcccgaaccctgggaagggttccgcctcgagttagaggcccgcatctccccaaacacccaacaatacctcaaaggctttcggttcaaaaactacgccgacgtcaatctctctgaaatcaaaccaatatttgtatccagaatgcctaaacgatctattacgggcgaactccaccaagagacaatccgaaaattcataggatacaacgaaaaaggtaaagtcctgactgcgataaaaacgaaactggaagacatccctttcgatgcaaacggcgacttccccatgtacggcaaagaaaccgacctctacacgtacaacgccatcaaagaaaggttcctctcacacaagaaagacaaacgcaaatcattccaagaaccactctacaaaccgacaaagagcgggggcattggtccactcataaagtccattaaaatcatcgacacccgcacaatcgtcaaccccgtaaaccagggaaaaggcgtcgtctacaactccaagatcgcccgaaccgacgtcttcaagaaagacgagaagtactacctaatccccatttacaccatcgacctaatgaaaaacattctcccacaaaaagcaataaccgcagggaaaggctacgaagactggacgaccatcgacccgtccttcacatttctcttcagcctcttcccaaatgacctcatacagatagtcccctccaaaaacaaaacgataaaagcacgcacaacggtctcaaagaaagaagtcctcctaccttccctcacaggctacttcaaaggtgtacactcaggtacagccggcataaccgtagaaacccacgacggttccgtcatcgctaacgtcggaagcaaacaactcctcctcttcgaaaaataccaagtggacgtcttgggccactacactaaaatcaaagaggagaaaaggatcgggatggccatctga

SEQ ID NO: 6160 - RNA, 3210 nt, synthetic construct
  misc_feature 1..3210: note = Cas9 variant
  source 1..3210: mol_type = other RNA
atgaagaagcagccacaacgctacatactcggcctagatctaggaatagcaagcgtcggatgggcactcattctagtagacggcgccgaaaaccccgtaggcttactagactgcggggtacggacattcgaacgagcagaagtaccgaagacaggagactcactcgccctcgcccgaaggcaagcacggagcgtcagacgcctcatacgccgcagggctcaccgccttctcaggcttagacgactactaaaacgtgaaggaatactcagtgccgcagacttcaactcagacggattacccaacctcccaatagacgcatggcagctacgcgtcgcaggtctagaacgcaaactaacaaaccaggaatgggccgccgtcctcctccacctagtaaagcacaggggatacctctcacagagaaagagcgaaacccagacggaaaacaaggaactagggaggttgctcgcgggtgtggccgaaaacagcaaactcctctcggaatcaagcgaacagtaccgaaccccagccgaactcgcagtaaagctgtttgccgaacaatctggccgcctgcgcaacaaaggaggcgactacacacacacgtttaatagacttgatctgcagaaggaactgcacctcctgttcgaacggcaatgcgcactcggaaaccccttcgcttcggccgagctccaatccaaagtagacgagctgctgatgacacaacgcagtgcgctccaaggcgaagcagtcctaaaaatgctcggtaagtgcacattcgagccgagcgagtacaaagcggcaaagaacacctactccgccgagcgcttcatatggctaacaaaacttaacaacctcagaatcctctacaatggagaagaccgcgcgctcgacgagggggaaagaaagcaattactagacgaaccctacaagaaagcgaagctaacctacaaacaagtccgatccatactcaacctccccgaaagcgcggtcttcaagggactcagatacgggaaagacagtgacggactaaaagccgagaacggagcgcttatggaaatgaaagcatatcacaaaataagaaccgtactcgaaaaagccgggctcaagggcgagtgggaaaaccgaatccgcaacccggagatcctagaccaaattggcaccgccttctccgtgtacaaaacagacgaagacatcaaggcagaactggccgccctcagactccccgagaacgtcctggatgccctcctcgccggattgaattttgacaaattcattcaacttagcctaaaggcactctcaaacatactgcccctgatggaaagaggaatccgatacgacgaagcctgcaaagaggtctatggagaccaccgcgcactagccgagagcaaaaaccagatgttgctcccacagatacccgcgaacgaaatacggaaccccgtcgtcctcagaaccctaactcaagccagaaaagtcataaacgcaatcatcagacgctacggcagcccccaacgcgtacatatcgaaacggcccgcgaactcggaaaatccttcaaggacagaaaagaaatagaaaagcgacaagaagaaaaccgtaaggaacgcgaacgtgccgccgaacactttaaagaactcttcccccgcttcactggcgaacctaagagcggggacatactaaaattaagactctaccaacaacaacaaggcaaatgcctctacagcggaatcccaatcgacctagggcgcctcaacgaaaagggatacgtcgaaatcgaccacgccctccccttctcacgcacctgggacgatagcttcaataacaaagtcctagtactcggctccgagaaccaaaagaaacgcaaccaaaccccctatgaatacctcgacggagccagggacagccaacggtggcgagagttccaagcgcgagtacaaggctgccgattcccctacgcaaagaaacagaggatccaaaccgcgaaattggactcaaaaacagaacagggattcctcgaaaggaacctgaacgacacacgatacatagcccgatttctatgcggcttcatagaaaaatccctccatctccaaggagccggcaaacgtcgtgtcttcgccagcaacgggcaaatcacagcactcctacgtggcctttggggcctcaagaaagtcagagaggacaacgaccgccaccacgcactcgacgctatcgtcgtagcctgctcgaccgtatcaatgcaacagaaaataacgaaagcaatgcaaagaagagaaacgctcgaaaccatcaacacagaaaccggagaagtcaagacccgcatcccgcagccatgggacttcttccgacaagaagtcatgataagggtattctccgacgcgccgagagaggaactcgccgaaaaactcaactcgagaccagaagctctccacgacttcgtatccccgttatttgtaagtcgcgcaccaaacagaaaaatgaccggacaaggacacctagagaccgttaaaagcgccaaacgactgagcgagaacatcagcgtagtaaagaaaccactcacggctctaaaattaaaggatatcgaaaacatagtaggataccccgaccgcgagccagccctatatagggccctccaagaacgactacaggcctacaaagacgacccagccaaggctttcgcagaacccttctacaaaccggcaaaagacggaggacaaggtagcctagtaaaagcagtgcggataatagagaacaccaaacatggactaaaagtacgcaacggaatcactgataccaacggcgacatggtccgcgccgacgtctaccaaaaggcagacaagaaaggaaaacgtcaatactttatcgtacccgtctacgcctggcaagttgaaaagaacgaactaccaaccgtagactgcaaaggctacgaaattgacgacacctacgagttctgcttcagcctctacaaatacgacattatcgaaatacaaaaccccgacaacatgtcaaaagagctacgcgtctactacatcaactgcgatagcagcgacggcagattttggctagcccaccacgacaagtcagccaaggaacaacaattccgcatctcaacgcagaaccagcccattattaagaaataccaggtagacccactcgggaaagaaattcgactctgcaaagcagaaaaacgaacagaactcaacggcaagaagaagaaatga

SEQ ID NO: 6161 - RNA, 3210 nt, synthetic construct
  misc_feature 1..3210: note = Cas9 variant
  source 1..3210: mol_type = other RNA
atgaactacgacatcggtctcaggatcggcatcacatcctgcggatggtcaatcataaacaaagacttagaaaggatagaagacttgggcgtaagggtcttcgagaaagccgaaaaccccgacgggacagcctcagccgccccgcgccgcgaagccaggaagagtcgccgaaaacacagaaggaagaaacaccgcatcgaacgcatcaaaagactaatcgtacaacacgacctcttaagcaagaaagaactcgacagcctctacctaagccccttcaacatcgacgtctggaacctccgggttgaagccctagagagaaaactagacaaccgagagttcgccagagtcctgatccaccttgtccaaagacgtggcttccagaccatccgcaaatcagtggaaatacaggaagaaggcaaactcctcgaaaacgtatccgaaaacgagcgcatcatgaaagtaaacggctacaaaactgttggtgaaatgttcagcaagcacgagaaattcacccaccacaaaagaaacaaagacggcagttatacaagcgtagtcaccagatctcttctattaaaagagataaaaacaatattcaactcccagcgaatccttggaaacgtattttcaacacaaaagctcgagtccgactatttatatatctgggggagccaacgccccacgctgacctacgaacaacttatgagcatggtagggaactgcatctatgagaagaaagagaaacgagcccccaaaacctcctgggcgttccaatacttcagcctcctccagaaaatcaacaagctcaaagtatcagacgacaacacactacgaaaactcagcaaagaagaacgcgatatcgtaatcgaactcgccttcaaaaagaaaaacgtatcgttcgtcgacatccgcaaagccctcaaactcaacgacaataccaaattcaatcacctgacttatagccacgtcgtagaaaccaagaaagtcgaaaaagccaccttcatcgagctaaagggctaccacctgataaagaagcaactcaaggaccgcaatgtcgagctcactcaagaactccaaccaaaggactacgacgcaatcgccgcagcgtcaacatttttcaaaaacgacatagagttccgagactacctacgcaatcaatacctcgactcaaacggaaaacgcaaatcaaacatcgccaacaaagtattcgaagacaaagtgatcgcagccgtctttgaactcaacttttccaaagtctgccaccttagttttaagtccctgtataagctaataccccacctcgaaaaaggcctggactacaaggaggccattctctgcgcgggctacaacttccgtgacgaaaacaaacgagacaagaaacttttcctgcccgttatacaacaagaaaccaaccccgtcgtccatcgggccctgacccaagcacgaaaagtaatcaacgcaattattcgcgagtacggatcgccaaacacaatccgattcgtagtcgctaacgatctagcaaaaacctacaaacaacgaaaagagctagagtccacgctcaaaaagaacagagccgaaaacgagaaaatcaagacaaaactcctatcaatgggcataatcaatccgacaggaatggacattgtaaaatacaaactctggtatgaacaaagcggaatatgcctctacaccggccgccaaatggagctgagcagcctattcaaaccgggatacagcatcgtaaaccacatcataccctacaaccgatcattcgacgacacttaccacaaccgcgtcttgacactaaccgaaaccaagtacgaaaaaggcaacaagatcccctttgaatacttcggagcggaagaaacctgctggaacgagtacgagaagcgtgtatcgaccagcaagaaaattcacgataagaaacgcgaaaaactactcatacgtaactttgacatcgaatacgaaaacgagatgatcagcaacaacgtcttcgacactcactacatcggttcctacttcgaaaaatacatcgacgagcatctgcagttcaagaaaagcacgaagaaacagaaagtattcagcatccacggaaacatggtagcgcacttgcactcacgctggggattcaacaaaaactcgcgcgaaatatacctgaaccacgcggtcgatgccgccattgtagccgtactgaccgaccaattgatccgcaatatcgccgactactaccgacgcgacaacattctcgaacaaaaaggctcgctcaaattcccggaaccgtggaaatccttcagcatagaactggaagcgagaatcagcccccaagtacgcgacctcatcaagaaactcaacctggactcctaccttgatgtcgacatactacacatcaaaccggttttcatctccaagaaacccagacgcaaagtcaacggcgaggcccacaaatccactatccgctcgctcatcggcatcaacgagatcgggaaaacagtaacctgcataaaaacacgactagaagacatccccttcgacgaaaacggcgacttcccgatgtacggcaaagacacagacaaatacacctacacggcaattaaggaacgctacctcgagttcaacaaggataaggaaaaagcattctccacacccctgtataaattaaaacgaaacggcgaacctggcaaccaaatcaaatccgtaaaaataatcgatacccgaaacatagtaaacaaggttaaccaaggaaagggcatcgcctataacagcaacatcatccgcgtggacgtcttcagccgagaccaaaagtactacgtagtcccgatctatttacgagatttcatcaagggatccctgccaaacaaaataatcaccgccgctaaggggttcatgcaatggccggagactgacaacagctatacattcctattttcgatcttcccaaacgacctgatcaaagtagttccaaaagaaggcaaattcatcaaagccaaaaacgaaaacaaggaaaacatcaaccttaccgaaatactcggctacttcaaaggcctagacagcagtacgggagctttcaccctggaatcccacgacggctcgctactggcccgaggaatcggaaccaaaaacctattactcatagagaaataccaggtggacgtcctcggtcggtacaacaaggtcggcaacgaagaacggcaggacatcaagatacaacaaaactga

SEQ ID NO: 6162 - RNA, 3210 nt, synthetic construct
  misc_feature 1..3210: note = Cas9 variant
  source 1..3210: mol_type = other RNA
atgaactacgacatcggccttcgtataggtatcacatcatgcggctggtctattatcaacaaagacctcgagcgaatcgaagatctcggagtccgcgtattcgaaaaggccgaaaacccggacgggaccgcctcagcggccccgcgccgcgaagcccgcaagagccgacgcaagcaccgacgcaagaaacaccgaatcgagagaatcaaacgacttattgtccagcacgacctactgtcaaagaaagaattagactccctgtacctatctcccttcaacatcgacgtgtggaacctccaagtcgaagcactagagcgcaaactggacaaccgcgagttcgcacgggtactaattcacctcgtccaacgcaggggcttccaaaccatccggaaatcggtcgaaattcaagaggagggaaagctcctggaaaatgtatcggagaacgaaaggataatgaaagtaaacggctacaagaccgtaggcgaaatgttctccaaacacgagaagttcacgcaccacaagcgcaacaaagatggatcctacacctccgttgtcactcgctcactcctcttaaaggaaataaaaacaatattcaacagccaacgaatcctcggaaacgtcttctcgacgcaaaaactagaaagcgattacctatacatttggggcagccagcgaccaaccctgacgtacgagcaactgatgagtatggttggcaactgcatctacgagaaaaaggaaaaacgcgcccccaaaaccagctgggccttccaatacttctcgcttctccaaaagatcaacaaactaaaagtaagcgacgacaatacactccggaagttatcaaaagaagaacgtgatatcgtaatagagctagcctttaaaaagaaaaacgtctccttcgtcgacatccggaaagccttaaaactcaacgacaatacaaaattcaaccacttaacctactcacacgtcgtcgaaaccaagaaagtcgaaaaagcaacattcatagaactgaaaggctaccacctcatcaagaaacaactaaaagaccgcaacgtagaactaacacaagaacttcaacccaaggactacgacgcaatcgcagccgcctcgacgttcttcaaaaacgacatcgagttccgcgactacttgcgcaaccaatacttggactctaacggtaagagaaaaagcaatatcgccaacaaagtattcgaagataaagtgatcgcggccgttttcgaacttaacttctcgaaagtctgtcacctatcgttcaagagtctgtacaaactaatcccccaccttgagaaaggcctagactacaaggaagcaatactctgcgcaggctacaacttccgggacgaaaacaaacgcgataagaaactattccttcccgtcatacaacaagaaaccaacccagtagtgcaccgcgcattaacgcaagcacggaaagtcatcaacgcgatcattcgcgaatacggatcacccaacaccattcgcttcgttgtcgcaaacgatctagcgaaaacgtacaagcaaagaaaggaactcgagagcacactcaagaaaaaccgcgccgaaaacgaaaagataaaaacaaaactgctctccatgggtatcatcaaccccaccggaatggacatcgtgaagtacaagctctggtacgaacaatcaggcatctgcctctacaccgggcgccaaatggagctatcctcccttttcaaaccaggctactccatcgtcaatcacatcatcccctataaccgttcattcgacgacacctaccacaacagggtactcactctcaccgagacaaaatacgaaaaaggaaacaaaatcccgttcgaatacttcggcgcggaagaaacctgctggaacgaatacgagaaacgagtctcaaccagtaaaaagatccacgataagaagagggaaaaactactcatccgcaatttcgacatcgaatacgagaacgagatgatcagcaacaatgtcttcgatacccactacatcggatcgtacttcgaaaaatacatcgacgaacacctccagtttaagaaaagcacgaagaaacaaaaagtctttagcatccacggaaacatggtcgctcacttgcactcgcggtggggcttcaacaagaactcacgcgaaatctacttaaaccacgccgtcgacgccgcgatcgtagcagtactcaccgaccaactcattcgcaacatcgcagactattacagaagggacaacatactagaacaaaaaggctccctgaaattcccagaaccctggaagtccttcagcatcgaactggaagcccgtatcagcccccaggtccgcgacctcataaagaaactcaacttagactcatacctcgacgttgacatactgcacatcaaaccggtcttcatctcgaagaaaccccgcagaaaagtcaacggggaagcccacaaatccaccataagatccctcatcggaatcaatgaaatagggaaaacagtcacatgcattaaaacacgcctcgaggatatccccttcgacgaaaacggggacttcccaatgtacgggaaagacacagacaaatacacatacactgccatcaaggagcgctacctcgagttcaataaagataaagaaaaggctttctccactcccctctacaaactaaaaaggaacggggaacccggtaaccagatcaaaagtgtaaaaattatagacacccgcaacatcgtaaacaaagtaaaccaaggaaaaggaatcgcctacaacagcaacatcatacgcgttgacgtattcagccgcgaccaaaagtactacgtggtaccaatctacctcagagacttcattaaaggttcactccccaacaaaatcatcaccgcagcaaagggtttcatgcaatggccggaaacggacaacagctacaccttcctgttctcaatcttccccaacgacctgatcaaagtcgtccccaaagaggggaaattcatcaaagccaaaaacgaaaacaaggagaacattaacctcaccgaaatactcggctactttaagggcctcgattcgtccaccggggccttcactttagagtcccacgacggctccctcctagcccgaggaatcggaacgaaaaacctcctgctcatagaaaagtaccaggtcgacgtcttgggtcgatacaacaaggtcggcaacgaagaacgacaggacataaaaatacagcagaactga

SEQ ID NO: 6163 - RNA, 3213 nt, synthetic construct
  misc_feature 1..3213: note = Cas9 variant
  source 1..3213: mol_type = other RNA
atggcaacgagactcggcctcgacatcgggacgaactccataggctggtgcctatacgacggcgactcaatccgcgacatcggcgtccgaatcttcctcgacggaagagagcccagcaagctgacggtgtccggctccggaacgcccctcgccgtaaaacgccgcgacgcccgcggcgcccgaagacgccgcgaccgatacatcggtcgccggagcgctatgctcagagaacttcgaaaacacggcctgctaccagcagatccaaaacaggcaaaagtattagagacacaggatccatacgcactaagagttagagccctagacgaaaaacttgaaccacaccaaatcggacgagcactgttccacctaaaccaacgacgaggattcaagagcaacagaaaagcggaaagggccagcaaagcaggagaagacggcaaaatcgccacagcaacaaaactgctagacgaagaaatgcaacgcctgggagcacgcaccctaggcgagttcctagtgaaacgagacagcgagttcgacggagaagcaggcaaacgagtacgcatgagagcagactcgaaggcatacgacttctaccccgaccgccgccacgtgctagacgagttcagagccatctggaacgcccaaaaagtatggcaccctgaactactcaccgaacaggcctggaacgacatcttccgggtcatcgaataccagagagaactaaaaccacaagtagtcggccactgcaccttcgcaggtataaacggggtacccgccgacgaaaagcgactgcccaaagcccacccactgttccaacagcgacgactatacgaagaagtaaaccaactaaaggtcgtcgccccgggagaagccggaagaccattaacccgcgacgaaagggacgcactaatcctaaaactacaggacaagaaatcggtatcattcgagaccctgggaaaaaccctaaaactcaaagacggtgaacgattcaacaaggaaagtgaaaaccggaaggccctggacggagacgaagtccgggcagccctcagcggaaagaaactcttcggtacacgctggttccatttcagcgccgaggaacaatggatgatcatcgaacgactcctcgaagaagaagactctgaaacactactaacatggctcaaaatcggatacagacttgacgacgaggcagccctggcagtcgcaaatgccaaactacccgagggccacggccgcttcggactcagcgccacaaccgcccttctaaaagaactcaaagccgatgtctgcacctacgccgaggccgcaaaaagagcagggttccaccactcggacttccgcaccggcgaagtcttcgaccagctcccatactacggagaaatactcgcccgggaaatcgcacccggcaaaccagaatatggcgacgaaaacgaacgaagattcggcaaaatcaccaacccaacggtccacatcggactcaaccaactaactaagctcgtcaacgctataatcagactacatgggaagcccgattacatattcgtagaactagcaagggaactaaaactcaacgaaaaagagaaaatcgcatacaaccgtcaactaaaagaaaacaccgacgcagcgagagatagaggcgcaaaactaggaacaatgggggtaagagacactggccgcaacaggctaatactaagactgtggaccgaattgaatccaggagatgctctaaaccgacgatgcccgttctgcggagaacagatatcacaaagaatgatacagaatggggaagtcgaaatcgaacacataatcccatacagccaatgcttcgacgacggaatcgggaacaaggtcctcagccacgtaagatgcaacaggcaaaaaggagaccaaacaccctgggaacgatggggccacgacccagatcgatggtcaataatccaagaacaggtcgcccacttacacagatccaaacaatggcgtttcggtccagacgcccgggacaggtacgcagctgaagaagacagctttctccccagacagcttattgatacgcaatacctcacaagaatcgccgccaaatacctcgcttgtctatacccagagcgcggcgagagacacgtgttcgccgtccacggaggcatgacagccatgctaaggcgcctctgggacctcaacagcatcctactcgaccacaactgggtcgaaaacctcaatagcaacgcaccgaaaaacagacttgaccaccgtcaccacgcgatcgacgcggcggtggtgggcatcatgaccccaggcctaatagccgaaatcgcaaaagctgccgctagagcggaaaaacaaaacctagatagactgttcgaagaattacctatgccctgggcccaacacccgaacgaccgccgtttccgcgacgaactccgcgagaaaatactggctgcgacggtctcccacaaagccgaccacggacgacagggcaagccagaaagaggaagagacattaccgccggcaaattgcacaacgacacagcatacggcttcacgggccttaccagcgataccggccttccagtagttgtacaccgagtcccattaacaagcctcacccccaaagatattgccgaccccgatcgaatccccgacacgaccttaagagggagcctctggcaagccacacgtgacctcagcggcaaggagttcgagaaagcactgctggacttctctcgcacccacgcacaatttaaagggatcagacgagttagagtacgagaaggcctcacactcatccccatccgaaaccacgccggaaaaccctataaaggttacctaggagacagtaacgcccgatacaacgtttggcaaatgccagatggccgctgggtccaccaagtaataagcacatttgacctccaccagccaggcttcatcgaacaaagaccacaccccgcagccaaaaaggtgctcagcctgcgacaaaacgacctaatcgcaattgaacgcgacggagcactccgacaaatcatgagagtacaaaaatacggccaaaatggtcagatcttccttatagaacataacgaagcaggtaacatggcagagagaaacaaaaatacagacgaccccttcaaattctacggaccgggagcatcggcactcaggaatatgaaagcccgacaagtacggatcgacgaactcgggcggatattcgacccaggcccacggtga

SEQ ID NO: 6164 - RNA, 3213 nt, synthetic construct
  misc_feature 1..3213: note = Cas9 variant
  source 1..3213: mol_type = other RNA
atggccaaagacttcgaatacatcctaggactggacctgggagaaacctcaataggatggagcgtggtccgactaaacgaaggagtacccgagcatctcgaacgactcggagtcagaatatgctctgatggacgcgatgcccagagccacgagccactctccgtagccaggaggatcgcacgcggcctccgacgacggcgtgaccgctacatccaccgtcgaatccgcctcaccgacgtcctagtaaagtacggtctcatgccagaggacatcaaagagcgcaagaaattacaggccctcaacccataccgactccgcagcgaagccctcgacagaaaactcgaaccttatgaactaggccgagtcctattccacataaaccaacgccgcggcttcaaatcaaacatgaaaacagaccgcaaagacagcgaaagtggagcaatgaaacaagcaatacttaaaacacgagcgaaaatggaagcaagcggcgcacggaccctgggtgagttcctatacttcctcaacaaggacaaaacatcgacacaagaatatgtacccgtaagaatgcgaagccacagcgaaaagaacaagacggtctacgaaatgtacccggatagagccatgtacgaagacgaagtccacaagatcttcgaacaacaggaactctccccggaggcccaaacggaaatattcaacacaatattcttccaaaggccgctgaaacccgtagaactcggattctgcgagttcgaagacggtgagcgacgggcatacaccgccagtgtagtttttcagaagttccgcgctctccagcagataaaccagatttacgtacaggacgactacgagcgccgcccgctaactaaagaggaaaaggacatactaaaacacttcctgctagaagacttcagcgccctcgacaagaacggactcctaacctgggccaaagtccgcaccctcttgaaattgcaaaagaagaaattcaacctggaaagcgaacgccgcaaaggactaaatgcagacgtcacatcctggaaactcagtaacgccgcatgcttcggccgagaatggttctcattctccgacgccaagaaggaagaaattgtcgcacttatcacgggagcagaaaaagaagaagaattaatagcagaactcaaaacaaagtacgggctatcagacgagagagccaaaaacacagcaaacgtatccctcccagacggcgtcgcaagtctgagcgccaaggccatgaagaagctcatcccgttcctcgaagaaggaatgctgtatgacgacgcagtaaaacaggcgggctatgtattcagctcatccttcaagggagtgctccccgaaaagtacgaaaccttcatcgaacccgaaagcggagaatgtttcgacgagctaccatactacggccaagtcctccgacgctacgtgctcggaggggtaccatcagaggaaaacaaactattccccgagaaatattacggcaagatcaacaaccctacagtgcatatagtcctgaaccaactaagaaaactgataaacagcctggtcgccaaatacggacatcccagaaagatcgtagtcgaaatggcgcgggacctaaaactcagtaagaaacaaaaagatgcaatagctaaagaacaggctctcaacgaacgcgaaaacaagcgaatcggcgcagaactagaacgcctcgatatacgaaacaactacgacaaccgaatgaagtacaaactctgggaagacctctcaacggacccaacaaagcgtagctgcccattctgcggaaagcaaatctcacaacaggatatcttctcccctgagtttgaaatcgaacacctcataccattcagtcggagctttatggacggccggtcgaacaaagtgctctcatgccgacgctgcaaccgcgagaaaggcaacaagacccccttcgaagcctttggaaacgacagcacacgctggaacgcaatcatgggccgagtagaatcgctacctgaaaacaagcgctggaagttcgcctccgacgcaatgtcaaggttcgaacgtgatggcgatctcctagcacgcatgatgacggacacacaatacatggcacgaatcgcccggcgctatctatgctgcgcagcaaaccccaaccaagtttatggtatacccggccaactcactgccaagctccgcgaacattggggcctcaactccatcctatccgaccagaaagagaaggaccgaagcgaccaccggcaccacgcgatagacgccttcgtagtagcctgcacagaccggggcacactccaaaagtactccacagagcgacgcgactacgccaaaccggaaatgcctagcgagaaagcgccccacatccccttcgcggacttccgcctcagcgacataaaaagagtcttcgacgagataatcgtatcgcacaagccggacagaggcaacgcacgggcagccatcttaaaaggcgggacggttgccaaactacacgaggaaacatactacggaatgggcggagaaggctcaaagaaaggaacatggaaactcatccaacgaatcccagtatccgaaatcaagaaagcgtccgacctagactgcctgatagaccaaaaaggcaccgcgaaccccctccgagtgctgctcgtaggagcaagcgaatcggaacaggaacaaataatagcatcatacttcgcccgaagaggaacgcacaaagtgcgcacctaccgggagcgaaacaaggacgtaatcctcccgttcaaggacaaagacggaaaactctaccgatacgcagtctatggcagcaacgcgtacgcagaaatctactgccctgacagaggaaagaacgcaggtaaatggcaggttgaaatcattcccaactactgcgcccaccagaaaggatttatcccgaaatggcgccacaccgacgctcacgctaaactcatcatgcgcctctacaggaatgacatggtggcatacgagaaggaaggaaaaacagtgatcgcccgcgtaaagaaaatgggcggaaacggcgtcatcgtattccgaaaccacttaatcgccaaagaagaaggcgaccgcctcagctggcaagccgtggtttcaggaatgcaatcagccaacctccgtaaaatctatgtcgacgtactaggccgggtgatagaccctaaacgacccatgacccaaaacgaaacagatggacaagataactga

SEQ ID NO: 6165 - RNA, 3213 nt, synthetic construct
  misc_feature 1..3213: note = Cas9 variant
  source 1..3213: mol_type = other RNA
atgagccacttccgactgaaacaactaaactacatattaggcctggatctaggcatagcatcagtagggtgggcagtagtagaaatcgacacagaagagaaccccacacgcctaatagatgtcggagtacgaaccttcgaacgagccgaagtacccaaaacaggagactcactcgcagcagcgcgacgccaagcgagatccgcccgaagactcatacggcgacgaacccaccgcctactacgtgcccgcagactactcaaacgggaaggcatcctacacgcagacgacctcaacgctgaaggtctagttaaagagctccccaacacgccttggcaactaagagtcgacggcttagatcgtaaattaatgcccaaggagtgggcagcagtcctgctccaccttgtaaaacatcgcgggtacctatcacaacgcaaaaacgagtccgaaggcgccgacaaagaactcggccgactgctcgcgggcgtccacgaaaaccaccaggccctccagagttcagaatatagaacaccagcagaactagccgtcaagaagttccaagcacaaagtggccacatacggaaccaaagaggggactacacacacaccttcgacagaaaggacctccagcaagaactccaccaactcttcgccgcccagcaaaaatatggtaacccatttgtgtcagacggcctgaaacagggcatcgagaccctactaatgcaacaacgaccggcattgtccggcgacgcagttcagaaaatgctaggcagatgcacattcgagacggaagagttcaaagccgcaaagcacacatattcagcagaacggttcatatggctcacgaaactgaacaacctaagaatacaagagaacggcaacgaacgatgcttaactgcccaggagcgcggccaaataatcgatctcccatacaagaaagcgaaactaacatacgcccaggtccgcaaagagctatccctccccgaaaacgcattcttcaaaggtttgagatacggcaaagagaacgccgagacagccgccctcatggaaatgaaagcctaccacgccatcaggaaggcacttgaaaaagccggactgaaaaccgaatggcaagggctagcatgcaaacccgagctcctagacgcaataggcaccgtcttctcactctataaaaccgacgaagacattagcacccgcctccaagggcaacttagtgaagacgtaataaacgccctattagccggcctcaacttcgataaattcatccaactatcgctcaaagccctatcaaagatcctccccctgatggaacagggccagcgatacgacgaagcccacgccgcactatacgtccgtagcacgccacaaccacagcggctgctgccccaaatcacagcagacgaaatatgtaaccccgttgtgctgagaacactatcccaggcccgaaaagtcatcaacgccatcgtaagacgctacggatcacccgctcgaatccacatcgaaaccggacgcgaagtaggcaaatcattcaaggaccgccaggagatccaaaaacggcaggaagacaatcacaaagagcgaaaacaggcagcagaaaaatttctagaatatttcccgaatttcgtagggcaacccaaggccaaagacatcctcaaactccggctctatcagcaccaacacggccaatgcctatacagtggcaaaacactggacatttgccgacttaacgaaaaagggtacgcagaaatagaccatgcacttcccttctcccgcacatgggacgactccttcaataacaaagtcctggtgctcgccggagagaaccaaaataaaggaaaccaaactccatatgaatggctaggcggcgcatctaactcaccccgctggcaggagttcgtagcacgcgtaggtagcagtcgcttccaccactcaaagaaacagagaatactcctccgtcaactcgacgaagaagggttcaaagaacgaaacctcaacgacacacgctacgtcgcgcgattcctctgcaaattcatcgaagagaacatgctcctcctaggacgcggcaaaagacgagtcttcgcatcaaatggccaaataacttcgttcctacgaagccgatgggggctccgtaaagtacgcgaagaaaacgaccgacaccacgccctcgacgccgtcgtagtggcctgctccaccgtggccatacaacagcgcataacatacttcgtccggcaacgcgaaatgaacatcttcgacggagaactcatcgacaaagaaacatcagaagtcagtagaccgtacttcccacaaccatgggacttcttccgacaagaagtaatgatgcgagtattcggcaaacccgatggggaccccagcttccccgaagccgacacgaaagaaacactctgcacactcctagagactaggctcagctccagaccccaagccgtgcatgagtacgtcacaccactctttgtctcccgcgccccaacccgaaaaatgtctggccagggacacaaagaaacggtaaaatcagcaaagctcttacacgaaggaaaaagcgtcctgcgagtcccactaacccaactaaaacctaacctcctcgagaaaatggtcaacagagaccgcgaaccacaactctacgaagcactcaaagaacggctagcggcatacggtaatgacccggccaaagccttcgccaccgaatttcggaagaaagggggacaactggtcaaagccgtacgagtcgaagacacccagaaaagcggcgtcctactgcacaaaggcaccggcgtcgcagataacgcaacaatggtccgtgtcgacgtcttcgagaaaagcgggaagtactatctagttcctatatattcgtggcaagtcgcccaaggcatcctcccaaacaaagcagtcatccaaggcaaggacgagaagaactgggacgaaatggacgaaacgtacacattcaaattctcaatgtaccccaacgacctcgtcgaaataaacacaggcaaacagcgcctcttcggctactatataggcctagatcgcgcaactggcgcaataagcataagagaacacgacctcgacaacttcaaaggcaaaaacggaatatacagagtaggagtaaaaaccgccatatccttcaagaaataccaaaccgacgaactcggaaaagtcgtggtgccatgcagacccaagaaaagactccccgtccgctga

SEQ ID NO: 6166 - RNA, 3216 nt, synthetic construct
  misc_feature 1..3216: note = Cas9 variant
  source 1..3216: mol_type = other RNA
atgaggctagggctcgatatcgggaccaacagtataggctggtggctgtaccagaccgacgacgggacaatcaccgacgtactcgacgggggagtgagaatattctcggacggacgagacccccagagcaaagaatcattggcggtagaccgcagagtcgcccgggcgcaaaggcgcaggcgagaccgatacctcagacgcaaggctgcgctcatgaaaaggatggcgggagcaggcctgatgccgacagaccaagcgcacgccaaaaagctcgagagcctggacccatacgcactccgagcagaaggactcgattgcgaactccccttaacacacctaggcagagcactcttccacttaaatcagagaagaggattcaaatcgaacaggaaaacagaccggggagacaacgagagcggaaaaatcaaagacgcaaccgcacgactggactgggcaatgagggacgccaaagcaagaacatacggggaatttctacacacgagacaacagaaagcagatgacccaaaaagaatgccaacagtccggacaagactgacagtggcgcgacgcgacaatgccgagaaggaggaagccggatacgacttctaccccgaccgacggcacctgtccgaagagttcgacgcactctgggcggcacaagcagactaccacgaagcacttagcgacgacttgagggaccagatcaaaacgataatatttcaccagagaccactgaaaacacccgaagtaggactatgcctattcacagacgaaagaaggatcccatcagcacacccgctcaaccaacgaaggatactattagaaacggtaaacgcactacgaatcgtagcaagaggggaagcggcaagacgcctcacactcgaagaaagagatcaaatagtccacgccctagacaacaaaaaccacactaaaacactctcagggatggcaatgaagttgaaagcactaggaaaagtaataaggctccgcagtgaccaaacgttcacactcgagacagccaacagagacgccatagcatgcgacctagtacgagcaagccttagccaccccgatcgaatgggcggtgtctggacgacactagacgaaggagcacagtgggaggtagtccaaaggataagggctgtgcagtcggactcagagttcgacgcgctagtggtctggctagaacagaaccacgggctcgacaacgcccacgcgcaagccaccgcgaacgcaccactgcccgaaggatacggaagaatggggctaatggccacacgacggatactcgcagcgctacaatcagacgtgatgccgtactcggacgcagtggcggcctgtggatggtcccacagcggagggcccaccggagaagtcctggaaaagctaccgtattacgggaagatcttggaccgccacgtaatcccgggaacctacgatgaaaacaacgaagacgtgaaaaggtatggaagaataacgaatcccacggtacacataggactcaaccaaataagaagactcgttaaccggattatctgcatacacggaaaaccggacgagatcgtagtcgaactggcccgagacctgaaaaactcagaagatcaaaagcgtgagatccagaaaatcattaagaaaaacaccgacgcagcaatcaagcgcggcgaaaagctaataaacgaactagggcaaaaggacacgggagccaataggctagtgctgcggctgtgggaggacctaggacacgacgtgatgacgagaaattgcccatatagcggaaaacgaatctccgcagggatgctattcgacggaagctgcgacgtagaccacatactcccgtactcgcgaacactagacgatggaatagcgaacaaaaccctatgcctaaaagaagcaaacagacaaaaatccaacaatactccctgggaagtatggggcgaaaccgaacaatgggacacgattgccgctaatctgaaaaacctaccggacaacaaggcatggcgctttgcatcagacgcgatgcaacgattcgaaggagaaaacgacttctccgctagagcgctaaaagacacgcagtacctaagccgaatcgcccgggcatacttagacgccctttacgacggcggagacggcaacagccacgtatgggtagtcccaggaagactgacagagatgctccgacgacactggggactcaacgggttagaagcgctaacagactccgacgaaaatacggtcaaggccaagaacaggatggaccaccgacaccacgcgatagacgccgcagttgtagcggccacggacagaggactaattcaaagaatcagcaaaatagcaaaacgggacgaacaggcaggagccgaagaggtggcgagatcggtcagcccgccctgggatggcttccgcgacgacattgccgctcaactgagccgaatcatcgtaagccaccgcgcagaccacggccgcatcgactcccaagcaaaacaacaaggcgaagacgccacagcggggcaactacacatggataccgcctacggagtagtggacgccgggcgggtagtctcgcgcaaacccctgctatcactctccgaatcagacataaagaaaatacgcgatcccgacctccaacgacacctaacaagggtcacaaaaggcctggacaagaaagagttcgaacacgccttaagcgatttcgcaaatgcacgaaaactccccgaccagagcgaaaacccgtactttggaatgcgccgcgtacggctaatcgacgcattacaagactcggcccgggtcagtgtacgagaccgcgacggccacatctacaaagcctacaaagccggctcgaaccactgctacgaagtatggaggctaccagacggcaagataaaaccctgggccatctcgacatttgaggcccaccaaaccggaacagaaagcaaaccccaccccgcagcaaaacgcttgctaagagtattcaagagggacatggtcgcaatagagagagatggagagaccctgatgtgctacgtccagaagatggacatcgccaacggcctcttcctagtccctcacacggaaggaaacgccgacgcacgaaacagagacaaagacgactcattcaaattcatccagatgtcagcggtaagtctaatccgggcaaagatcagacgcatacacgtcgacgaaatggggcgcctaagagaccaaggaccacccagatga

SEQ ID NO: 6167 - RNA, 3216 nt, synthetic construct
  misc_feature 1..3216: note = Cas9 variant
  source 1..3216: mol_type = other RNA
atgagatacaccataggcctagatataggcatagcatccgttgggtgggcagtgatcaatgaggacaagagtcggatcgaggacttgggggtaagagtcttcaagaaagccgaggaacccgatggaaaaagcctgaacctggcccggagagaggcccgaggaagccgccggcggatacgacgccgagcaacaagaatgcagaaggtcaaagaactcctcgtcaagtacaatctcgtcagcgagaaggagctcgaaacgctctacatcatcaccgaaacgacaccggacgtgtacgagctcagggccaaagggctcgacagactgctcagcaggcaggagttcgccagagtactaaccaacatcgcaaagcgaagaggatacaagagcaacaggaagatcgacgaagaagacaaagaagtgggaaaactcagcaaaggcaccatcgaaaacaaacggatcctccaagaaaaaggataccgcacaataggggaaatgttctacaaagacgaaaagttcgaatataacaaacgcaacaaagcaggggaatataactcaacggtgttacggtcaatgctcatcgacgaagtacatacccttttcgaaatgcaacgcaagttcaaaagcgagttcgcaaacgaagagttcgaaaaggaatatgtcgaagtcatgacctatcagaaaccatacataacgccagaactgttagagaaaatgctcggcaaatgcacattcgaaaaaggggaacccagagcgcctaaaaattcctataccttcgaacgattcatgcttctccaaaaagtcaacaacctcaacatctacatcaacggggaaaaggttgaaatcccccaagagaaaaagaaagaaataatcgaactcgcatacaaacagagcgaaataaaatacacacagctacgaaagaaactagaactacccatcgaggcccggttcgcggacctcaactaccaaataaaaagaacagaggacgagagcgaggaagcactcgtcaagaaaatagaggacaagaaattcgtcaaactcgaagggtggcataaaatacggctcgcactaaaagagaacaaagataaattcgagaaaatagagaaaaatccagaattacaaaacatcatagcggacgcactcgttaggaacaagaccgatgaaactatcaaaaactacctagaaaaatccgacatagacgaagaaataatcaacgcgatcctcaacatcaacttcacaaaattcggacacctctcctataaggccatgaacaagatcatccccgaactagagaaaggactcacctacgacaaagcgtgcgaaaacgtaggctacgagttcaaagggcgcaaaaacgaactccaatataaactaccgcccgtcaccgaactagaagacgaaatcctcaactcagtggtactgagagcggtaagtcaaaccaggaaggtcattaacgccattatagacaaatacgggtcccccaccgccatatacatcgaaaccgcacgcgagctcagcaaaccgtacgatgaacgcatgaaaatcgaaaagcgacaaaaagaaaacgcggctaacaacgaccagataaaagaatacatcaaggaaactttcggattcgaccccaaacctttcgacatagtaaaaatgaaactctggcgagagcaaaacggaaagtgcgcgtacagcagtaaaccgataccggcagaacgactttacgaggaaaacttcgtacaagtcgaccacatcattcccttctcacgctgcttcgacgactcctaccaaaataaggtgctggtactaacagacgaaaaccagaaaaagaaggagcggacgccattcgagtacttcggggaagacaaggaaaggtggcaccaatttgaggagttcgttaacctaacctacaagttcaacacgcggaagaaagaaaacctgctcatcaaaaacttcaacgaagagaaaagtaaggaatggatccagagaaatatcaacgacaccaaatacatcagcaaattcatgtacaactacatagccaataacctgaagtttgccgacagcgagtcaaaacgaaaggtctacaacataaacggccaagcgacctcaatcctccgccattactgggggctaaagaaggacagagaagagagcgacaagcaccacgcacaagacgcagtgataatagcatgtgcaaccaataagaacataaagaaagtgtccgactacagccgaagaaaactcctatacaaaaacaacgaaataatcgacgaagaaacaggagagatcatcgacaaaaagtacaacatagacatcagcatcaaggaaccctggccaaaattccgcgaagaagttgaagcccggatggaagatgcagacaacaacgggcagctatacgccctgataaacgggaactttacaaactacgacgacgtagacatcacccacataaagcccatattcacctcccgcatgccggagcgaaaaatcaccggacgggcccacaaagacaccatgcgatcacagaagttcattcagcaaggccaaaatttcacagtggtgaaaaagccgctcaaggcgataagcaagcaggagatagagggaataatcaacaacccagacttcaaaaacctgtatctcagcgacaagaaactctacgacgacatctaccagaaaatgaaagaagcagacttcaaagcagaaaaagccttcgccaacgagtaccgcaaatacagcaaaaatgggaactccccaatcgtcaggtcaatcaaggtcgccagcgcgggagcgacaggagtacagctgaaaaacggcgcgatagccgagaacgcaaacatggttcgcgtggacgttttcgaaaaagacaacaagaactacctagtaccgatatacgtcagcgacttcgcgaaaaacgagttgccgaacaaagcaatctgcgccaataaagacgagaaggaatggatcgaaatgactgaaaagtacaagttcaaattctcactctacccaaacgacctagtcaagatcaaacggaaaaacgaaaaggagttctacgcctactactgctcgacacaccgagggaccgggaacatcaacctactactggtaaacggcgaggcacgaaaggacggcgtggggatcaaaaacaccgagatcttcgagaagtaccaggtcgacgtattagggaacattagcaaagtcaacaaggagaaacgagagggagtcaagtga

SEQ ID NO: 6168 - RNA, 3216 nt, synthetic construct
  misc_feature 1..3216: note = Cas9 variant
  source 1..3216: mol_type = other RNA
atggactatcgcatcgggctcgacatcggaaccaacagcatcggctggagcattatcgaactcaccacagtacaaagcaagctcgacggtaaatacagactcaaggcagtaggcctaatagacgccggcgtcagaatgttcgacagggccgaggtaccaaagacaggagcatccctagccttaccccgccggctggcccggagcagccgaagacgcctaacccgaagaagcgcaaggaaaaaggcaatccggaacctcctcgtgaaagaagacatactgaaccaaatcgagcttgaccacctatatcgaacatccgaactcgtcgatatatggcaaatacgggtcgaaggcctagaacggcgcctcggccgacaagagtgggcccgactcctgatacacctcgggcaaaaacgcggctatagatccacacgcaaggccgaggaaggagccgacaccgaaggacgcgccgtcttgagctcgatcaaagaaaaccaggaaacactgaaacaatacaggacggtcggagaaatgtgggcaaccgacgacaagttcaagggcagagtgaggaactcgaccaacgagttcatcttcaacgtgtccagagacaacctcgaagaagaaattcgcttcctcttccagcaacaacgggaactaggctccatgtacgcatctaagctcctcgaggagtcctacatggaagtctggggtcaccaactaccattcgctagcggagaaagcatactcaaaaacgtcggcacgtgctccctctacgagaaagaaaaacgggcggccaaagcgacctacacattccaatatttcatggcactggacaaactaaacaacgtccgcatcctcccatcaatgcggaccctctccgaagaggaaagaggactcgcactaaaggcgatgttcgagcgtgacaagctccccaagaacccaccaaaattcacatacagccacctacggaaggccataaaactagaagaagatgaaactttccaaacaataagctacgacgtcgagaaaacactggcaaccaacgagagcgcagtattcgtgaacctggccgcttattaccagataaagaaggtatgcgacgagcacaatgaaaattacgactacgtagactacaacacgatcggacacgcccttacagtctacaaaaccgacgaagacataaacaaatacctagcaagcaaaaacaacatcgcaaagagagtatacgccaacgacttcatagactcagtcctaaaacacagttacacgaccttcggccacctaagcctaaaggcccttagccgaatcatcccactaatggaagagggagaggtcttcgcgaaagcgaaggaaaaagccggcttcaaagaagaatcctacctagaaattaaaagtaaactcctgaccaacatacccgacgcaatcaaaaacccagtggtaatgcgaagccttacccaagcgagaaaagtcataaatgcaataataaaacgcatgggagaacagcccgcatcaatacaaatcgagctggcccgagagctatcgaaagacgtcagcgaacgaaagaaaataacaaacggattcgcagaaaacagaagccgaaaccagttcgccataaaaacactggaggaaaaccacatcacgaacatccgcggccaggacatcgtaaagttcaaactctggcaagaacaaggcggccgctgcgcctattcactaaaacccatcaagctagaggaactgatcagcttcctcaagaaagagcgccgctacgaacataacctagacgtggaccacataataccctattcaaaaaccttcgacgacagttacaccaacaaagtcctagtatttagtgacgaaaaccgcaagaaaggggaccaaatcccggcagagtatctcggcatcggcacaaaaaggtgggaaaaatataaagagttcgtcatcacctcgaagttcccagccagcaaaaagaaacgcctcctgaaggaacaacttgtcgaacgagaggagctgttcatgaaagagagacacctaaacgacacgcgctatgcgagccgctactttatgaacttcctgagagaaaacctactgcgaaaagagacggtactccacgaaacccagtgggtgacagccgtggcgggtagagtcacaagccacataagaaaaaggctaggattcggaaaggatcgcgaggaaacgcacttgcaccatgcgctggacgcaataatagtagcgtgcacagacaaatggatgatcgactgcgtcacaaactactacaaatcccgcgaagggggctccatcaaacgcaaggagatcagattcccctcgccgtggaacggcttctggcacgacgtgcaaaccaaactcgcccaactgccacagccagaggtaatcaacgaaagcatatccaaaggcaaccccgatgcggtagattacatgctggtaagccgcatgccccgaaagtccatcacaggagcggcccacaaagaaaccatcagcaaatggggcggatacgacgacaaagggaaagcgctccttgttaaaaaggtcgcactgagcgagctgaaattcaaaaatgacgatttccccatgtacaacaaggaaactgaccccttactttacgaggccatcaaaaaccggtacgtcgaaagcggacgagacgtcaaaagggccttcgcgacaccactctacaaaccgtcaaaaagcggcaaacgaaacgaagtgaaacgcgtaaaggtaatagcggagaagaaagcaatggtcagagaagtcaacggcggaatagcggagaacggagggctagtgagaagcgacatattcctcaaagagaagaaatacgtgatggtacccgtctacaccttcgacaccataaaacagcaactcccgaacaaatatgtcgtaagcggaagaggatacgaacaatggccggaactaaccgccgagcacgtattccagttcagcgtctacccatacgagctagtgcacgtcgggactaacaaaggcgacaacagcttctactacttcgctagcctaaacatatcatcaaacgtcctaaagttcagcgaatgcaacagacccaccaaggactacatagaaatcggcctaaattctataatactcctagaaaaatacgaaatcgacgttctagggcgcataaccggccaaagcaaaaaggggatccgacagagcttcaaaaacaataagagccaaatgaaagaatga

SEQ ID NO: 6169 - RNA, 3219 nt, synthetic construct
  misc_feature 1..3219: note = Cas9 variant
  source 1..3219: mol_type = other RNA
atgcgactaggacttgatataggaaccaactcagtaggctggtggttgtacaaaaccgacggggaggcagcatccgcgcgaatcgtcgaagtcatagacgggggagtccgaatattcagcgacggaagggacccaaaaagcaagacctcactagcggtagataggcgcgttgcccgagccgctcgacgaaggcgcgaccggtacctaagacgacgagccagcctcatgaaactcttagctagaacgggactcatgccggcagatcccgtagaagcaaagaaactagaacgactcgacccgtacgagctacgatccaccggactagacgacgctctgcccctcacccacttcggacgcgcgctattccacctcaaccaacgacggggcttcaaatccaaccgaaaaaccgaccgcggcgacaacgagaatggaaaaatacgagaagccaccgcacggctggatcttgaaatgatgaccagcggggccagaagttacggcgagttccttcatatgcgaagacaacgagccagcgaccccagacatgtaccctccgtccgcacccgcctatccgtagcagcaagaggcggacccgacgccaaagccgaagcaggatacgatttttaccccgaccgacaccatctggaagaagagttccacgcactttgggccgcgcaagcaacacaccaccaagcactaaccgacgacttgagagacctcgtatttgaaaagatattctaccaacgaccactcaaagagccaaagatcggactctgcctcttcacagcagaggagcgaatagccaaagcacaccccctgacccagcgccgagtactcttcgaaacaataaatcaactacgagtgacagcagacggaaggagcacgcgtccactaacactcgaagaaagggatacactcgtacacgccctagacaacaagaaaccaaccaaaagcatgacttcaatgaacatgacactaaaagccctcgcaaaactcttaaaactccgcgacggagaaagattcacactagagaccggggtaagggaaaacataagctgcgacccagtaagggcctgcatggcacacccagccagattcggcccccaatggtcatccctagactgggaagcccaatgggacgtcatatcaagagtacgacaagtacaatcagagggcgagttcatcgaactcacagactggctaatccagggccacgggctcgacgcggaccacgcaaaggccgtaggcaacgcacccctaccagaaggatacgcacgactagggttcagcgcaaccgaaagaatcttagaccaactcaaagcagaagtctgcacatacagcgacgccgtcgccaagtgcggctggcaccacagcgatcaaaggaccggggcctgcctagaagttctgccctactacggggaggtactagaccgtcacgtgatacccggcacctacgacgccaccgacgacgagataacgcgctacggacggatcacaaacccaaccgtccacataggccttaaccaactcagaagactggtaaacaaaatcatagaagtacacgggaagccagaccaaatagtagtagagctggcccgggaacttaaacaaagcgaaccccagaagaaagacgctatgaaacgccttcgaaacacaacagccgacgcaatacgcagaagcgaacaactagaacaacttggacaaccaaacactggccacaacaggatgctactgagactatgggaagacctcggaccagccatagggccacgatgctgcccctacaccgggaaaaccatctcagtcaccatggtattcgacggaagttgcgatgtcgaccacatacttcctttcagtcgaactctagacgactcgttcgctaataggaccttatgccttaaagaagcaaaccgcgaaaaatcagaccgtaccccctgggaagcctggggcggaacagaccaatgggacgacatagctgcgaaccttaaaaacttacccgagaagaaacgcaaaagattcggaccggacgcgatggaatggttcgaaggagaaaacgatttcctcgatcgcgccctcgtcgacacccaatacctcgccaaaatatcacggatgtacctggatacattattcacaaaaggtggacatgtctgggtagtgcccgggcgtatgaccgaaatgttacgccgacattggggcctaaatgcactcctgaacgacaaagaccgcggcgcggtaaaagccaaaaaccgcacagaccatcgccaccacgcaatagacgcagcagtagtggccgccacagattaccgcttaatgcagaaaatatccagggcagcaggccaaggggaaaacgccgggcaatcggccgagctcatcgcgagagatacagacgcgccgtgggagcacttccgagccgacatagcatcgcaactcgagaaaattatagttagtcacagggcagaccacggaagaatagacgtcgaaggccggaagacaggaagggacagtacagccggacgcctccacaacgacaccgcatacggagtaatagacgacctcactgtagccagtagaacacccctaatgtccctaaagcctagcgacatcgctataaccgaaagaggaaagaacataagagaccctcaactccaaaacgctctatacgtagccacaaaaggcaaggaagggaaaatgttcgaacaggctctagtcgacttcgcctcgaaagaaggcccctaccaaggaatacgacgcgtacgacttgtagaaacactacagaaagcagctagagtggaaatcggtaaaacagaaagtggacaaccactaaaagcctacaaaggagacagcaaccactgttacgagctatggaaactgccagacggcaaaatagtaccccaagtagtgaccacctacgaagcccacgcaggctccgcaccgagaccccatccagccgcgaaaagaatactcagagttttcaagaaagacatggtaaaactcactaaagacggcgaggaaatcgtcggctacgtacaaagcatgcatatcaaaaacggactcttcgttgctcaacacctcgaagcaaacgccgacgcccgtaatcgggacaaaaccgacccattcaagttcctacaaatgggagcagggacactggtaaaaacaggacttagacgcgtcctcgtagacgaaatcggacggctaagagaccccggacccccgaaactttga

SEQ ID NO: 6170 - RNA, 3225 nt, synthetic construct
  misc_feature 1..3225: note = Cas9 variant
  source 1..3225: mol_type = other RNA
atgcagaccaaaaatctcccatacacacttggcctagacataggcatggcgagcgtgggcgcagcgctgctcctcccagaccaagaaagaatactcgcccttcatgtaagaacattcgacaaagccgaaaccgcgaaagagggagagagcttaaacaagatcagacgagacagcaggctcactcggaggcgaatccgccgccgagcacaccgtctcgtccgcctggcaagactaatgaaacgcgtaggactgatagccgatgcaaaccccgaagccttcgccctacccggagtcagcccctggcacctccgagccgacggacttgaccgacttctagaaccaaaagaatgggctggcgtactatatcacctcgtaaagcatcgaggcttccaatccaaccgaaagtctgaagccaaagcagacgaaaaagcaggacagatgctttcaggcgtaggacggaaccaagcactcctgaaagaagcaggataccggaccgtgggggaactcgccgcgcgccacgaagacttcaaagaagcgaaacgaaataaaggtggatcatacagccataccttcgcacgggccgacctaaacgccgaactgaacctactattcgaacgccaacgcgcgctgggcagcagattagcctcagccgacttccaagaaaacgtgcgagacctccttatggcgcgacgccccaccctatcaggggcaaacctactcaaaatggtgggcaaatgcaccttcgaaaaatcagaagatcgggccccaaaggcaggataccgggccgaacgcttcgtctggctcgggaagctgaataacctcaaaatcgtaggatccggcgacgcaagaccccttaccgacgcagaacatcgaatcgtcatcgacctgccgttcacacaagcaaaactcacattcaaacaggtaagaaaagcattagaactagaaacccaccaaagattcaatctgctgagctacaggcctgacccaaaaggcaaagacaaagatcctgaggaatcaacattctttgaggccaagagcttccacaccctaagaaaagcgtacgagggagcaggcctaaagaaagaatggcaacgagacgcgctcgacccagaccgactagacgcgctagcctatgcattaacatgctacaaagacgacaccgaatcgcgacaatggctggtagcacaaggaataggcacacccataatcgaagctgtcctggctgagagcttcgacaaattcatccacctaagccagaaagcactgaaagcgatactgccacacatggaagcaggccagcgctacgacgacgctgctaaatccgccggctacgaccactcccaaccggacgcaggcaccggaaaacgagcgaccctacctccacctgacaaagacacgatacgaaacccagttgtctaccgcgcgttaaaccaagcaagaaaactcgtaaacgccatagtcgccgaatacggaccaccggccgcagtgcacatagaactagcgcgcgacctgtcgaaaccaatagatgaacgtcgagatatcgaaaaaggccaaaaagagttccaagcgcttaaggaaaagctcgctgccgcattcgaagaaacattccaccgcaaaccaagcggattagatctactcaaatacagactcttccgagaacaactagaccaatgcccgtactgccaaaaggccctagtagtagaccgcctatttgaacccggctatgcccaaatcgaccacgcactcccctactcccgttcattcgacgacggaatgaataacaaagtcgtggtccatgtagcatgcaaccaagacaaaggcaatcgcacaccatatgagttcctggacggagcaggcgactcagaacggtggcagcgcttcgtcgcatgggtacaaggaaacaaagccatacgacaagccaaacgaaaccgcctactgcgggtaaacttcggcactgatgaagcgaaagagttctccaaacgtaatttaagcgacacccgatatatctgtcgagagttcaaaaggaccatagaaacccaattcgcctggcactccgatgcggaaggtaacgaacgctgcgtcgtgctctcaggccagctaacctctctattacgagcaaggtggggactcataaaagtacgcgaagacggagacctccatcacgcactagacgttgctgttattgcagcggccagccggagcttggtaaagcgaatggccgactactcccgaaggaatgaactcgaaatggtaaggaaccgctacgtagacccagctaccggagaagtcgtcgacgtcgccgcacttagacagatcgaagaccacttcccgaaaccttggcccctcttccgcgaagaactgctagcgcgcctggcccctgaaccgaaactccaactgacgtgcgtctcaagctacgatgagggactacgtgagagtattcgtccaatccgtgtctcacgagccccgacacgtagaggactaggagctgcccatcaagaaaccatacgatccctcagggacggatcccagtcagcaatcaaaacacccctaagagatctcaacctcaaagacctagaaaacatagtagggttcgaaagagacactgcgctaatcgacgcaatccgaacccgactcgaggcattcggaggcgaaggaaagaaagcatttgacgacaaacaaccgccgctacggaaacccagcaaagacccagacaaagctccaatcatcagatccgtcaaactcctagtcacacaaaagtcagggatcccaatccgcggcggaatagcaaacaacggagcaatgctacgaagcgacatcttcacgaaagccggaaaattctatgcagtaccgatatatgtagcagacgcagtgagaggcgaactaccccacagagccgtagcacaagcgaagcccgaattagaatggccaatgatggacgagtcgtaccagtttctgttctcactacatccaaacgactggatgacgatcagacttaagaacgaggtcagggaaggttactacgccggactcgaccgcgccaccggaaacatcagcctgtggctgcacgaccgaaaccaaaacgtcggccaaaaaggcctcctgaccggaaacggtatcaaaacagccctagcagtagaaaaataccacgtcgatctactcggcaaactgcaccgcgtacataaagaggaacgacagccgatacacatcaagccagggaagcgctga

SEQ ID NO: 6171 - RNA, 3234 nt, synthetic construct
  misc_feature 1..3234: note = Cas9 variant
  source 1..3234: mol_type = other RNA
atgaaatacagcatcggactagacatcggtatcgcgagcgtgggctgggccgtaataaatgaagacatcgaacgaatcgaggacctcggagtcagaatattcgacgtagcggaacaaccgaaaacaggcgcttccctaagtaccccgcggagactagccagatccacacgaaaacgcctacgccggcgacgccaccgcgtcgagcgagtccgcaaattcatgatccagaaaggactgctgacacaggtacagatggaacaactatacgactggaaggacggagacctagacatatggcttgtacgcgtcaatgccctcgagcgcaaactaagcgacagagaatttgcaaggatacttgtacactttgccaagaacagggggttccaatctaaccgcaagtccgaactccaagaagaagacaacggagccgtcctgagcgctgtccaggaaaacaagcggctaatggaggaaaagggataccaaacaatctcagaaatgctattgtatgacgaaaaattcgagggcaccaaacgcaataaaggcggcgagtacactcatgtggtagccaggtctgacctaaagcgggaaatccaactcatcttcgaaaaacaacgcgcctatggccacgcctttgccacaatggagaatgaagacaaattcctccaaatctggtcgtcacaacgacccttcgcgaccaaagacgacatagccaagaaaataggcaactgcaccttcgaacccaaagagaaacgcgccccaaagagcacctacaccttcgaacgcttccgcgcactagacaaactcaaccggctgaggattctatccggcaccagtcccgcccgctccctcacacaagaagagagagacctcatattaaactcactgttcagcaagaaagaagtaaaatacaaagaactacgaaaactcctcaagctcaacgacgaacagcgattcaacgagatcttctacgacccaaacgagaaaattgaaaagaacgaaaaccgaacgttcctgagtctagagagccagtacaaaatccgcaaaatcctccagaaaatagagggcaagagcctcaacgacacgtacagaccggtcgacttagacacgatcgcatacgccctaacagtattcaaggacgaccaagacatacgagattacctccaaaaccaatatgtggcgtcaaacgggaagaaagagctgaacctcgcaaaccggaagtacaacgacgaactcatagaggaactcctccatctctcattcacgaaatttggacacctctcgctaaaagcgctccgcaacatcctacccttcatggaacaaggcatcccctaccaccaagcgtgcgaaaaggccgggtaccaattcaacaagaaagtcaaccgcgagaaacagaaactactcccgcccgtccccgccaaagacattgtcaatcccgtagtgatacgatcactgagccaggtcagaaaggtaataaacgggatcataaagcgatacggcagccccagcagcatctacatcgagctggcgagggagatgggccgtgggtacaaggagagaaaagacttagaaaaacaatacaacaaaaaccgccaaatgaacgagggcgcaaagaaacacatcctggagctacgacccgagttcggcgacccaaggggccacgacatcctcaaatacaaattgtggcaggaacaggactgcagatgcgcctacagcttcaaatccatcccaattaagcaactattcgagatcggatacgccgaagtagaccacatcataccctactctaggtcctttgacgacagcaataacaacaaagtccttgtactagccgcagaaaaccaaaacaagcaaaaccgaacaccgtacgaatggttcggacacgacgaaacaaaatggcaggagttcacctcgctagtcaccacaatgaaagtcagcaaaaagaagaaaagcctcctactaaagaaaaacttcgacgaagaacaggcagaagagttccgcagcaggcacctgaacgacaccagatacataacgagatacatcaaaacatttatcgaagacaacctacaattccggatcgaagaaggcaagaaaacctacgtacacaccgtaaacggcgcctacacatccctaatgcggaaaagatggggattcaacaaaaaccgacaggagaacgccctccaccacgcacttgatgccgtgatcgtggccgtatcgctaccatttaaacacaaagtgcgcgcatacttcaaacgaagagaagaatatgcccacaaccaacttaaacgggagggcgagttcttccccgaaccgtggccaggcttcatccatgagctagagatacggatgatgcaggattccgagaatatcaaacttgcgatggaatccctcaatctaaaaacctacgacgaatccttcataaaagagctcaaaccaattttcgtctcccggatgccgaaacgcgccatgaaaggacagatacacgaagaaaccctgaaacgcgtgcggggacgcacagacgacggatacatccgcacagtcaaaaaggtaaaactagatcaaatcccattcgacaaaaacggcgacttcccgatgttcggaaaagaaaccgatatgaaaacatacgaagccatcaaatcacgatacctcgaatcaggaaaagacaagaagaaagccttcaacaccccactgtataaaccggccaaaaacccagagaacgcccccattatccgatccataaaaatagaagaaaaagcaaaccgggtagtcatgctcgacgagaaaacggcagcggacaacgcgtcgatcgtaagaacggaagtgttcaggcacaaggaaaccggcaactacttcctgactccagtgtacgtcgccgacgtcctagcgaagaaagtaccagaccgcctaatcaccacaaagaaaccgtacagcgaatggcgcaaaataacagacgaatacgagttccttttctctctataccccaacgacctaatcagggtaaaaatgccaaaagaaaaagaaacgaaaacccacaccggcgaaaaacatgtctggcaggaaaacttcatgtacttcaaaggtgtgcatagcgggagcgccggagtacgaatgatagatcacatgaactccttcgaagacgaaatcggcgtccgcaaactcgtcgtattcgaaaagtaccaagtggacccccttggacgaatgaacaaagtgcacggcgaaaagcgccacggcatatga

SEQ ID NO: 6172 - RNA, 3234 nt, synthetic construct
  misc_feature 1..3234: note = Cas9 variant
  source 1..3234: mol_type = other RNA
atgaagtacagcattggactcgacatcggaatcgcgtcggtaggatgggccgtaatcaacgaagacatagaacgaatagaagacctcggagtcagaatctttgacgtcgccgaacaaccgaaaacaggcgctagcctgagcacgcccaggcgactcgcccggagcaccagaaagagacttcgcaggcgacgacacagagtagaacgcgtacgaaagttcatgatacagaaggggctcctaacccaagtacaaatggaacagctatatgattggaaggacggagacttggacatatggctcgtacgcgttaacgccctcgaacgcaaactcagcgaccgagagttcgcgcgaatcctagtgcacttcgccaaaaacagaggcttccaatcaaaccgaaagagcgaactccaagaagaagacaacggcgccgtcctctcggccgtccaggaaaacaagcgcctaatggaagaaaaaggataccaaacaatatcagaaatgctactctacgacgaaaaattcgaaggaacaaaacgaaacaaaggaggcgaatacacgcacgtcgtggcacgatcagacctcaaacgagagatacagctgatattcgaaaaacaaagagcgtacggacacgccttcgcgaccatggagaacgaagacaaatttctgcagatatggagcagccaaagaccattcgcaacaaaagacgacatcgccaagaaaataggaaactgcacattcgagccaaaggagaaacgggccccaaagagcacctatacattcgaacgcttcagagcgcttgacaaactcaaccgactgagaatcttgagtggcacctcgccggcccgttcactcacgcaagaggaaagggaccttatcctaaattcactattctccaagaaagaggtgaagtacaaagaactccgaaaactactgaaactcaacgatgaacagcgcttcaacgaaattttctacgaccccaatgaaaagatcgaaaagaacgagaaccgcacattcctaagcctggaatcgcaatacaaaatccgcaaaatcctacagaaaatcgaaggcaaatcactaaatgacacctaccgaccggtcgatctcgacaccatagcatacgcacttaccgtattcaaagacgaccaagacatccgagactacctccaaaaccaatatgtagccagcaacggcaagaaagaacttaatctagccaaccgaaaatacaacgacgaactaatagaggaactcctccacctatcctttaccaaattcggacacctgtccctgaaagcgctgcgcaacatacttccgtttatggaacaaggaatcccctaccaccaagcctgcgaaaaagccggctaccagttcaataagaaagtcaaccgagagaaacaaaaactgttgcccccagttccagccaaagacatcgtaaaccccgtagtcattcgctcactcagtcaagtaagaaaagtaataaacggaataataaaacgctacgggtcgcccagcagcatttatatcgaactcgcgcgcgaaatgggtcgaggctacaaggaacgcaaagatctagaaaaacagtacaacaagaatagacagatgaacgaaggcgcgaagaaacacatcctcgagctgaggccggagttcggcgatccgcgcgggcatgacatcctcaaatacaaactgtggcaggaacaggactgtaggtgcgcctacagcttcaagagcataccaataaaacaactcttcgaaataggctacgccgaagtggaccacatcatcccctacagccgatcctttgacgacagcaacaacaacaaggtgctcgtccttgcagcagagaaccaaaacaaacaaaaccgaacaccgtacgaatggttcggacacgatgagacgaaatggcaggagttcaccagcctggtcaccaccatgaaagtcagcaaaaagaaaaagagcctcctcctcaagaaaaacttcgacgaagaacaggcagaagagttccgatcccggcatctcaatgacacacgatacataacccgatacataaaaacattcatcgaagataacctgcagttccgcatggaagaaggaaagaaacaatatgtgcacaccgtgaacggagcatacacgtcactcatgcggaagagatggggattcaacaagaaccgacaggaaaatgacctgcaccacgctctcgacgcggtcatagtcgccgtgagcctcccgttcaaacacaaagtgagcgcctacttcaagcgccgagaagaatacgcgcacaaccaactcaaacgagaaggcgagttctttcccgaaccatggcccggtttcatccacgaactggaaatccgcatgatgcaagacagcgaaaatataaaactggccatggaaagtctcaacctaaaaacatacgacgagagcttcataaaagaactaaagccaatcttcgtcagcagaatgccgaagagagctatgcgcggccaaatccacgaagaaacactaaaaagggtaagaggacgcaccgacgacggctacatccgcaccgtcaagaaggtcaaactggaccaaatacccttcgacaagaacggagacttccccatgttcggaaaggaaaccgacatgaagacatacgaagccatcaaaagcaggtatctggaatcaggtaaagacaagaaaaaggccttcaacacaccgctatacaaacctgccaaaaacccagaaaacgcaccaatcatccggtccataaaaatcgaagagaaagctaaccgtgtcgtaatgttggacgaaaagacagcagcagacaacgcgtcaatcgtccgaacagaagtctttcgccataaagaaaccggaaattacttcctcacacccgtctacgtcgcagacgtgttagctaagaaagtccccgacagattgatcacgacaaagaaaccctactccgaatggcgaaaaataacagacgaatacgagttcctgttttcactctacccaaacgacctcatcagagtcaagatgcccaaagaaaaagggacaaagactcacacaggagaaaaacacgtatggcaagaaaatttcatgtacttcaagggcgtccactctgggtcagccggcgtgagaatgatagatcacatgaactccttcgaagacgaaataggagtgcgcaaacttgtcgtcttcgaaaagtaccaagtcgacccactcgggcgaatgaacaaagttcacggcgagaaaagacacggaatctga

SEQ ID NO: 6173 - RNA, 3234 nt, synthetic construct
  misc_feature 1..3234: note = Cas9 variant
  source 1..3234: mol_type = other RNA
atgcagcaaaaaccccaacgatacatcctggggctggacctgggcattgcctcggtcggatgggcatgcgtatgggccgatgaaaatgaacatccgacagggctgctggactgcggcgtccgcacgttcgaacgagcggaagtacccaaaacaggcgacagcctagcactcgcacgaagacaagcgagatcagtaagacgcctgataagacgacgagcgcaccgcctcctacggctaagaagattgctcaagagagaaggagtgctccttagtgcagacttcaacgaaaacggactcgttcgaggactaccaatagacgcatgggcactgagggtagcgggacttgacagaaaactcagcaacaaagaatgggccgcggtattactccacctagttaaacaccgcgggtacctaagtcagagaaagaacgagacgcagagcaaggacaaagaactaggccgtctcctcgcaggggtaaatggcaaccgagaagcacttcagaacagatcggacgaatacagaacagccgcagaactagcggtaaagaaattcgccgcggaaaataacgggagcctgcgaaacaaagggggcgactattcacacacgttcgaccgaaaagacctacaaagagagctccacctactctttgaaagacaacgagctttagacaacccattcacatcctcagaaatggaagccgccgtcgacgagctcctcatgaagcagagatcagcactacaaggggaagcggtcctaaagatgctcggtcgctgcacattcgagcccagtgagtacaaggccgccaaaaacacgtacagcgcagaacggttcgtatggctcacaaagctaaataacctgcgcatacaatacaacggagaggaacgagccctaagcgaagcggagcggagactgctactcgacgaaccataccaaaaagcgaaactcacatacaaacaagtgcgaaccatccttgaactaccagagtcggcggttttcaaagggctcagatacgggcatggagaagacggattaaaagcagaaagcggcacactcatggaaatgaaagcgtaccacgccgtccgcaaagcactcaaagacgcaggactggaaggagagtgggaaaatcggatcaggaacccagaactactagacgcgatcggcacagcgttcagcctgtacaaaacagacgaagacatcagagcgaacctggccgcattccgactaagcgagaacgtcctcgaggcattgttagcaggactaaactttgacaagtttgtccatctaagcctaaaagcactggccaagatactacccctgatggaacaaggaatgagatatgacgaagcgtgcaaggaagcctatggagaccactacggcgcgaaagagcaagaggaccacaggctcctcccacctttcgtagcggacgatataagaaacccagtagtattcagaacactaacacaggcccgcaaaatcgtcaacgaaatagtgcgcaggtacgggtcaccgctacgcgtacacatcgaaacaggcagggaagtgggaaaatcctttagcgacagaaaagaaatcgaaaaacggcaagaagagaatcggaaagagcgagaaagagccgcagcccatttcaaagagctatttcccaacttcgcgggggagccaaaggcacaggacatcctcaagctcaggctgtacgaacaacaacacggaaaatgcctatactcaggaaaagagatagacctacgacgactaccggaaaaaggatacgtagaaatagaccatgccctgccattctcaaggacatgggatgacagcttcaacaacaaagtactcgtactcggaaaggaaaaccaagacaaaagaaacagaacaccatacgaatacctggacggcaaaggaaactcaggcgcatggcgggcattcgccgaacgcgtctcaggatgccgattcccatatgccaagaagcaacggctactgacgcaaaaattggacgagaaaacggaacaaggcttcctcgaacggaacctcaacgacacgagatacgtcgcgagattcctatgccaattcatagaggaaaagatgcacctcgaaggagcagggaagaagagagttttcgcatccaatggacagataaccgcactactgagaggattctgggggctaaagaaagtccgagaagaaaacgatcgccaccacgcgcttgacgcagtagttgttgcctgcagctcagtcagcatgcaacagaaaattacgagacacttcaggtacagggaagaactggagcacatcgaccgagagaccggcgaagtcattcacggatttccacaaccgtgggaatttttccgacaagaagtcatgacacgggtattctcggatgaccccgtgagcgaactcgcggaaaagctggacagccgacccgaagcggttcacgaatttgtgacaccactcttcgtctcccgcgcgccacacagaaaagtcaccggacaaggccacctcgaaacaatccgaagtgcaaaaagactggacgagaaaataagcgtcgtcaaactccccttgacccaattaaaaacaaaagacatagagcgaatagtcgggtaccccaatcgtgaacccgccttgtacgacgcgctcgcggcacggctagcagcgttcaaagacgacccagccaaagcattcagcgagccattctacaaaacaggaaaagacgggaaatgcggcgtccttgtaaaagctgtccgagtagaaaacgtccaaaaatccggcctcctggtgagaaaagatgaatcgggaaaaatgcaaggcgtggcagacaacgcaacgatggtaagggtagacgtgttcggaaagaacgggaaaaattacttagtgccagtctacgcatggcaggtcgagaaaggagaactgcctaacagagcagtggtcgcatacgcggacgaggaagactgggatgagatggacgactccttcgagttcaaattcagcctctacccgaacgatctggtcgaagttgtgaccaaaaaggacaagttcttcggatattacagcggcttcaaccgagccacaggggcaatcaacatcaaggaacacgacctaagcaagagcaaagtcaaaaacggagtatatgaagggatcggcgtcaaaacagcacagtccttccaaaagtaccaagtagacaccctggggaagacgatccgactctgcaaaccagaaaagcgaatggggttcaagaagaaatga

SEQ ID NO: 6174 - RNA, 3237 nt, synthetic construct
  misc_feature 1..3237: note = Cas9 variant
  source 1..3237: mol_type = other RNA
atgcgatacgtcctaggcctcgacatcggaatcgcaagctgcggatgggccgttataaaccaagagaaagaacgtatcgaagacctgggtgtcagaatattcgataaagcagaaaaccccaaagacggcaaatcactcgccgcgccacgacgggacgcccgctcaacccggagaacgctccgccgcaagaaacaccgaatgcaacgaatcaaagtactactcgtcaaacacggattactgtccaaaacagaactcgaccacctatacgaaagcgccaccgaagtggacgtatggaacctccgcctcgacgcactcgaacggaaattataccccaaggagttcgctcgaatcctaatacacctcgcaaaacgcagaggcttcaagagcaaccgaaaagaaacaacgcttagcgaaaatggccaaatcctcgaatccatctcagaaaaccaacagatcatggaaaaacaaaattaccgcaccgtgggcgaaatgatcctaaaggacaagaagtttgagaaccataagcgcaacaaaaacggaacatacgtcggaaccgtcactcgccaacaactgcaagatgaaatccaaatgatatttcacgcacaacgcctatataaaaacgattacgccactgaggagttcgaaagcagctacctggaaatatgggcatctcaacgcccctacgcaagcaaggaccagatagagaagatgatcggctattgcacgctagaaccaaaagaaaaacgcgcccccaaggcgtcctggtccttccaatacttcgtcgcactccagacgatcaataacctccgcctgattagcaaggaccgcatcgaagaactgtcatttgaggaaaagaaacaaatcatgaacctagcccttgagaaaagtatagtgaaatacatagacatacgaaaactgctatcagtccctaacgagttccaattcaacagcctatcttactcagcagatacagtcgacacagccgtcgaatcccgaaagtgcatcgaactcaaagaataccatagcataaacaaggtctacaagcaaatatacggcgaaaacgcgctcaacctcctcccaaaatactacgacaccatcgcgtacgggctaaccatcttcaaggacgacaaggacatcctcgaatacctacaaaacaagtacgtgaacgctaaagggaaacccatctccaacttcgcaaacaaaacttacgacgacacgttcatccaagcccttcttaacctcaacttcacgaaaatgggacacctgagcttcaaagccctgaaaaacatcatcccattcctcgaagaaggcctctcgtacgacaaagcctgtgaaaaggcaggatacaacttcaaagggacgtcctatacggaacaaacaaaatacctacccgttatcccacaaaacaccaaccccgtagtccaccgagcgctcagccaaacccgcaaagtgatcaacgcaataatcaagaaatacggatcccccaacgcgatccacatcgagacagcccgggaactatcaaaaacattccaagaaaggaaagagatagacagcatgtaccaagacaacagcaagaagaacgaacacgcaatccacaaactcaaagagctaggaaacattaaccccagcggaatcaacatcgtcaaatttaagctctggaacgagcaggacggccgctgcatgtactcgggaaaatacatcgaaccacaccgacttttcgaagagggatacaccgaggtcgaccacatactaccctactcacgaagcctcgacgactcctataataacaagacattaacattgggaacagaaaatcaacgcaaaggaaacaagataccttacgaatatatgggaaacacgtcaatatggaacgacttcgaaacgcgcgtccagagcaataagaaaatcaacaaaaagaaacaacaaaaactactactccagcacttcagctacgcccgagaacaagagttcatagaacgcaacctgaacgacacccgctacgcgacaatctacctttcatctctaattcaacaacatctcatcttcagcgagtcgtctcgcaaaaagaaagtgcatacggtctccggaatcatcacctcacacctacgatcacgatggggcttcaacaaagaccgcaaagaaggtcacatccatcatgccctcgacgccgtcatcgtagccgtgacctccgaccacatgatccaacgcgtgacaaaatactacaaactcaaagaactaaaccgcaacctacaagctaaacgtatgccctttccagaaccctgggagggcttccgcctcgaactcgaagcccgaatctcccccaacacccagcaatacctcaaaggccttcgcttcaaaaactacgcagacgtcaacctgtccgaaatcaaaagtatcttcgtctctcggatgccaaagcactcaatcaccggggaactacatcaggaaaccattcgcaaatttattggttacaacgaaaaaggcaaagtcctgacagccattaaaacaaaactagaagacatcccattcgacgccaacggggacttccccatgtacggaaaagaatccgacctatacacctataacgccatcaaagaaagatacctctcacacaagaaagacaaacgcaagtccttccaggaaccactctacaaacccaccaagagtggaggcatagggcccctcataaaaagcatcaagataatggacacaaggaccatcgttaacccggtaaaccagggcaaaggcgtagtctacaacagtaagatagcacgaaccgacgtattcaagaaagaagaaaaatactacctgatcccgatatacaccatcgatctcatgaaaaatatactgccccaaaaagccatcacagccggcaaaggctacgaagactggacaacaatagatccctcgttcaccttcctcttctccttattccccaacgatctaatccagattgtgccgagtaaaaacaagaccataaaggcacgaaccacagtatcgaagaaagaagtactcctgcccagcctcaccggctatttcaaaggcgtccactccggaaccgcgggcataaccgtcgagacacacgacggctccgtaatcgccaacgtcggctcaaaacaacttcttctcatagaaaaataccaagtcgacgtcctcggtaactacaccaaaatcaaagaggagaaaagaatcggactaacgacatataacgataacaagaaaatagccgcatgctga

SEQ ID NO: 6175 - RNA, 3237 nt, synthetic construct
  misc_feature 1..3237: note = Cas9 variant
  source 1..3237: mol_type = other RNA
atgaaacaacagccgcaacgatacatactgggcctggacctaggaatcgcaagcgtaggatgggccctaatcctagtagacgaagaaggcaatccgatcggactccttgactgcggcgtccgcacattcgaacgcgccgaagtgcccaaaaccggcgactcactcgccttagcacgcaggcaagcacgaagcgtcaggcggctcataagacgacgcgcccaccgactcctgagactgcgacgactcctgaaaagagagggagtccttagcgccgccgattttaactcagatgggttacccaacctccccatcgacacctggcaactaagggtggcaggcctggaacgaaaattaaccaaccaagagtgggcagcagttctactacacctcgtcaaacacagaggatacctgtcccaaaggaaaagcgagacacaaaccgaaaacaaagaactcggatgcctcctagcatcggtagcgaaaaactccaaactcttaagcgagaacgcaaaccaatacagaaccccggccgagcttgcagtccgcctcttcgctgaacaaagcgggcacttacgcaataagggcggagactacacacacacgttcaaccgtctcgacctccaaaaggaactccacctcctattcgaacaacaacggacattcgggaaccccttcgcaagcgccgaactccaatccaaagtcgacggtctcctgatgatgcagcgaagcgccctccaaggcgaagccgtgctcaagatgctgggaaagtgcacattcgaaccaagcgaatacaaagccgcgaagcacacctactcagccgaacgcttcatctggctgaccaaactcaacaatctccgcatcctcgagaacggaacagaacgagcactaaacgaggcagagcggaaactcctcctcgacgaaccatacaaaaaggcaaagttaacctacagccaagcccgaaaactgctggatatgtcgcacgacgcaacatttaagggcctacgatacggaaaagactcggaagggctcaacgcggaaaatggagcactgatggagatgaaggcttaccacaagatcagaacggtcctagacaaggccgggctaaagggtgaatgggaaaacaggatccgaaacccggaaatcctcgataagataggcacagccttctccctctacaagaccgacgaagacatccaagctgcgctcgcagacctccggctaccagaaaacgtcctaaacgccctactcgcaggcctaaacttcgacaaatttatccaactcagcctaaaggccctgagcaacattatgccactgatggaacgcggtataaggtacgacgaagcctgcaaagaagtatacggagaccaccgcgcgctcgcagaatcaaagaaccaaatgctactcccgcccatacctgccaacgaaataaggaatcctgtcgtcctacgaaccttaacacaaacacgcaaagtcataaacgccatcatccgtcgctacggaagcccacaacgcgtacacattgaaacagcccgcgaactgggaaagtccttcaaagaccgcaaagaaatcgaaaaacgccaggaggaaaaccgaaaagaacgagaaagagccgccgagcacttcaaagagctattcccacatttcgcaggagagcccaaaggaggagatatactgaaactgcgactctacgaacagcaacaaggcaaatgcctatactcatcaatcccgatcgacctagggcgactaaacgaaaaagggtacgtagaaatcgaccacgccctacccttcagccgcacctgggacgactcattcaacaacaaagtcctagtcctcggatcagaaaaccaaaagaagcgcaaccaaaccccatacgaatacctagacggcgccagcaattcccaacgttggcgagagttccaagcccgcctacaaggctgcagatttagctacgccaagaaacaacgaatacaaacagcaaaactagactcaaagaccgaacaaggctttttagaacgaaacctcaacgacacacggtacatcgcaaggttcctctgcggcttcatagaagaaaatctacaccttcagggagaaggcaaacgaagggtattcgcatccaacggccaaatcacagcacttctccgcggcttgtggggcctcaagaaagtacgcgaggaaaacgaccgacaccacgccctagacgcaatagtcgtagcttgcagcacagtgtcaatgcaacagaaaataacaaaagcgatgcaacgacgcgaaacattagaaacggtagacaccgagacaggcgaagtaaaaacccgtataccccaaccgtgggacttcttcaggcaagaagtcatgatgcgcgtattcagcgacacgccacacgaagaactagccgaaaaattatcaggaagacccgaggcactccacgacttcgtcagccccctcttcgtgtcacgagcccccaatcgcaaaatgacgggacaaggacacttagaaacagtgaaaagcgcaaaacgcctgtccgaaaacataagcgtggtccggaaaccactaactgccctaaaacttaaggacatagaaaacatagtcggctacccagacagggagcccgcactctaccaagcgctcagggaaagactacaggcctacaaagatgacccggtaaaagccttcgcagaaccgttctacaaaccagcgaagaacggaggccaagggagcctcgtaaaagccgttcgtgtaaaggacgtccagaagacaggagtcatggtccggaaggaccgcggaggcatagccaggggaatagcagacaacgccacgatggtacgagtagacgtattcggtaagaaaggcaaaaactacctagtaccggtatacgcttggcaagtagcaaaaggcatcctaccgaaccgagcagtagtggcatacgccgacgaagcagactgggacgagatggacgactcatacgagtttaaattcaccctctatccgaacgatctcgtcgagataatcagcaagaaagggcgaatcttcggatactactcgggcctcaatcgggcaaccggagcaatcgacatcaaagaacacgacctaagcaaagagaaagccaaaaatggcattcaccaaagcgtcggcgtcaagacagtactgagcttccaaaagtaccaagtagatcccctaggaaaagaaatatgcttatgcaaagtagagaaacacccagaactgaacagcaaaaagaagaaatga

SEQ ID NO: 6176 - RNA, 3237 nt, synthetic construct
  misc_feature 1..3237: note = Cas9 variant
  source 1..3237: mol_type = other RNA
atgggatacctcatcggcctcgacataggcataacaagtgtcggctacgccgtgctccaaaccgatttcaaaggaaacccatataaaattcttctgatgaacaccgtcatcttccccgtagccgaagcgccaaaaacaggcgagagccttgccgcacccgtccgccaaaaacgcagcagccgacggacaaaccgacgaactaaattccgtaaattacgagtacagaaacttttcgtccgcttcggtctactcgaatccgcagacgtcgccactttccttaatcaaaaagtacctcatcaagacatatggcaactccggaaggacgcactaaaccgtaagctgagcaaccgagaactcttcgaaatcctttacttcttcgtcggccacagaggcttcaaaagcaaccgacggtcggaagtaaccggcaaacaaccgaaggacaaccaggtggtccttaccagcatccacgaccgaggaaacaccctcaacgacttcgactccctaggcgaaatgatgcaagaactacccgaatttaagaccatcaaacataacaaggcctaccgacccgacaatacaatctacccccttcgcgcatggatcgaacacgaactcagtgccatattctccgtccaacagaaaaacaaccgccaaatcaccgacaacttcattacacaatacctagacatcttccgctcacaacgagacttcgaccaaggccctgccgccccttcgaggttcggcggcaacatgatcgagcgcatggtaggccctgactccctagacgctcatgagaagcgcgccgccaaactcaccaacacgttcttccgcttcaacttcctatccacactcaataacctgaagatccaacttacactcggtgccgagttccacccactcactaccccacaacgcgaaatcgtcctccaagcggcaaccctaaaatccctcaactacaaacaaattcgacacaaactccaactccccgactcagcccgcttcaatctagtaccctaccaatcaaacgaagaccccatcaaaaccgaaagtaaacactacctattcaaacgcaaagccctcacccaaatcgaagcggtcaccgataacccccagctcatcgacaagataggcacaatcctggcatacttcaaaggagacaaaacccggcaagaaaaactatcggctctcaatctaagccgagcagaaatcaagcaacttctccccatcaatcaacccggcttcggcaatctctcactaaaaactatgcacaaaatcctaccctacctagaacaaggccacctctaccacgaagcagcccaacttgccggatacgactttcaaaacaaccttgttgaccgacaataccttcgcgacaacctcaaaaacccagtggttaatcgcgccatcggcaaaaccatcaaagtcgtcaatgcaattattaagaaatacggagacccggacgcaattcacatcgaattaacccgcgaaataaagcactctcatgaggaacgccagaaaattgcccgccaaatgaacactaacatggaccaaaacgacaaagtagcagaacatctacgcgaaaacggcatcccagtcaacggacaaaacatcataaaatccaaactcttctacgagcaaaaagggatagatctctactccggccagcaaataaacgagcaggatctatacacggaagaccactaccaagtcgaccacatcataccctactcaatcagcttcaacgactctttcaccaacaaaaccgttacccgaactagcaacaaccagaacaaggctaatcggctcccactcgagtacctctcagaagagaaacaggatgctttccgcgcccgagtcatgtcgaatatatccaactaccgcaagcgacaaaatttactgaaagaaggaatcaccgaagacaaccgccaacagtggaaaacgcgcaacatcaacgacaccggatacattaaccggctcctctcacaatacctacgcaacaacgtccaattcaccaagaaaagccacaaccccgtcttcaccgtaaacggggcgactacagcctacatacgcaaacgttacggcatcattaaaaaccgccaagccaccgacctgcaccacgccgtagacgcagtcataataggctgtatctccaacacattcgtctcccgactggccaaatacagcgaagcgcaagaggcacggtaccataaacaactctggcaaataacacaataccgccaggaacacaaagacctatccacaatcgaataccaagaactgataaaacaatttcccctgccatggcccgacttcagacacgaactcatggcacgcctaagtaccgacccagccaaaatgatggcccaccacacctgggaacattacaccgacgaagaaataagccagctcaagccggcgttcgtcatcagatccgccaaccacaaagtcaccggctctgcacacgacgacaccatttactctaagaaactatacgaccagcgtggcgtaggactcctccgcacctccctccaaaacttgaaatatgattccaagaaagacgggatcaaaaactacgaacggctcaaagacggatctaactcgctcgtctacgattccctcctccgcgccttgaaagaacatgacggcaacgccaagaaagccttcccggacaaccaactacttataagcacgggtaaccaccaacaaataatcacacacgtcaaaacagtcaaaaagatcacccatcccatcgaagtcaaccgcgacaccgccatagctataggcggtcgtatgatccgcgttgacatcttcaaacaagctaaggcacaaaaactcatcgggatccccgtctacgtgaatgacaccgtcaagcccactctcccaaatcgcgcttgcacgagcggcaaaagatactccgattggtatcagctaacccgccaagaccaatttctatgctcactcgtctcaaacgacctcgtgctagtagaaaccgcatcgcctctcaaagtcacaaacaacatcacaaacgaagaagtccaaaccacacaactcctctgctacttctcgtcattcaatattgcaaacgcacaaattaacttccactccataaacaacgactcatcaatcaaccccatagtcctaaacaaagtcacgtatctcacaaaataccaattggactacctcggaaactacttcccagtcaagcacgagtcacgcaaaacctttaatcgaaaacgatga

SEQ ID NO: 6177 - RNA, 3237 nt, synthetic construct
  misc_feature 1..3237: note = Cas9 variant
  source 1..3237: mol_type = other RNA
atgcacacccgcctcgcactcgacataggcacaacctccataggctggatcctatacgagctagtaaacggacaacccgcctcgatcctcgacggaggtacccgcatcttctccgacggccgagaagcaaagacaggccactccctggccgtcggtcgaagaacagcccgaggcatgcggagacgacgcgaccgctatctacggaggcgggcagcactcatgaaaagactagcagccatcggactaatgcctgaatcacccgaagcagcggcgcaactagcaaccctagacccatacgaactccgcgcgcgaggactagaccacccactccctcccgaacatctcggacgagctctgttccacctcaaccagcgcaggggattcaaaagcaatcggaggaccgacaaaggtaacaatgaaggcggcatgatagcagacgcatccgcaagattagaacaggcaatgatggcggcaggcgcacgcagctacggcgagttcctccacaaaagacgagctgaagcaaccgcacccagagcaacccccgctgtccgcacaagaataaacccgcaccttaccggagaagacggcaaagaacaaccgggatacgacttctacccggatcgcaaacacctggaagacgagttccacagactctgggaagcacaagccaggcacaatccagacctaaccccagcaatgggagacctgctattccaaacaatctttcatcaacgacccctaaaggctcccgcggtcggccgatgtctctttctggacgaaccacgtctacccaaggcccacccattaacccaacaaaggacactatacgaaacagtaaacatgctccgaatcgcgccaccaggccaacccaaaagacgcctctcacgcgtgcaacgcgaccagatagtgcacgcactcaacaatcgaaaaatcctagcctccccaggtaaaaatgtactaacattagccgcgatcggaaaactcctgaagctaagaccaggagaagcctttagcctcgatacagctaaccgagacgccatcgcatgcgaccccgtccgaatgtctctagcctacgaaggaagattcggacctcaatggagcgcattgtccgtggaaagccagtgggaactaatacagcgactaagagatgaccaggacggggccgcacttgtagactggatcatggaccggtacggcttcgacagagaccgggcccgcgccatagcagacgcaccactgccagaaggattcggaaggctcggggaaacggcaaccagagcagtcctcgctgtcctgatcggcggcaccacagaacaagaagtcctaacctactcagaagcagtcgccgcttgcgggtgggaccactcacgtctcgggacgggcgaagtgcttgacaggctgccctactacggccaagtcctagacagacacgtcctccccgggaccgggagacccgaagacgacgaaataaccaggttcggcagaatcaccaatccaacagtacacataggcctaggccaagtcaaacgcctagtaaacaaagtcatagacgcatggggtagaccacacgagatggtggtagaactagccagagacctaaaaatgagcgaggatcagaaacgcaacctcgcaaaggtaaacgcacaaaaccaacgcgccgcagaaatgagaagcgcaaaactaataggagacctgaaaatagaagacaatggacgaaacagaggcatcctgagagtatgggaggaatccgcagccgacgtactccatagatgctgcccatacacaggggcacaaatctctgcaagcatgctattcgacggaagctgcgacattgaccacatactaccctacagcagaaccctagatgacggatttaacaatagagtcatatgcctgaaaagcgccaatcgagagaaacgcaacctaacaccatgggaagcctggggaaacacaccaaagtgggctgcaatagaagcaaacctcaaaaacctgccgcccgcaaaagcctggcgcttcgccccggacgcaatgttacgatatgaaggggaacgggattttacagcccgagccttggttgatacccaatacctcagccgactcgctagagaatacctcgagtgtctctacgccgaagacatagaccctggaccgcactcgggaaagaaaccaagacggccaatatgggtcgtaaccggaaaactaacagagctactgcgcagacactggggactaaacagcctacttcccgacgcccaccgaggaaccgctaaagccaaaaatcgcttagaccacagacaccacatgatagacgcagcagtagtgggcgccaccgaccacgcgaccgtgcaacgcatagctaacatggcgaaagggaacgtcgaaaacggactcgaagacttagccggcacaatactaccaccgtggcccggcctacgggacgacctaaaagcgcgactcgaaaggacaatcgtttcacacagaggaaatcacggcgcaatagacccggcagcccggaagcaaggacgcgacacaaccagcggtcagttacataacgacaccgcatatggactcacgggggaaaccctaaaaggcgtacctctcgtcgtgaatcgcaaaccaatcgacatgttgaccccggcaatgatagacaagatcagggatccgcatctaagccgatggctcacagcggtcacgaaaggcaaagaagggaaggactttaaagcggccgtagaagcattccgtgcccacccaggaccatatagaggaataagacgggtccgcctaatagagccggtagaagtgataagaataaaagaccggaacggaagaccatacaagggctacaaaggggacagcaaccaatgctacgaagtatggtgcctaccagaccgcaccctgacacaccacgtcgtaagtacattcgcagcccaccagggccaaacagggaagccccacccagctgccaagcgccttgcacgactatacaaaggcgacatggtaagactagaccgcagcaaattcggcagcgtcatcgcaacagtcgaaaaatttgatcgaaacgggcagctagagctagtcccccataacgaaggaaatgcagaccaaagatacagaaaggacaaatccgacagcgtattcatccgactacgcgcggccaccttcatagcctccggagcacgccgggtaatcgtagacgaaatgggaagaatccgcgacccaggcccaggaaaacactga

SEQ ID NO: 6178 - RNA, 3240 nt, synthetic construct
  misc_feature 1..3240: note = Cas9 variant
  source 1..3240: mol_type = other RNA
atgaaatatggaattggactagactgcggaataaactcagtgggctactgcatcatggaactcaactcagacgacgaacccaaaaggatcgttcgacttaacagtcgcattttcaccgaagcagagaaccccaaagacggctcctcactagccgcccctcgccgcgaggccagaggactccgacggcgaatacgccggcacaagcaccgcctagaacgcatccgagccctactcgtacgcgaaaacatagtcactcaggccgaactagacaacatgttctccggcactctaagcgacatctacgaactccgcaccgcggcactagacgcacccctcaacaacatcgagttcgcccgagtcctaataaacctagcccagcgaagaggattcaaatccaacagaaaaagtgagaaaagtagctccgacaaggaaacgggaaagctactctctgcgattaagaaaaacaaggaatccatcgaagccggcggctaccgaaccgtcggagaaatgctgttcaaagacgaaagatacgccaaacacaaacgaaacaaaggcgaagcgtacctcaacacagtatcccgagatatgatcgaagccgaaatccacgcggtcttcgcatcacagcgtaacttcggaatgcccttcgccaacgaaaagatagaaaacgaatacaccgacatcgcactctctcaacggccattcgacctcggccccggtgaaggcccagaaaactgcaaatccccctacgccgggaaacaaatcaaaaacatgattggacagtgcacattcttcccagaagaaaagagagccgtcaaagcctcctactcattccaactcttcagcctgttacaaggtatcaataacataaccctggtctcatctgacggcaacacattccccctctcgcaggaacaacgaaaaacactcaaagactactgcttcaaaacagccaacgtcacatacgcaagcatccggaaagtcctccagatcccacaggaatacaccttcaaaaacataacctacaccgacgatggcatcgaaaaatcggagaaaaagacaaagttccaacacctgaagccataccacgaaatgaaaaaggtgctaggcagcgcgatccaaaccctgacgccagaggaactcgacgagataggcgaaattttcactttctacaaagacgaaacgataatcatcaaacaactcgaagagaccgagatcgacaaaagcctgtacgacttactgctgcagctaccaacattcgagaaagcaggccacatatcaacaaaggcctgcaaaatgataattcccttcctcgaagaaggcaaaacctacgacaaagcctgtgaatgcgcaggactgaacttcaaagcacacacgaacatgcagaaacagatgcttttgccagccaaatctgacgagctgaacgacgtcgtaaacccagtagtgcgacgcgcgatctcacaaaccatcaaagtcgtcaacgcaatcatcagggaaatgggaacctcgccaacgtatataaacatcgaactggcccgagaactcagcaaaagcaagaaagaaagggatgagataaacaaaaagtacaaactcaaccaggcggaaaacgagcggctcaagaatgaaatcatcgacaatttcaaaattaaaccaaacgggcaggacatcatcaaactcaagctatggcacgagcaagacgacggcatatgcccatacaccggcgtgagaatcaagtatgagaacctcttcgacgatggctacgcggaaatcgatcatataataccctactcactctcattcgacgactcattcaacaacaagatactcacaacagccacccaaaaccgccaaaaaggaaatcgaataccactagagtaccttccggagagcgagaaagacggctttcgagtctgggtcaactcaaatattaggaaccacaggaaacgacaaaacctacttaaagaacacttcacagaagcagacaagaaagagttcaaatccagaaacctcaacgacacccgctacctaaataaactcctactaaactacatcaatgacaacctcctattcaccgacttctacaacggcaagaagaaacacgtaacatccgtcaacggcgcagtaacggcctacatacgcaaacgttggggcataaacaaaaaccgggaagacggcgacctgcaccacgccgtcgacgcggccgttatagcctgcgtgacacaaggcataatcaacagaattacagcatactcagcaaggaatgaagcaccatacgacctaaacaccgaaacgggggaaatcaaagaacgattccctctcccctaccccaacttcaaaaaggaactagacgcccgtactaccatcgaagacgagaaacgactaaaacgcgtactaatgtcattcagcaattacagctatgacgacgtcgaaaaagccaaaccatgcttcgtgtccaggaccccgcaccgtaaagtcaccggagccgcacacgaagagaccataagaagtggcaaggtagagggcttcaccgtcagtaaaaccgaactcacgaaactcaaactaacaaatggcgaaatcgaaggatactatgaacccgaatcagacacgctactctacaacgcattactccaacgcctaaacgagtttggcggagacgcgaaagccgccttcgccgacgagttccataaaccaaaagccgacggaacccccggaccagtcgtgaagaaagtcaaaaccatcaaaagatccagctccaacgtcaaggcacgcaacaaaaacggactcggggtcgctgacaatggctcaatgatacgaatagacgtcttctacgttgaaaacgagggctactacttcgtccccatctacgtggcagacacggtcaaggagatgccgaacgaagcatgcccgttcggcaaagacaagaagaagatcatgaccgacgacgacttcctcttctcactttacccgaacgacctcattaaaatcaccgccaagaaagacatgaaattctccttagccaacaaagagagcgggctcccgaaaaacaaatacgcaaatgaagtactggtatactacagcgctgccgacatatcgaacgcgagcatttcagtaatcatgcacgacaacgcttacaagttcagaggttgcggaatcaaatccctagtgaaactggaaaaatacacggtcgaccccctcggcaacgtctcgaaagtcaaccgagaaaagcggatgtacttcaaatga

SEQ ID NO: 6179 - RNA, 3240 nt, synthetic construct
  misc_feature 1..3240: note = Cas9 variant
  source 1..3240: mol_type = other RNA
atgcgcctaggactagatataggaacctcgagtatcggctggtggctatacgagaccgatggcgccggatcggacgcacgcatcaccggcgtcgtggacggaggcgtgcgcatattcagcgacggccgagaccccaaatcaggcgcatccctagcggtagacagacgcgcagccagagcaatgcgaagaagacgagaccgttacctcaggcgcagagcaaccctcatgaaagtactagccgaaaccggcctgatgcccgcagacccggcagaagccaaagcgctagaagccctagacccgtttgctctaagggccgccggtctagacgagccactacccctaccccacttaggcagagccctctttcacctcaaccaacgacgaggattcaaatcaaaccggaaaactgacagaggcgacaacgagagtggaaaaatcaaagacgccaccgcaagattagatatggaaatgatggctaacggcgcacgaacatacggagagttcctacataaacggcgccaaaaggccaccgacccgaggcacgttccaagcgtgagaactcgactctcaatcgcaaacagaggcggccccgacggcaaagaagaagccgggtacgatttctacccagatcgacgtcacctcgaagaagaatttcacaaactctgggccgcgcagggcgcccaccacccggaactcaccgaaaccctcagagacttattattcgagaaaatattcttccaaagacccctaaaagaacccgaggtgggcctatgcctattctccggacaccacggagtaccaccgaaagacccgcggctaccaaaagcacaccccttaacgcaacggcgagtcctatacgagaccgtcaaccagctacgcgtcaccgcggacgggcgagaagctcgccccctcacccgagaagaacgagaccaagtcatacacgccctggacaacaagaaacccacgaaaagtctctcgtcgatggtattaaaactccccgctctcgcaaaagtgttaaagctaagagacggagaacgtttcacgctcgaaactggtgtcagggacgcaatcgcatgcgaccccttaagagcttccccagcacaccccgatcgcttcggaccccgatggtcaatacttgacgcagacgcccagtgggaggtcataagcagaatccgacgcgtacaatcagacgccgaacatgcagccctcgtagactggctcacagaagcgcacggtcttgacagggctcacgccgaagcaaccgcacacgcacccctcccagacggatatggcagattaggcctcacagccacaacgaggattctctaccagcttaccgcagacgttgtaacctacgctgacgctgtaaaagcctgcggctggcatcactcggacgggcgaacaggagaatgcttcgaccgcttgccgtattacggagaagtcctagaacgacacgttataccaggctcataccatcccgatgacgacgacatcacccgattcgggcgcatcaccaatccgaccgtccatattggactcaaccaactccgacggctagtcaacaggattatagaaacacacggcaaaccacaccaaatcgtagtagagcttgcgagggatctaaagaaaagcgaggaacagaaaagagccgacataaaaagaatcagagacaccaccgaggcagcgaagaaacgctctgaaaaactcgaagaactcgaaattgaagacaacggacgcaaccgaatgctactacgcctgtgggaggacctcaacccggacgacgccatgagaaggttctgtccctacaccggcaccagaatctcggcagccatgatattcgacggctcgtgtgatgtcgaccacattctaccttactcacgcacccttgacgactcattcccgaaccgcaccctctgcctgagagaggccaacagacaaaaacgaaaccaaaccccgtggcaagcctggggcgacaccccacactggcacgcgatcgcagccaacctcaaaaaccttcccgaaaacaaacggtggagattcgcaccagacgctatgacccgattcgaaggtgaaaacgggttcctagaccgcgcactaaaagacacccaatatctcgcccgaatcagccgttcatacttagacacactcttcaccaaagggggccatgtctgggtggtgcccgggcgattcaccgaaatgctacgccgccactggggcctaaactcgctcctaagcgacgccggacgaggagcagtgaaagccaaaaaccggacagaccatcgccaccacgcaatcgacgcggcagttatcgccgccacagatccaggcctactaaaccgaatcagccgcgcggcaggccaaggcgaagctgcgggccaaagtgccgaacttatcgccagagacacgccaccaccctgggagggattccgggacgacctcagagtaagactcgatcgcataatagtgtcccaccgcgccgaccacggacgaatcgaccacgcagcccgaaaacaaggcagagactccaccgcgggccaactccaccaggagaccgcctactcaatcgtcgacgacatccacgtagcctcccgaaccgacctcttaagcctgaaaccagcacaattactagacgaacccgggcgatcgggccaggtaagagacccacaactccgcaaagcactgcgcgtagccaccggcggcaaaaccggcaaagatttcgaaaacgctctgcgatacttcgcctcaaaaccaggaccataccaagctatacggcgagtaagaataatcaagcccttacaggcgcaggcacgcgttcccgtgccagcacaagaccccataaaagcataccaaggcgggagcaatcaccttttcgaaatatggcgcctaccagacggagagattgaagcacaagtcatcacctcgttcgaggcacacaccctggagggcgaaaaacgaccacacccagccgccaaaaggctcctcagagtgcacaaaggagacatggtagcactggaaagagacggacgccgagtagtaggccatgtacagaaaatggatatagcgaacggcctattcatagtaccacacaacgaagcgaacgcggacacccgaaacaacgataagtccgacccattcaagtggatccaaataggagcgcgtccagcaatagcaagcggaataagaagggtgtcagtcgatgaaatagggagactcagagacggcggcaccaggccaatatga

SEQ ID NO: 6180 - RNA, 3240 nt, synthetic construct
  misc_feature 1..3240: note = Cas9 variant
  source 1..3240: mol_type = other RNA
atggacgaagaagctaaaatccagctctcaaaagaaagctacgaagaggaactagaatcactactggaaaagagcggggaagagttccgtgacgtcttcctacaggccaagaaagtatacgacgcaatcctactcagtgacatactcagtacgaagaaacaaaactcaaaagcaaaactcagcctgggcatgatcgagcgctacgactcccacaagaaagacctcgaagaactcaaacaattcgtcaaagccaaccttccagagaaaaccgccatcttctttaaagactccagcaaaaacggctatgcaggatacatagacggcaagacaacacaagaagacttttacaagttcctaaagaaagaactcaacggcatcgcggggtcagaacgatttatggaaaaagtcgaccaagaaaacttcctcctaaaacaacggaccacggcaaacggcgtgatcccacaccaagtacacttaacagagctcaaagctataatcgaacgccaaaagccctactacccattcctggaagaggccagagacaagatgatccgactgctaacattcaggataccatactatgtagggcccctcgctcagggagaagagacctcctcattcgcatggctggaaagaaagaccccggagaaggtaacaccatggaacgcaacagaagtcatagactactcagcatcggccatgaaattcatccaacgcatgataaactacgacacatacctccccaccgaaaaagtactccccaaacactccatcctctatcaaaaatacaccatattcaatgaattaacaaaggtcgcctacaaggacgaacgcggcatcaaacaccaattctcaagcaaagaaaaacgggagatcttcaaagagttgtttcagaaacagcgaaaggtcaccgtcaaaaagctacaacagttcctctccgctaactacaacatcgaagatgccgaaattctaggggtagacaaagccttcaactcatcctacgccacctaccatgacttcctggacctagcaaaaccgaatactgaaagggtcgccgaactcctagaacagcccgaaatgaacgcgatgttcgaggacatcgtcaaaatcctcacgatcttcgaagaccgagagatgatccgcacacaactcaagaaataccagtccgtgcttggagacggctttttcaaaaagctagtgaagaaacattacaccgggtggggacggctctcagagcgactgataaacggaatccgcgacaagaaaacaaacaaaacgatactagactacctcatcgatgatgacgacttcccatacaaccgcaaccgcaatttcatgcaactgatcaacgacgactcactcagctttaaagaggagctagccaacgaactcgccctcgcgggaaaccagagcctgctcgaggtcgtagaagccctgcccggcagccccgcaatcaagaaaggaatctggcaaacgttaaaaatcgtagaggaactaatcgagatcatcggctacaatcctaaaaacatcgtcgtagagatggcccgggaaaaccaaagaacgaaccgatccaaaccaagactgaaagccctagaagaagcgctaaagagcttcgacagcccgctcctaaaagaacagccggtcgacaaccaagccctacaaaaggatcggctttacctttactacctacagaacggcaaggacatgtatacaggagaagcactcgacatcgaccgactttccgaatacgacatagaccacataatcccccgctcgtttatcgtcgacaactcgatcgacaacaaagtcctagtatcaagcaaagagaaccgcctaaagatggacgacgtcccagaccaaaaggtagtgattcgaatgcgcagatactgggaaaaactcctacgggccaacttaatttcagagcggaaattcgcctatctaacgaaactagagctcacaccagaagacaaggcacggtttatacaacggcaactcgtggaaacccggcaaataaccaagcacgtcgcagcaatcctagaccaatacttcaaccaaccggaagagtccaaaaacaagggcatacgtatcataacactgaaaagtagcctggtttcccaattcaggaaaacgttcggcatacacaaagtacgggagataaacaatcaccaccacgcacacgacgcatacctcaacggggtagtcgccatcgcgctcctaaagaaatacccaaagctcgagccggagttcgtctacggaaattataccaaattcaacctcgcaacagaaaacaaggcgaccgccaagaaagaattttacagcaacatcctacgattcttcgaaaaagaagagtattcatacgacgaaaacggcgaaatcttctgggacaaagcgcgacacataccccaaatcaagaaagtcatcagcagccaccaagtaaacatagtaaagaaagtagaggttcaaaccgggggcttctacaaagaaacggttaaccccaaaggcaaacccgacaaactcatacaacgcaaagctggctgggacgtcagcaagtacggagggttcggctccccggtcgtcgcctacgccgttgccttcatatacgagaaaggcaaggcaagaaagaaagctaaagccatcgaaggcatcaccatcatgaaacagtcactctttgaacaagaccccatagggttcctcagcaacaaagggtactcaaatgtcacaaagttcatcaagctctccaaatacaccctctacgaactggagaacggaagacgccgcatggtcgcgtcccacaaagaggcacaaaaagccaactcgtttatcctaccggaaaaacttgtcaccctcctcttctacgcccaacactacgacgagatcgcgcacaaagagtccttcgactacgtcaacgaccacctcagcgagttccgcgaaatactcgaccaagtaatcgacttctccaatcgatacaccatcgcggccaagaacaccgaaaagatcgcagaactattcgaacaaaaccaagaatccacagtccaaagcctctcccagagcttcatcaatctaatgcaactaaacgcaatgggggccccagcagacttcaagttcttcgacgtcatcataccacgaaaacgctaccccagcctcaccgaaatatgggagagcaccataatctaccaatcaatcacgggcctgcgcgagaccaggaccagaatggcgactttgtgggacggtgaacaatga

SEQ ID NO: 6181 - RNA, 3240 nt, synthetic construct
  misc_feature 1..3240: note = Cas9 variant
  source 1..3240: mol_type = other RNA
atggatgaggaagcaaaaattcaactaagcaaagaatcctacgaggaagaactcgaaagcctgctagaaaaatcaggggaagagttccgagacgtattcctgcaagccaagaaagtctacgacgccatactcctctcagacatcctcagcaccaagaaacaaaactccaaagccaaactctcactaggaatgatagaacgctacgactcccacaagaaagacctagaggaactcaaacaattcgtcaaagcgaacctacccgagaaaaccgccatcttcttcaaagattcaagcaaaaacggatacgcaggatacatagatggcaagacgacacaagaagacttctacaaattccttaagaaagaactcaacggaatagctggctccgaacgattcatggaaaaagtggaccaagagaacttcctgctaaaacaacgaacaaccgccaacggggtcattcctcaccaagttcacctaaccgagcttaaagccatcatcgaacgccaaaaaccttactacccatccctggaagaagccagagacaaaatgatccgcctcttaacattcagaatcccatattacgtaggaccactcgcccagggggaagagacatcctccttcgcctggctggaacgaaaaactcccgagaaggtcaccccctggaacgccaccgaggtcatcgactactccgcctcggccatgaaattcatacaacgcatgatcaactacgatacgtacctgccgaccgagaaggtacttccgaagcactccatcctttaccaaaaatataccatattcaatgaactcacgaaagtcgcctacaaagacgaacgaggcatcaagcaccaattctcgtcgaaagagaaacgagaaatcttcaaggaacttttccagaagcaaaggaaggtcacagtcaagaaacttcagcaattcctttccgccaattataacatcgaagacgcggaaatactgggcgtcgacaaagcctttaattcgtcatacgccacataccacgacttcctcgacctggcaaaacctaacaccgaaagagtcgcagaactactcgaacaaccagagatgaacgcaatgtttgaggacatcgtcaaaatcctgaccatcttcgaagaccgagaaatgatccgaacccaactaaagaaataccaatccgtgctgggcgacgggtttttcaaaaagctcgtcaaaaagcactacacaggatggggccgtctatcagaacgactaataaacggcataagagacaagaaaaccaacaaaaccattcttgactacctaatcgacgacgacgactttccatacaaccgcaacaggaacttcatgcaattaatcaacgacgacagcctctcattcaaggaggaactagccaacgaactcgcactagcaggaaaccaatcccttctcgaggtcgtcgaagccctcctcggcagcccggccatcaagaaaggcatttggcaaaccctcaaaatcgtcgaagaactaatagagatcatcggctacaaccccaaaaacatagtcgtggaaatggcacgggagaaccaacgcaccaaccgctcgaaaccacgtctaaaagcccttgaggaggccctcaaatcattcgactccccattactgaaggagcaaccagtggacaatcaagccctccaaaaagaccgcctatacctctactacctacagaacggaaaggacatgtacaccggcgaggctttggacattgatcgcctctcagaatatgacatcgatcacataatcccccgatcatttatagtagacaactcaatcgacaacaaagtcctagtctcctccaaagagaacagactcaaaatggacgacgtgcccgaccagaaggtagtcatccgcatgcgcaggtactgggagaaactgctacgggcgaacctcatctccgaaagaaaattcgcctacctcacgaaactagaactcacccccgaagacaaagcccgtttcattcagcgacagctcgtagagaccagacagatcacaaaacacgtcgccgcaatccttgatcaatactttaatcaacccgaagaatccaagaacaaaggcattcgaatcatcaccctcaaatcatcgctggtaagtcaatttcggaaaaccttcggaatcaacaaggtacgcgagatcaacaatcatcaccacgcgcacgacgcatacctgaacggcgtagtcgctatcgccttactgaagaaataccccaaacttgaaccggagttcgtctacggcaactacaccaaattcaacctggccaccgagaacaaagcgacagcaaagaaagagttctacagcaacatactccgcttcttcgaaaaagaagaatacagctacgacgaaaacggcgaaatcttctgggacaaagccagacacataccacaaatcaagaaagtcatatcctcgcaccaagtcaacatagtaaagaaagtagaagtgcaaaccgggggcttctacaaagagacagtcaacccgaaaggtaaaccggacaaactaatccagagaaaagcgggatgggacgtatcaaagtacggcggattcggctcgccagtagtagcctatgccgtagccttcatatacgagaaaggcaaggcgcgcaagaaggccaaagcgatagagggcatcaccataatgaagcaatccctattcgagcaagacccaattggattcctgagcaacaagggatattccaatgtcaccaaattcatcaagctgtccaagtacactctctacgaactagaaaacgggcgaagacgcatggtcgcaagccacaaagaagcacaaaaagcaaacagcttcatactgcccgaaaaactcgtaaccttgctataccatgcccagcactacgacgaaatcgcccacaaagagtcctttgattacgtaaacgaccatctatcagagttccgagagatcttagaccaagtcatcgacttcagcaaccgttacaccatagccgccaaaaacaccgaaaagatcgcagaactcttcgagcagaaccaggagagcaccgtccaatcgctgtcccaatccttcattaacctcatgcaactcaacgcaatgggcgcgcccgccgacttcaaattcttcgacgtaatcataccacgcaaacggtacccatccctaacagaaatatgggaatcaacaatcatctatcagagcatcactggcttacgggaaacaagaaccagaatggccaccctctgggacggggagcaatga

SEQ ID NO: 6182 - RNA, 3243 nt, synthetic construct
  misc_feature 1..3243: note = Cas9 variant
  source 1..3243: mol_type = other RNA
atgaagacctcattcgccttcgacatcggaacaaactccatagggtggtgcgtactcgccctcgacaacgccaacctgccataccgaatcctcgacgcaggagttcgcatcttctcggatggtcgcgagcccaagtcaggcaccagcctcgcagaaggcaggagactagcccggggcatgtcgagaagacgcgacagatacaaacgcaggcgcaaagccgtgataagaaccctaatagaatacggcttaatgcccgacgaccccgcagcgagacgagccctagtagcagaaacgaacgacaaggcgccaggcaaaatcgcatccgacgtatacgccctaagagccagagcactagacgacaaattacccctacaccacatcggccgtgcactgttccacatcaaccaacgaaggggcttcaaatcaaaccgaaaaaccgacaaacgagacaacgaccaaggaaaaatcgcctccggaataagcaggctgagagacaaactggcgagcgagggaatgcgaaccctaggcgaatatctaaaccaccgacaccaagccggcaattgggtacgagtccgcccctcgcgcgtacccggaaaagacgacaaagaagaagacggatacggcttctacccagagcgagcactacttcaagacgagttcaacgcgatctggaccgcccaagcggcccactacccagacgtcctcacggaagaacggagaacccacctagaaaccataatcttcttccaaagaccactcaaacccgttcaagtaggcaaatgctccttcaaccccggcgaggaacgcttgcccagggcacacccactattccaagagttccggctatacaaagaagtaaacgagctcgaacttgtagacagaaaccaagatcaccacaaactgagcctcgatcaacgagacgccctcatagcccaactcaaaacgcaacgcgaagccgcatacagtgccctaaggaagaccgcccgagcacccctcggaacacggttcaacaaggaaacagaatcgagaaccaagatgaaaggcgacgaagtcgcagccgaactctcagcgaagacaagattcggtcaagcctggataagcatgccacttgaagaaagatggatcatagtcgacaccctgcgacgggttgaggaccccttagagcttacagcatggctagaacaacactacggactagacggagaacacatagatgcaatcctcgctgccaggctccccgaagggtacggcagactgggagaaacagccctaacggaaatcctagtcgaactaaaagccgccgttataagcgaagcagaagccgcacgtcgagccggctacgaccacgcactccttcagcgaggagcgggtttagaagcactacccaaatatcaggaagtcatagcccgacgaatcccacccggcaccggcaatcccgacgacccatacgacgtcgaaaaaggacgcattacaaaccccacagtacatatcggactgaaccagctgcaaaaagtcctcaacgcactgatccgaaggtacggaaaacccgaacaaatagccatcgaactagcacgcgaactcaaactcaacgacgaacaaaaacgagagaaaaacatcgaaattgcccgaaacactagggccgccgagcaacggagcgcaaaactcgtggaattaggcgtcccagacaccggatacaaccgagtgttactaaaactatgggaagaactaaacctacgtgcccccgaaaacagggtatgcatctattgcggggaaccaattaacatagaaacgctattctctagcgccgtagatatagaccacatcctcccctggtccaaaaccctagacgactcccaagcaaaccgtctcgtctgccatgtcgcgtgcaaccgacaaaaagcaaactacgcacccgcagaggtcccccaatggcaggggcggtacgatgacatactagcccgagctaacaccctcccactaaacaaacgatggcgattcggacgcgacgccatgaagaaatttgcagacgaggaaacattcctagcgcgccagctcacagacacccagtacctctccagactcgcccacgcctatatggccgccctatacccagacgaagaaccggacgcacaaggggtactggcccgcaaaaaccacgtgcgagtaatcaccgggcgcatgacagaaatgctacggagacaatggggtcttaacagcctcctcgcagaccacaaccagaaaaataggaacgaccaccgccaccatgcaatcgacgcagccgtggtaggcgttactacacgcgcactcctacaacgaattgcaaccgtcgcagggggaagagaagcgcaagcgctagaagaaacgatcggaaaaatagaaccgccatggccaggctttcgtgacgagttgcaagccgtcatcaaacgaatcgtagtgtcgcacaagccagaccacggcacgctaccaaaaccaggacaaggaggacaaacagcagggcaactacacaacgacaccgcatacggattaacaggagaaaccgactcacgaggaacacccatcgtcgtgcggcgaaaacctttcacatcattaacggaaaaagacctgccatcgatcagagacagacaactcgcacaggctttaggaagcgccattgctggccgatctggtaaggaactccaagctgcactagagcaattccgcgacagagacgactacaaaagcataaggcacgtacgtgttgtcgaacctctcaatgtaatacccatacgagacggaaccggacgcgcgtacaaagcgtataagggcgacgcaaactacaggtacgacgtatgggaactacccaacggcaaatggatgcacgaggtcgtcagcatgttcgatgcgcacgacaggagctggacatccgcagtccacatacaccaccctgcagcgcgacgcgtactgagcctaaagcaaaacgacatggtcgcatacgaccatcctcaagacggacctacaataggacgagttgttaaattctcacaaagcggacagatgacgttcgcaccccacaaagaagccggcgcccttaaggccagagacgcggatccggaagatcgattccgttacttctataaatcaggctcagccatgaaagacatcggcctgcgccaggtccgcgtggacgaaataggccgcgtattcgacccaggtccgcgcgacaaagaagcaagaaacgcccgaaagaagaaatcgacagattga

SEQ ID NO: 6183 - RNA, 3243 nt, synthetic construct
  misc_feature 1..3243: note = Cas9 variant
  source 1..3243: mol_type = other RNA
atggccaagagctttgcgtttgacatgggcaccaactcaatcggctgggccgtactaggactggactccgccggagatccggactccatagaaggagcgggagtacgcatattttcagatggacgtgaaccaaaaagcggagcctctcttgcagaaggccgcaggatcgccagaggcatgtcgcgcaggcgagaaagatataaggcgagaagaaaagcgctcatccgaaccctcggggactacggactaatgcccctagaacgcgcagctcgtcgcgctctcgtggccgagaccaacgatcgtagcttcggattggtagcacaagacgtatatgccctaagagcacgcgcgctggtggaaaaactacccccataccacctgggccgagcactattccacctcaatcaaagacgcggcttcaagtccaaccgcaaaaccgacggcagagacaacgaactcggaatgatcgccacgggtatagcggccctagacgcgcaactgaacggacgcacactcggacaatacctccacgaaatgagaggagcagaccctcgacaaagaggccaagtacgagtaagaccgcacctcgaaattaacgataaaggcagggagatagccgcttacggcttctacccacaacgagcaatgctagaacgcgaatttaacgccatctgggcggcgcaagccccacaccatcccgaactactgtcggaagagagacgcgcccatctattccaagtcatattctatcagagacccctaaaacaaccagacccaggccgttgcagcttcaatcccgcagagccccgactcgccaaagcccacccattattccaacgatttcgactcgtcaaggaaataaacgaactacgcatagtaacaggaagcaactcccaaggcgtccccctaaccctagaacagcgggacatcctactaacactactcagggacaagaaggcatcctccttcaaaacactcctggcaaagataataaaaggccaacccgaggccagattcaataaagcaagtgattcacgcgacaagatgaaaggcgacgaactagcagcaacaatgagcgacaaaaccagattcggtcaagcctggttcgccatgcccgaagccgaacaatggcgaataatcgcaaaactccgcgacatcgacgacccactggaattaaacgcatggctagagagtgaatacggactagcgccggagcgccgtgacgcagtcgcaaacgcacttctaccacagggatacggtcgcctcggagaaacagctttgcgcacaatgctagattacctggaagccgccgtcatcagcgaggcagaggctgcggcccaggcaggctacgaccacgcgctcgcacgcagaggcgcgggcctggaccaacttcccaaatatcaagaagtcctaggccgccgaatacccccaggctcaggagaaccaaacgacccatacgacatcaggatggggagaatttcaaatcccaccgtccacatcgccctaaaccaactgcgaagagtagtcaacgctctaatccgcaagtatggcaaacccgctgaaatcgccatcgaactcgcacgcgacctaaaactatcggaggaacagaagagggaggtcaacgcaactatagcgaaaaacacccgcgacgccgaacgacgagcagtcagactcgcggacgaaggcatagataacacaggacataaccgcgcactgttacgcttctgggaggaactggccgcagaccccctagacagagtatgcgtatactgcggcggaggaatcggggctgcgagcctatttaacggaagcgtggacatcgaccacatacttccctggagcagaacgctggacgacagcagagccaaccgtatactggtacacaacagctgcaacaggttaaaaagaaacttcgcccccttcgaagtgcccgaatggagagagatataccaagatatcctggtgcgtgcggccaagctaccggcaaacaaaagctggcgattcgcccccgatgcaatggatagatttgaaggagaaaaagacttcttagcaaggcaactcaccgatacccaatacctggccaggatggcacacgagtacctggccgcgctatacccagacgaagaaccagacgaatggggcgtgttcgcacgcggcaaccacgttcgggttgtcccaggacggttgaccgagatgttacgtcgagcatggggattaaacgcaatactaagcgatgacaaccgcaaaaaccggaatgaccacagacaccacgcaatagatgcagtcgtagtcggagtgacaacacgagacatgctcaataaaatctcccaagccgcaggccgaggagcggacatgggagcagcagacgcactccgtagattcgacccaccctggcccagcttccaccaagccgtcagagcagccgtagaacgcatcctcgtctcgcacagagcagaccacggaacattacccggcacagatggacaaggctcaacggcagggcagctacacaacgacacagcctacgggctcacaggagaaacccgaaaaggactggccgtcgtagtaaggcgaaaaccctacctctcactcgaaccccgagacatagagacaatacgagacccacagctgcgcgaccacctagccacagaaacatacggcctggcgggtgctgagttcactgcagcacttaagcggctccaacaaacggacaagttctacgcaggaatccgacgagtgcgagtcaccgaagccctgagcgtcatcccaattagagacgctacaggccacgcatataaagcctacaaaggagacgcaaacttcagatatgacgtatgggaactcccaaacggaaaatgggtacccgaagtaatatcaatgtttgacgcgcacgacagaggatgggtaagccaagtccacgccgcaaatccagccgcccgaagagtactttccctacgccaaaacgacatggtagcctatcaacaccctgaacaaggattagtatacgggcgcgtcgtaaagtttggacagtcaggccaaatgacgttcgcagcccaccacgaaggaggatccctaaagagccgagatgccgaccgggacgacccattcaagtacttctataaaagcgccggcacaatgaaagacatcggcctacggcaaataagagtagacgaaatcggaagagtccaggaccccggtccacaggaccgcgacagcaagagagtacgcaaatccgatagatga

SEQ ID NO: 6184 - RNA, 3246 nt, synthetic construct
  misc_feature 1..3246: note = Cas9 variant
  source 1..3246: mol_type = other RNA
atggccgcattcaaaccgaaccccataaattacatactgggcctcgacattggcatagcaagtgtaggctgggcgatggttgaaattgacgaagacgaaaacccgatatgcctcatcgacctaggagtaagggtcttcgagagagctgaagtccctaaaactggcgacagtctagccatggcacgccgcctcgcccgaagtgtaagacgcctaacaagaagaagggcgcacaggctgctccgcgcaagacgcctactaaaacgagagggtgtacttcaagcagccgatttcgacgagaacggtctaatcaaaagcctccccaacactccctggcaactccgcgcggcagcactcgaccgaaaactcacgcccctggaatggagcgcagtccttctccacctcataaagcacaggggctacctaagccaacgcaaaaacgagggcgagaccgcagacaaagagctcggcgcactcctaaaaggcgtggccgacaatgcacatgccctacaaaccggcgacttccgcacccccgccaagttggcactaaacaaattcgaaaaagaatccggccacatcagaaaccaacggggcgactacagccacacattctcccgaaaagacctacaagcagagctgaacctgctattcgagaagcaaaaagagttcggaaacccccatatatccgatggactgaaagaaggcatagaaacccttctaatgacccaaaggcccgcactctccggagacgcagtccagaaaatgctaggccactgcaccttcgaacccacagaaccaaaggcagccaaaaacacctacaccgcagaacgcttcgtttggctcaccaaacttaataacttgcgaatcctggagcaaggcagtgaacaaccactgacagatacccagagagctaaactcatggacgaaccctacaggaagtcgaagctgacttacgcccaagcaaggaaactactaggcctggaagacacagcgttcttcaaagggctgaggtatggcaaagacaacgccgaagcctccaccctcatggaaatgaaagcataccacgctatatcaagagccctcgaaaaagaaggactaaaagacaaaaagtcgcccctaaacctctcacccgaacttcaagatgaaatcggcacagcattcagcctatttaagaccgacgaagacatcacaggccgcctcaaagatcgagtacaaccagaaatcctcgaagccctcctaaaacacatatcattcgacaaattcgtccaaatatccctgaaagcactccgcagaatagtacccctaatggagcaagggaagcgatacaacgaagcatgcgcagaaatatacggcgaccattatgggaagaaaaacaccgaggagaaaatctatctcccacccatacccgcagacgaaatacgcaatccagtagtcctacgcgcactctcccaggcaagaaaggtgataaatggtgtcgtcagacgatacggctcccccgcacgcatccacatagaaacagcccgagaagtcggaaagagcttcaaagacagaaaggaaatagaaaagcgccaagaagaaaacaggaaagaccgggaaaaagcagccgccaagttccaagaatacttcccaaacttcgtaggtgaaccaaaaagtaaagatatcctcaaattacgcctttacgagcaacaacacgggaagtgcctctactcaggaaaagaaatcaacctaggcagactcaatgaaaagggatacgtggaaatcgaccacgccctccccttcagccgaacgtgggacgactcgttcaacaacaaggtcctcgtactcggtagcgagaaccaaaacaagggaaatcaaaccccatacgaatatttcaacggaaaagacaacagccgtgagtggcaagagttcaaggctcgagtagagacaagccgcttcccacgttccaagaaacagcgcatccttctacaaaaattcgacgaggacggattcaaagagcgcaatctgaacgacaccagatacgtaaaccgattcctgtgccagttcgtcgccgatcgcatgcgccttaccggtaaaggaaagaaaagggtctttgcatccaacggccagatcactaacctcctccgcggattctggggactgcgcaaagtccgagctgaaaacgataggcaccacgcactagacgcagtcgttgtcgcatgctccacggtcgccatgcaacaaaagatcacaagattcgtaagatacaaagaaatgaacgccttcgatggaaaaaccattgacaaagagacgggcgaggtcctccaccagaaaacccacttcccgcaaccctgggagttcttcgcacaagaggttatgatccgggtcttcggaaaacccgacgggaaaccagaatttgaagaggcggacacaccagaaaaactccgaactctactagcagaaaagctcagctcacgccctgaagcagtacacgaatacgtcacaccgcttttcgtaagccgcgcaccaaaccgaaaaatgagcggacaaggccacatggaaacagtaaaaagcgcgaaaagactggacgaaggggtcagcgtactacgagtccccttgacgcaactaaaactcaaagacctcgagaaaatggtcaaccgagaacgggagccgaaactatacgaagccttaaaagcgcgcctcgaggcacacaaggacgaccccgcaaaagccttcgcagagcccttctacaaatacgacaaggccgggaatcgtactcaacaagtaaaagcggtccgggtggagcaagtccaaaagaccggcgtatgggtccgcaaccacaacggcatcgcggacaacgcaaccatggtacgcgtcgacgtattcgaaaaaggggacaaatactacctagtaccaatctacagctggcaagtagcaaaaggcatcctacccgatcgagcggtcgtggcatatgccgacgaggaagactggacagtcatcgacgagtccttcaggttcaaattcgtactctactctaacgatctcataaaagtacagctcaaaaaggatagctttttaggctacttcagtggcctcgacagagcaacaggcgcaatatcactgcgagaacacgacctggagaaatcaaaaggaaaagacggaatgcatcgcatcggagtaaagaccgccttaagttttcagaaataccaaatcgacgaaatgggcaaagaaatccggccatgccgtctaaagaaaagacccccagttcgctga

SEQ ID NO: 6185 - RNA, 3246 nt, synthetic construct
  misc_feature 1..3246: note = Cas9 variant
  source 1..3246: mol_type = other RNA
atggcggcctttaaacccaacccaatcaactacatacttggactagatatcggcatagcctcggtcggctgggcaatggtagaaatagacgaagacgaaaaccccatatgcctcatagacctcggagtacgcgtcttcgaacgagcggaagtccccaagacaggagacagcctagccgcagcccgccgcctggcccgaagcgtaagacgactaacccgaagacgtgcgcaccgactactgcgggccaggcgactcttgaaacgcgaaggcgtcctgcaagctgccgactttgacgaaaatggacttatcaagtccctacccaacaccccatggcagctcagatcggccgccctggacagaaaactaaccccgctcgaatggagtgcggttctcctacacctaatcaagcacagaggctacctcagccaacgcaaaaacgaaggagaaaccgcagacaaagaactaggggcgctactcaaaggagtggcggacaacgcccacgctctccagaccggagacttccgaacccccgcagaactcgctctaaacaagttcgaaaaagaatccggccacatacggaaccgacgcggagactactcgcacaccttcagccgcaaggacctccaagccgaactagacctactattcgaaaagcaaaaagagttcggcaaccctcatatctccgacgacctaaaggaaggaatcgaaacactcctcatgacccaaagaccagcactcagcggggatgcagtgcagaaaatgctaggacactgtactttcgaacccaccgaaccaaaagccgcgaaaaatacctacactgcggaaaggttcgtctggctgacaaaactcaacaatttacgcatcctcgaacaaggcagcgaacggccactaaccgataccgaacgggccacactaatggacgagccctaccgaaaatccaaactcacatacgcgcaagcaagaaagctactagaacttgacgacacagcatttttcaaaggactacgttatggaaaggacaacgcagaggcttccacgctaatggaaatgaaggcataccacgcaatatccagagcgctcgaaaaagaaggcctcaaagacaagaaatccccactgaatctatcacccgagctacaagacgaaatcggaacagcattcagcctcttcaaaacggacgaggacatcacgggcagactaaaagacagagtacaacccgaaatcctagaagtactactgaaacatatcagcttcgacaaattcgtacaaatatcgctcaaggcactacgaagaattgtcccactaatggagcaaggcaaacgctacgacgaagcgtgtgcagaaatctacggggaccatgacggaaagaaaaacaccgaggagaaaatatacctacccccaatcccagccgacgaaattcgaaatcccgtggtcctacgcgcgctctcacaagcacggaaagtaataaacgccgtcgtaagacgctacggcagtcccgccagaatccatatcgagacagcaagagaagtcggaaagagcttcaaagaccgcaaagagattgagaaaagacaagaagagaaccgaaaagaccgagaaaaagcggccgcaaaattccgagaatacttccctaacttcgtcggcgagccaaaatcaaaggacatcctaaaactgcgcctatacgaacaacaacatggcaaatgcctgtacagcgggaaggaaatcaacctaggcagactgaatgaaaagggctacgtagaaatcgaccacgccctacccttcagcaggacgtgggacgattccttcaacaacaaagtcctagtactcggaagcgaaaaccaaaacaagggaaaccaaacaccgtacgaatacttcaatggtaaagacaacagccgcgaatggcaagagttcaaagctagagtagaaaccagccgattcccccgaagcaagaaacaaagaatcctcctccagaaatttgacgaagaaggcttcaaagaacgaaacctgaacgatacacggtacgtaaaccgattcctgtgccaattcgtcgccgatcacatgttactaactgggaaaggcaaacgacgagtgttcgccagcaacggacaaatcaccaacctccttcgaggattctggggactaagaaaagtaagggctgaaaataaccgacaccacgccctggacgcagttgtcgtggcctgcagcacagtcgctatgcagcagaaaataacccgattcgtcagatacaaggaaatgaacgcctttgacggaaaaacgattgacaaggaaaccggagaagtgctgcaccagaaaacccactttccacaaccctgggagttcttcgcacaagaagtaatgatcagagtcttcggcaaaccggacggaaaacccgaatttgaggaagccgacacgccagagaagctccgcaccctcctggccgaaaagttaagctcacggcccgaagcagttcacgaatacgtaaccccactatttgtatcgcgcgcaccaaacagaaaaatgagcgggcaagggcacatggaaaccgtaaaaagcgccaaaagactagacgaaggcgtctcggtattacgggtccccctaacacaactgaaactcaaagacctggagaaaatggtgaacagggaaagagaaccgaaactatacgaagccctgaaagcccgcctagaagcacacaaagacgaccccgccaaagccttcgcagaaccattctacaaatacgacaaggccgggaacaggacccaacaagtaaaagcagtaagagtagaacaagtccagaaaacaggagtgtgggtaaggaaccataatggtatagcagacaacgcaacgatggtaagagtggacgtcttcgaaaaagccggcaaatactaccttgtacccatatactcatggcaagtcgccaaaggaatactgcccgaccgtgcggtcgtagcctacgccgatgaagagggatggaccgttatcgacgaatcgttcagatttaagtttgttctatacagcaacgacctcataaaagtgcaattaaagaaagactctttcctgggctatttcagcggactagaccgagccaccggggctatcagtctacgcgagcacgacctagaaaaatccaaaggcaaagacgggatgcatcgcatcggagtaaaaacagccctatcgtttcaaaagtaccaaatcgacgaaatgggcaaggaaatacggctctgcagactcaaaaagagacccccggtacgctga

SEQ ID NO: 6186 - RNA, 3246 nt, synthetic construct
  misc_feature 1..3246: note = Cas9 variant
  source 1..3246: mol_type = other RNA
atgacagccttcaaacccaaccccatcaactacatcctcggactcgacatcggcatcgccagcgtcggctgggccatggtggaaatagacgaagaagaaaaccccataagactcatagacctgggcgtaagggtattcgaaagagccgaagtcccaaaaaccggcgacagcctagcggccgcgcgccggctggcccgcagcgtacgcagactaacacggagacgagcccaccgactactaagggccagaagactcttgaaacgcgaaggcgtcctccaggctgcggacttcgacgaaaacggcctcattaaatcactccccaacactccctggcaactccgagccgcggcactagaccgcaaactcacgcccctcgagtggtccgcagtactactacacctcataaaacaccgaggctacctcagtcaacggaaaaacgaaggagagacagcggacaaagaactcggagcactcctcaaaggggtggcagacaacgcacacgcgttacagacaggagacttccgcaccccggccgaactcgcagtaaacaaattcgaaaaggagtcaggccacatccgcaaccagagaggagactacagccacacattctccagaaaggacctacaagcggagctcgtcctactcttcgaaaaacaaaaggagttcgggaacccccacatcagcgacggactgaaagaaggcatagagacactcctaatggcccagcgtccagcactaagcggcgatgccgtacaaaagatgctcggctactgcaccttcgaaccaacggaacctaaagccgcgaaaaacacctatacagcagagaggttcatatggctgactaagttaaataacctccgaatcctagaacaaggctccgaacgacccctaacagacaccgagcgtgcaacactgatagacatgccttacaaaaacaaactaacctacgccaaagcgcgcgaactcctaggattggacgacacggcattcttcaaagggctccgttatggaaaagataatgcagaaagcgcgacccttatggaaatgaaggcctaccacgcaatacgacgggccctggagaaagagggactcaaggacaagaaatcgcccctctccctatcacccgaattgcaagacgaaatcggcacagcgttctctctattcaaaacagacgaagacatcaccgggcgactaaaaggctgcctacaacctgagatcctagacgccctccttaagcacataaacttcgacaaatttgtacaaatatccctcaaagcactcaggagaatagtccccctgatggaacaaggcaaacggtacgatgaagcgtgcgcggaaacctacggcgaccactacggagagaaaaactcagaagaaatgctgtacctcccgcccatccctgccgacgaaataaggaatccagtcgtcctgcgagctctctcgcaggcccgaaaagtaatcaacggagtcgtccgcagatacggatcgcctgcccgtatccacattgaaaccgcacgagaagtcggaaaatcattcaaagacagaaaagagatagaaaaacgccaagaagaaaacaggaaagaccgagaaaaagcagcagcgaaattccgggagtacttcccaaacttcgtcggcgagccgaaatcaaaagatatcctaaagctacgactatacgagcaacaacacggcaagtgcctttattccggaaaagcaattgacatccgacgactaaacggcaaaggatatgttgaaatcgaccatgcactccccttcagtaggacgtgggacgacagcttcaacaacaaagtcttagtcctggggagcgaaaaccagaacaaaggaaaccgaacgccttacgagtatcttaacggaaaagacaattcccgagagtggcttgaatttaaagctcgcgtcgaaacatcccgattcccccacagcaagaaacaacgcgtactcctccaaaaattcgacgaaaaaggcttcaaagaaagaaacctcaacgacacacgatacgtcaaccgcttcctctgtcagttcgtagccgaccacatgcaactcacaggaaagggcaaacgacgagtcttcgcctcaaacggacaaattacaaacctactccggggattctggggcctacacaaagtcagagccgaaaacgaccgacaccacgctctagacgcagtagtcgtagcctgctcgacagttgccatgcaacagaaaataacctgcttcgtccgttacaaagaaatgaacgcttttgacgggaaaaccgtagacaaagaaaccggcgaagttttacaccagaaaacccacttcccacaaccctgggagttctttgcgcaagaagtaatgatcagggtcttcggcaaaccagacgggaaacccgagttcgaagaagccgatacccccgaaaaactacgcgcactactagccgaaaagctgtcctcccgccccgaagcagtccacgaatacgtaacaccactcttcgtctccagagccccaaatagaaaaatgtcaggagcacacaaggacaccctcagaagtgcgaaaagattcgtcaaacacaatgagaaaatcagcgtaaaaagggtctggctcaccgaaataaagctagcagacctagaaaatatggttaactacaaaaacggccgagaaatcgaactctacgaagcactaaaggcgcgcctcggcgcctacgggggaaacgccaaacaagccttcgacccaaaggacaaccccttttacaagaaaggcggacaactcgtaaaagcagtccgtgttgaaaagactcaagaatccggagtcctccttaacaagaaaaacgcatacaccatagccgacaacggagacatggtaagagtcgacgtcttctgcaaagtcgacaagaaaggcaaaaaccaatacttcatagtacccatatacgcgtggcaagtggccgaaaacattctacccgacatcgattgcaaaggatacagaatcgacgacagctacaccttctgcttttcgctccacaaatacgacctcatcgcgttccaaaaagacgagaaaagcaaggtcgagttcgcctactacatcaactgcgactcctctaacggccgcttttacctggcctggcacgacaaggggagcaaggaacaacaattcagaataagcacccagaacctagtcctaatgcaaaaataccaaatcgacgaattaggcaaagaaataaggccatgccggctcaagaaaaggccacctgtacgttga

SEQ ID NO: 6187 - RNA, 3246 nt, synthetic construct
  misc_feature 1..3246: note = Cas9 variant
  source 1..3246: mol_type = other RNA
atggccgcattcaaacctaaccccataaactacatcctcgggctcgacatcggaatagcaagcgtcggatgggcgatggtcgaaatagacgaagacgaaaacccaatctgtctaatcgacctgggcgtgcgcgtattcgaacgcgccgaagtaccgaaaacgggggacagcctcgcagcggcacgaagactagcgagatcggtacgcagactaacaagaaggagggcacaccgactcctaagggcacggaggctcctgaaacgcgaaggcgtactacaagcggcagacttcgacgagaacgggctaatcaagtcgctgccaaacaccccgtggcaactcagaagcgcagccttggaccgaaaactgacacccctcgaatggtcagcagtcttgctgcacttaattaagcaccgcggctacctaagccagagaaagaacgaaggcgagaccgccgacaaagaactcggagcgctactaaagggagtcgccaacaacgcacacgcgctccagacgggagacttcaggacgcctgccgaactcgcactgaacaagttcgagaaggaatccggccacatacggaaccaacgaggggactacagccacacattcagcagaaaggacctccaagcagaactaatcctactcttcgaaaaacaaaaagagttcggcaacccccatgtctcaggcggcctcaaagaaggaatagaaaccttattaatgacccaacgccccgcactatcaggagacgcagtccagaaaatgctaggccactgcacgttcgagccagctgagccgaaagccgccaaaaatacctacaccgccgaacgattcatatggttaacaaagctaaacaacctccgcatactcgaacaaggatccgaacgccccctcacagacacagaacgagccacgctcatggacgaaccataccgaaaaagcaaattgacctacgcacaagccagaaagctactaggactagaggacacagcattcttcaaaggtctacgctacgggaaagacaatgcagaagcgtcaacgctaatggagatgaaggcgtaccacgcgataagcagagcactagaaaaagaaggcctgaaagacaagaaatccccactcaacctttccccggaactgcaagatgaaatcggaacggcattcagcctatttaaaacagacgaagacatcaccggtcgactcaaagatagaatccaaccagaaatactggaagccttactcaaacacatatccttcgacaaattcgtccaaataagcctgaaggccctcagacgaatcgtcccactgatggagcaagggaagaggtacgacgaagcgtgcgcagaaatttacggggaccactacggaaagaaaaacaccgaggagaaaatctacctaccgcctataccagcagacgaaatccgaaacccagtcgtgctcagagcgctatcccaagcccgcaaagtaatcaacggggtggtcagacgctacgggagccccgcccgaatacacatcgaaacagcgagggaagtaggaaaatcatttaaagacagaaaggaaatagagaaaagacaggaggagaacagaaaagacagagaaaaagcggcggctaaattccgcgagtacttccccaactttgtaggcgaacccaagtcaaaagacatcctaaagctccgcctatacgaacaacagcacggaaaatgtctctattccggaaaagagataaacctcggccgcctcaacgaaaaaggctacgtcgaaatcgaccacgcgttaccgtttagccggacgtgggacgacagctttaacaacaaagtgctggtcctcggaagcgaaaaccaaaacaaagggaaccaaacgccatacgaatactttaacggtaaagacaacagtagagaatggcaagagttcaaggccagggtcgaaacatcccgcttccccaggtccaagaaacaaagaatactactccaaaaattcgacgaggacggcttcaaagagcgtaacctcaacgacactagatacgtcaacagattcctgtgccaattcgtagcggaccggatgcgcctgacaggaaaaggcaagaaacgagtcttcgcatccaacggacaaattacaaacctactcagaggcttctggggactaaggaaagtacgcgcggagaatgaccgtcaccacgctcttgatgcagtggtcgtcgcctgcagcaccgtcgccatgcaacagaaaatcaccagattcgtcaggtacaaagaaatgaacgccttcgatggaaagaccatcgataaagaaacgggtgaagtcctacatcagaaaacccacttcccgcaaccatgggagttctttgcacaagaagtaatgataagggtatttggaaagccagacggaaagcccgagttcgaagaagctgacaccccagaaaaactacggacactactagcagaaaaactcagctccagaccagaagccgtccacgaatacgtaacacccctattcgtctccagagctcctaaccgaaaaatgtcaggccaaggccacatggaaacggtcaaaagcgcgaaacgactggacgaaggagtctccgtgctccgagtcccactgacacaactcaaactcaaagacctagagaaaatggtcaacagggaacgagaaccgaagctgtacgaagccctcaaagcacgcctcgaagcacacaaggacgaccccgccaaggcgttcgcagaacccttctacaaatacgacaaagcaggcaaccgaactcaacaagtcaaagccgtgcgtgtagaacaagtccagaaaacaggggtctgggtcagaaaccacaatggcatcgccgacaacgcaaccatggtacgcgtcgacgtcttcgaaaaagctggcaaatactacctagtccccatctacagctggcaagtcgcaaagggcatactacctgacagagcggtcgtcgcatacgccgacgaagaaggctggacagtaatcgacgagagcttcagattcaaattcgtcctgtactcgaacgacctcattaaagtccaactcaaaaaggacagcttcctaggctacttcagcgggctcgaccgggccacaggagccattagcttaagagaacacgatctcgaaaagagtaagggaaaagacggtatgcacaggataggagtgaaaactgctctgagcttccaaaaatatcaaatagacgaaatgggcaaagaaatacgcctctgtcgcctcaagaaacgaccacccgtccgttga

SEQ ID NO: 6188 - RNA, 3246 nt, synthetic construct
  misc_feature 1..3246: note = Cas9 variant
  source 1..3246: mol_type = other RNA
atgctaaaacgggtcctcggaatagacgtggggataagcagcataggatgggcactcctagagttccaaggtgacatagacaacaaagacctcccgagtggcaagatcctagcgtcaggagtccgggttttcacacaagccgaaaacccaaagaacggggaaagcctggccaagcccagacgcgacgcccgcctagcccgccgccgcacaagacgcagggcacaaagactcaccgacattaaggacctattcttcaaatacaagctagtcaccggcataagtcgcaacaaaataaacagcatatataaaaccgaagaaaacaagaaagatccgtggaccctgcgtaaagaagccctgtacagaaagctagacggagaagagttcgcccgcgtattaacccacatagccaagcaccgcggcttcaaaagtatgagaaagagcgaggaggaaggatccgacacaaaggcaaaagaaacccagagggttttgacggagatcggcaaaaacaaagataccctgaagacgggcatatggcaaacggccggagaaatgatagcgtcacgaccgaaaggggacgcccgccgaaacaagacagatagctataaaaactccatatcgcgagaactcctacaggatgaaaccaaaataatctttgaaaaacagcgagggatgaactcgcaattcacgtccgcggacctcgaaaaggaatactccgatatcgcattccaccaagcgcccatacaatcgatgttaaaaatggtcggcggatgcactttcgaaaaagacgaagaaggcaaacgactaaagcgggcacccaaaaactcctactccgctgaagttttcacagccctcaccaagatcaacaatctggtccttaaaaccaaaacggccaacataaatgaccgattcctaacaaccgaagaacgaaagaaagcactagaactttgccacagcaacgcaaaggtcacattcaaacaactacgaggagaactcggcttaccagaagactggatattcaacaccgtggattacgccaagaagcccaagaagacagcggtcaaggaaaccgaacccgaatccgcctgctttttccagatgcgagggtataacgagatccgaaaaagtgtagggaaagacctatggacagagatatccatgaagaaggaaatcctaaactcaatagtaaccacactcgccacagagaaaagtgacgaagccataaaagctcagctaaagaaaagcgaagtaccggacgaaatagccgaaaaagtcctgggcctaaactttcgcggattcctacacctaagtatcaaagccctagacaaaatcatcccgttcatgatggccggcgacaaatacacggacgcctgcgacaaagcgggatacaaagaacagatctccggcataaagaaaatattcctccgcaaactaaacgacgaagaaaacgagcagatcactaaccccgtcgccaaaagagcgataacgcaattccgcaaagtcataaacgcgataatccgcgagtacggaaaattcgaccaaatgaatatagagctcgcccgcgacctggcaaaatcatacgacgacagaaagaaaatcaaagaaggccaagaagacttcagggcggaaaaagaccgcgccgcacaaagatgcaaagacaacggactagaccccaacagcaaagacaacctcagcaaataccggctatgggagcaacaggacaacggattttgtatctactgcggaaaacccatagaactacaacgactggcggagcaggggtactgcgaagtagaccacatactgccgtactcgcgtagcctcgacgactcccagcacaacaaagtcctagcacacatacacgacaaccaacaaaagaaaaaccaaatccccttcgaacacttcgggggcgacggcccaaaatgggaagagttcgtcggccgcctcaacagccaattcaaaaacctgccaaaaagcaagctgaatcgtctcgtcaaacgtaaattcgacgaaaaagacatggaaggattcaaagaacgcaacatcaacgacacaaggtacatctcgcgattcatcaaaaacttcgtggaaaaccacctcgagttcgcagaatccgctcaaaagcaaaaagttttcgtgagaagcggcagcctgaccgcgttcctgcgccaccaatgggggcttatcaaaaagagggacgaaagcgaccgacaccacgcactagacgcgctcgttaccgcgtgcgccacccaagcgatggtaaagagcaccgcaatcaccgcccagaagatggaatcgtacaactggataaacaaggaaaaaccacggatgccccttccatggctcaactttagagacgacgtccagaaaagcctagacgccgtcttcgtcagcagagctcccagacataaagtgggcggcgccgcccacaaggagacaatccggtcaataagaaaatgcggcgaggagaacctaataatcgaaaagacacccctagttgacatagcgaccaaatccggcataaagctaaaggacattgaaaaactatacaagaaagagcaaaacagaaaactctacgaaactctcaaagagcgtctcgaacaaaacgggaacgaccccgtgaaagcgttcggaaacccagacgaccctgtgcgcatgccgaccaacgatctaacaaaaacgggacccatcataaaatcaataaaactaatcaccaacaagaaatccggtctcaacgtaagagcaggcatcgccgacaacggcgagatagccagactagacgtttacgaacggaaaggcaagttctacctcatacccaactacgtggccgacttcgccaataaagaattgcccaagaaggcaatcaaagccaatacaccagaaaccgaatggccaataatcgaccgcaattacaacttcaagttctcgctgtttaaagatgatctaataagcatcaaacaaaaactcgacagccccgaggagttctattactacaaagggccagacgtctccaccgcctccatcaccgtcgaaagcgtggaccgcaaacggctctgggaggaaaagaagaaaggcaagatagaaaacgtgttccacaccagaataggaaccaagaccttaaaatcttttagaaaattcaacctagacatcctaggaaccaaagcgcccgtggagatcaaaaaggaaacctgggtcggcgtaatccgcaaaaacggagtagccaacaacacagggaacaaagccatgtga

SEQ ID NO: 6189 - RNA, 3249 nt, synthetic construct
  misc_feature 1..3249: note = Cas9 variant
  source 1..3249: mol_type = other RNA
atggcagcgttcaaacccaaccccatgaactacatcctcggactggacatagggatagcaagcgtcggctgggccatggtagaaatcgacaaagaagaaaacccgatacgactcatagatctaggagtcagagtcttcgaacgcgcagaagtacccaaaacaggtgactccctggccatggcacgccggcttgcccgatcagtgcgacgactcacacgacgacgagcacaccgactcctccgggcccgacgcctcctcaaacgcgaaggcgtcctccaagacgctgacttcgacgaaaatggcctcgtcaaaagcctcccaaacacaccctggcaactacgcgcagcagccctagatcgcaagctaacctgcctcgaatggagcgctgtactgctccatctgatcaaacacagaggatatctaagccaacgcaaaaacgaaggcgaaacggctgacaaagaactcggcgcattacttaaaggggtcgccgacaacgcccacgcactccaaacaggagacttccgaactccagcggaactagcactcaacaaattcgaaaaggagtcgggacacatccgcaaccaacgcggcgattactcgcacaccttcagtcggaaagacctccaagcggagctgaacttactcttcgaaaaacaaaaagagttctcgaacccacatgtaagcgactccctcaaggaaggaatagaaacactattaatggcccaacgcccagcgttgagcggcgacgccgtccagaaaatgctcggacactgcaccttcgaaccagccgaaccaaaagcagcaaagaacacatacaccgcagaacgattcatatggctgacaaaactaaacaacctgcgcatactcgaacaagggtccgaaaggccactgactgacaccgaacgcgccacgctcatggacgaaccctaccgcaaaagcaagctaacatacgcacaggcacgcaagctcctgggcctagaagataccgcattcttcaaagggctaaggtacggtaaggacaacgccgaagcccccacgctgatggaaatgaaagcgtaccacgcaatcagccgagcactcgaaaaggaggggctcaaagataagaaaagcccgctaaacttaagcaccgaactgcaagacgaaatcggcacggccttcagcctattcaaaactgacaaagacataacagggcgcctgaaagacagggttcagcctgagatactggaagccctcctgaaacacatctcctttgataaattcgtccaaataagcctcaaagcattgcggagaattgtaccactcatggaacaaggaaaacgctacgacgaggcctgcgccgaaatttatggcgaccactattgtaagaaaaacgctgaagaaaagatctacctaccccctattccagccgatgaaatacgaaacccagtcgtcttaagagcgctatcacaggcacgcaaagtcataaactgcgtagtccgccggtatggctcgcccgcaaggatacacatcgagaccgcccgagaagtaggcaaatcattcaaagaccgaaaagaaatcgagaaacggcaagaggaaaaccggaaggaccgagagaaggcagcggccaagttccgcgaatacttccccaatttcgtcggagaaccaaagagcaaagacatactgaaacttcgcctatacgagcaacaacacggcaagtgcctatacagcggcaaagagataaacctggtccgactcaacgagaaaggatacgtcgaaatcgaccacgccctaccattctcccgaacctgggacgactccttcaacaacaaggtgctagtactgggctcagagaaccaaaacaaaggaaaccaaaccccctacgaatactttaacggaaaagataacagccgcgaatggcaagagttcaaagcaagagtagagacatccagattcccgagatccaagaaacagcgaatattactacaaaaattcgacgaagagggcttcaaagaaagaaacctcaacgacacacgatacgtcaatagattcctatgccagttcgtagcggaccacatacttctaaccggaaaaggaaaacgacgcgtgttcgccagcaacgggcaaataacaaacttgctacgaggattctggggactacgtaaagtgcgcgccgaaaatgaccgccaccatgccttggacgctgtagtcgtggcatgttcgacggtagcgatgcaacagaaaatcacacggtttgtccggtacaaagaaatgaacgcctttgacgggaaaaccatagacaaagagaccggagaggtcctccaccaaaaagcccacttcccccagccatgggaatttttcgcacaggaagtcatgatcagggtattcggcaaacccgatggaaagcccgagttcgaagaagcggacacccccgaaaaactgcggacactcctagcagaaaaattatcaagccgcccggaagcagtacacgaatacgtcaccccgctattcgtcagccgcgcacccaaccgcaaaatgagcggacaaggccacatggaaaccgtcaagtccgcaaagagactagacgaaggaatcagcgtcctccgcgtaccgctcacccaactcaagctcaaaggtctcgagaaaatggtaaaccgggaacgcgaaccaaaactctacgacgccctcaaagcccaacttgaaacccacaaagacaaccccgcgaaagcgttcgcagaaccattctacaaatacgacaaagccggcaaccgaacacagcaggttaaggcagtccgaatcgaacaagtacaaaagaccggtgtatgggtcagaaatcacaatggcatagccgacaacgccacaatggtgcgcgtcgacgtgttcgagaagggcggcaagtactatctagtacccatctacagctggcaagtcgccaagggcatactaccagaccgagccgtcgttgcatttaaagacgaagaggactggacagtgatggacgactccttcgagttccgattcgtcctttacgcaaacgacctaataaagctaaccgcaaagaaaaacgagttcctcggttacttcgtgtccctgaatagagcgaccggcgcgatcgacatcagaacccatgacaccgatagcacgaaaggcaaaaacggcatattccagagcgtaggcgtcaaaaccgccctcagcttccagaaaaaccaaatcgacgaactaggcaaggaaatacgcccctgccggctaaagaagcgacccccagtgcgatga

SEQ ID NO: 6190 - RNA, 3249 nt, synthetic construct
  misc_feature 1..3249: note = Cas9 variant
  source 1..3249: mol_type = other RNA
atggcagcgtttaagcccaacccaataaactacatactcggcctcgacatcgggatcgcatccgtcggctgggcaatggtggagattgacgaggaagaaaaccccattagactgatagacctgggagtaagggtcttcgagcgggcagaggtccccaaaaccggggatagcctagcaatggcacgcagactcgcccgcagcgtacgaagattgaccagacgcagagcgcatagactcctccgcgcgcgacgtctattaaaaagagaaggcgttctccaggccgcagacttcgacgaaaacgggctgatcaaatcactcccaaacaccccatggcaattgagagccgccgcactcgaccgcaaactgacaccactcgagtggtctgcggtactacttcacctaatcaaacaccgcggctacctctcgcaacgcaaaaacgagggggaaacagcagacaaagaactaggcgcgcttctgaagggggtcgccaacaacgcacacgcccttcaaacaggcgatttcagaacccccgctgaactggccctcaacaagttcgaaaaagaaagcggccacatccgcaaccaacggggcgactactcacacaccttttcacgcaaagacctgcaagccgaactcatcctactattcgaaaaacaaaaggagttcggtaacccccacgtatcaggcggcctgaaagagggcattgaaacgctcttgatgacgcaacgacccgccctatccggcgacgccgtccagaaaatgcttggacactgtacgttcgagcccgcggagcccaaagcagccaagaacacatacaccgcagaaagattcatatggttaacgaagctcaataacctgcgcatactcgaacaaggaagcgaacgcccactaaccgacaccgaacgtgcaaccttaatggacgaaccctaccgcaagagcaaacttacgtacgcacaagcccgcaaactcctcgggcttgaagacactgcattcttcaaaggcctacgttacggcaaagacaacgcagaagcatcaactctaatggaaatgaaagcataccacgccatctcacgagccctcgaaaaagaagggctcaaagacaagaaatcgccactcaacctcagctcggaactacaagacgagatagggactgccttctccctcttcaaaaccgacgaagacataacaggccgcctaaaagatcgcgtccaaccggaaatcctggaagccctcctcaagcacatatccttcgacaagtttgtacagatatcgctaaaagcgctccgccggatcgtgccactaatggagcaaggaaaaagatacgacgaagcatgcgctgaaatctacggagaccactatggcaaaaagaacacagaagagaaaatataccttcccccaatccccgcagatgaaatacgaaacccagttgtactccgggcactcagccaagcacgcaaagtaatcaacggagtcgtcagacgctacggaagcccagcacggatccacatagaaacagcacgcgaagtcggaaagtcattcaaggaccggaaagagatagaaaaacgccaagaagaaaaccgcaaagaccgcgaaaaagcggccgcaaaattcagggaatacttccccaacttcgtcggcgaaccgaaatccaaagacatactgaagctaagactctacgagcagcaacacggcaagtgcttgtactcaggcaaggaaataaacctagtccgcctgaacgaaaaaggctacgtagagatcgaccacgccttgcccttctcacgcacatgggacgactcgttcaacaataaagtcctcgtcctgggatccgaaaaccaaaacaaaggaaatcaaaccccctatgaatacttcaacgggaaagacaactccagggaatggcaagagttcaaagcgcgcgtagagacaagccgcttcccacgaagcaagaaacaacgcatattacttcagaaattcgacgaagacggattcaaagaatgcaacctaaacgacacaaggtacgtaaacaggtttctatgccaattcgtcgcagatcacatcctcctgaccgggaagggcaaacgacgagtattcgcatcaaacgggcagatcacaaaccttctaagaggcttctgggggctacgaaaagtgagggccgaaaacgaccgacaccacgccctcgacgccgtagtcgtggcctgcagcaccgtagccatgcaacagaaaataactagattcgtacggtacaaagaaatgaacgccttcgacggaaaaactatcgacaaagaaaccggcaaggtcctgcatcagaaaacacacttcccacaaccctgggaatttttcgcgcaagaagtcatgatacgagtcttcggaaaaccggacggcaagcctgaatttgaagaagctgacacgcccgaaaagctacggacgctattagcggagaagctctcaagcagacccgaagcggttcacgagtacgtaacaccgctattcgtgagccgcgcacccaacagaaaaatgtcaggtcaaggccacatggaaaccgtcaagtcagcaaaacgactagacgagggcgtctcagtactacgagtcccgctgactcaactcaaactcaaagacctcgaaaagatggtgaacagagaacgagaacctaagctctacgaagctctgaaggcgcgcctcgaagcccacaaagacgaccccgccaaagcattcgctgaacccttttacaaatacgacaaggcagggaatcgaacacagcaagtaaaagctgtccgagtcgaacaggttcaaaagacaggggtatgggtccgaaaccataacggaatcgccgacaacgcaacaatggtccgcgtagacgtatttgaaaaaggtgacaagtactacctcgtgcccatatacagctggcaagtagcaaaagggatactccccgaccgcgccgtagtccaaggaaaagacgaggaagactggcaactaatcgacgacagcttcaacttcaagttcagcctacaccctaacgacctagtagaagtgataacgaaaaaggcccgaatgttcggctacttcgccagctgccaccgtgggacggggaacataaacatccgcatacatgacctggaccacaaaatcggtaaaaatggaatactcgaaggaataggagtgaaaacagccctctcattccaaaagtaccaaatcgacgaacttggaaaagagatacgtccgtgcagactgaagaagcgacccccagtgagatga

SEQ ID NO: 6191 - RNA, 3249 nt, synthetic construct
  misc_feature 1..3249: note = Cas9 variant
  source 1..3249: mol_type = other RNA
atggcggcattcaaacccaatcccataaactacatcctcggcctagacataggcatcgcctccgtaggctgggcaatggtcgagattgacgaagacgaaaacccaatctgcctgatagacctaggtgtacgggtcttcgaacgcgcagaagtcccgaaaactggagacagcctcgccatggcccgaagactagcgagatcagtgaggcgactcacaagacgccgcgcacaccggctactacgcgccagacgactactaaaacgagagggagtcctgcaagcagccgacttcgacgaaaacggcctcatcaaatccctcccgaacacaccctggcaactacgagcggccgcactagaccgaaaactcacaccactcgagtggtcagcagtactcctccacctcatcaaacaccggggatacctatcacaacgcaaaaacgagggcgagaccgccgataaagaactaggtgcactcctcaagggggtcgcagacaacgcacacgcccttcagaccggcgacttccgcaccccagccgaattagccctaaacaaattcgagaaggaatctggccacatccgaaaccagcgcggagactactcccacacattcagccgtaaagacctacaggccgaactcatccttctctttgaaaaacaaaaggagttcggaaacccgcacgtcagcggcggcctaaaagaaggtatagaaacgctactcatgacccaacgacccgccttgagcggcgacgcggtacaaaagatgctaggacactgcaccttcgaaccagccgagcccaaagcggccaagaatacctacaccgcagaacgattcatctggctcaccaagttaaacaacctcagaatactcgaacaaggatcagagcgacccctaacggacaccgaacgtgcaacattaatggacgagccctacagaaaatcaaagctaacatacgcacaagcacgcaaactactgggcttagaagacaccgcgttctttaaaggactacgctacggcaaggacaacgccgaggcatcaactctaatggaaatgaaagcataccacgctataagcagagcgctagagaaagagggattaaaagacaagaaatccccactgaacctatcgccggaactacaggacgaaatcgggaccgccttctcgctgttcaaaacggacgaggacataaccgggagactgaaggaccgcatccaaccagaaatactagaagccctcctaaaacacatctcgttcgacaaatttgtccaaatatcattgaaagccttacgccgcatcgtgccactaatggagcaaggcaagcgatacgacgaggcatgcgcagaaatctacggagaccactacggtaagaaaaacacggaagaaaagatctacctaccacccatacccgctgacgaaatacggaacccagtagtactccgagccctatcccaagctagaaaagtaataaacggagtagtcaggagatacggctctcctgctcggatacacatcgagaccgcccgcgaagtcggaaaatccttcaaagacaggaaagaaatcgaaaagcgacaagaagagaataggaaagaccgcgaaaaagcagcagccaaattccgggagtatttccccaacttcgtgggcgagcctaaaagtaaggacatcctgaaactcagactttacgaacaacaacatggaaaatgcctatattccggcaaagaaattaacctcgggagactcaacgaaaaaggctacgtggagatcgaccacgcactccccttcagccgaacatgggacgactccttcaataataaagtcctcgtcctaggatcagaaaaccagaacaaaggcaaccaaaccccctacgaatatttcaacggtaaggacaactcccgagaatggcaagagttcaaagcaagggtagaaaccagccgattcccccgcagcaagaaacaacgcatactccttcaaaaattcgacgaagacggcttcaaagaacgcaacctcaacgacacacgatacgtcaatcgattcctctgccaattcgtggccgaccgaatgcgactgacaggcaaaggtaagaagagggtattcgcctccaatggccaaatcactaacctactccgcggattctggggcctccgaaaagtacgagcagaaaacgaccgccaccacgcactagacgccgtagtcgtagcctgcagcacagttgccatgcaacagaaaatcacgcgtttcgtacgttacaaggaaatgaacgcattcgacggtaagacaatcgacaaagaaacaggagaagtcctccaccagaaaacccatttcccacaaccctgggagttcttcgcacaagaagtaatgatcagggtgttcggaaaaccagacggaaaaccggagttcgaagaagccgacacacctgaaaaacttcgaacgctcctcgcggaaaagctctcatctcggcccgaagccgtccacgaatacgttacacccctcttcgtgtccagagcgcccaacagaaaaatgtcagggcaaggacatatggaaaccgtcaaaagcgcaaagcggctagacgaaggcgtctccgtcctacgcgtaccgctaacccaactcaaattaaaagacttagagaaaatggtgaacagagaacgagaaccaaaactgtacgaagcccttaaagcacgcctcgaagcgcacaaagacgacccagcaaaagcattcgcagaacccttttacaagtatgacaaagcgggcaaccggactcagcaagtcaaggcagtgcgagtggaacaagttcagaaaacaggagtctgggtccggaaccacaacggcattgccgacaatgcaacaatggtcagggtcgacgtattcgaaaaaggggacaaatactacctcgtccccatatactcctggcaagtcgcaaaagggatcctcccagatagggcagttgtccaaggcaaagacgaagaagattggcagctcatagacgacagcttcaatttcaagttctcactccaccccaacgacctcgtcgaagtcatcacaaagaaagcacgaatgttcgggtacttcgcatcctgccacagagggactgggaacatcaacatcagaatccacgacctcgaccacaaaatcgggaaaaacggaatcctagaaggaataggagtcaaaacagccctgagtttccaaaaataccagatcgacgaactcggtgaagaaataaggccatgtcgactaaagaaacggccacccgtgcgatga

SEQ ID NO: 6192 - RNA, 3249 nt, synthetic construct
  misc_feature 1..3249: note = Cas9 variant
  source 1..3249: mol_type = other RNA
atggcggcgttcaaaccaaacccaatcaactacatcttagggttagacatcggaatagcaagcgtcggatgggcaatggtggaaatcgacgaagacgaaaaccccatctgcctaatagacctgggagttcgggttttcgagcgagcggaagtccccaagaccggagacagcctcgcaatggcccgccgactcgcgcgcagcgtacgacgactaaccaggcgcagagcccaccgactactccgcgcacgtcggctcctcaagcgagagggagtcctccaagcggcagacttcgacgagaacggcctgataaaaagccttccgaacacaccgtggcagctacgcgcagcagccctcgaccgcaagctaaccccgctagagtggtccgccgtcctcctgcacctaatcaaacaccgagggtatctaagccaaagaaagaatgaaggcgaaaccgcggacaaggaactaggcgccttactcaagggcgtagcagacaacgcccacgccctacaaacgggcgatttcagaacccccgccgagctagcgctcaacaaattcgaaaaagagagcggacacatcaggaaccagaggggcgattactcacacaccttctcaagaaaagacctccaagccgaactcatactactattcgaaaaacaaaaggagttcggaaacccccacgtctcaggaggcttaaaggaagggatagaaaccctactaatgacacagagacccgcgctaagtggcgacgcagtccagaagatgctcggccattgcacctttgaacccgcagaacccaaagccgccaagaacacctacacggcagaacgcttcatctggctaacaaaactcaataacctacgcatcttggaacaaggaagcgagcgcccactgaccgacacagaaagagcaaccctgatggatgaaccctaccgcaagagcaaactgacctacgcgcaagcccgaaagctgctcggacttgaagacacagcgttcttcaaaggtctccggtacggaaaggacaacgctgaagcgagcacactcatggaaatgaaggcataccacgccatctcgcgcgctctcgagaaagaaggattaaaagacaaaaagagccccctaaatctatcaccagaactacaagacgagatcggtaccgccttctcactcttcaaaacggacgaggatataacggggaggctgaaagaccggatacaaccagaaatactcgaagcactgctcaagcacatctccttcgacaaatttgtccaaatatccctcaaggccctccgtcgaatcgtaccactcatggaacagggcaaaagatacgacgaggcctgcgcagaaatatacggagaccattacggaaagaaaaacaccgaagagaaaatctacctaccaccgatccctgcagacgaaatccgcaaccccgtcgtactcagggccctctcacaggcacgtaaagtgataaacggcgttgtaagaagatacggaagcccagcacgcatacacatagaaaccgccagagaagtgggcaagagcttcaaagaccgaaaagaaatagaaaaacgacaagaagaaaatcgcaaagaccgagaaaaagccgccgcgaaatttcgcgagtacttccctaacttcgtaggcgaaccaaaaagcaaagacatcttaaaactcaggctatacgaacaacaacacggtaaatgcctttactcaggaaaagaaatcaacctaggcaggctcaacgaaaaaggctacgtggagatagaccacgcgctaccattctcccgcacatgggacgattcattcaacaacaaggtccttgtattaggaagcgagaaccagaataaagggaaccaaacaccttacgaatacttcaacggaaaagacaattcacgcgaatggcaagagtttaaagcccgcgtcgaaacgagtcgattcccccggagtaagaaacaacgaatcctactccaaaaattcgacgaagacggattcaaagaaagaaacttgaacgacaccagatacgtaaaccgcttcctctgccaattcgtcgctgaccgaatgcgactgacgggcaaaggaaagaaacgggtcttcgccagcaacggtcagataacaaacctcctgcgcggtttctggggcctacgaaaagtcagagcggaaaacgacagacaccacgcgctagacgcagtagttgtcgcctgcagcaccgtcgccatgcagcagaaaataacgagatttgtccgatataaggaaatgaacgcattcgatgggaaaaccatcgacaaagaaacaggagaagtccttcaccaaaagacccacttcccccagccatgggagttcttcgcccaagaggtaatgatccgcgtgttcggcaaaccagacggcaaaccagagttcgaggaagcagacaccccggagaaactacgcaccctcctggcagaaaagctctcctcacggccagaagccgtccacgaatacgtaacgcccttatttgtcagccgcgcgccgaaccgcaaaatgagcgggcaaggacacatggagacggtcaaaagcgctaaaaggctcgacgaaggggtctcagtactccgcgtaccgctgacgcagcttaaactgaaagacctagaaaagatggtaaaccgagaacgtgagcccaaactttacgaggcactgaaagcgcgactggaagcacacaaagacgatccggccaaggcattcgccgagccattctacaagtacgacaaggcaggaaaccgcacacagcaagtcaaggccgtaagagtagaacaagtacagaaaaccggcgtatgggtgcgcaaccacaacggaatcgcagataacgccacaatggtaagagtcgacgttttcgaaaaaggggacaagtattatctagtccccatctacagttggcaagtagccaaagggatactccccgaccgggcagtagtgcaaggcaaggacgaggaagactggcaactcatagacgattcattcaactttaagttcagcctccacccgaacgacctagtggaagtcataaccaagaaagccagaatgttcggttacttcgcaagctgccaccgaggaacgggtaacatcaacatacgaatacacgacctcgaccacaaaatcggcaaaaacggaatactagaaggcataggagtgaagaccgccctcagcttccaaaagtaccagatagacgaactaggaaaagaaatacgaccatgtcgattaaagaaacgacccccagtgaggtga

SEQ ID NO: 6193 - RNA, 3249 nt, synthetic construct
  misc_feature 1..3249: note = Cas9 variant
  source 1..3249: mol_type = other RNA
atggcagcgttcaaacccaacccaatcaactacatactagggctcgacataggcatcgccagcgtaggatgggccatggttgaaatcgacgaagacgaaaaccccatctgcctaatcgacctaggcgtacgcgtattcgagagagccgaagtccccaagaccggggactcactagcggccgcccgcagactagcccgcagtgtcaggaggctaacccgaagacgtgcgcatcggctcctaagagccaggcggctccttaagcgagaaggggtactgcaagccgccgacttcgacgaaaatggactcataaagagcctacccaacaccccatggcaattacgcgcagccgccctagaccggaagctaacgcccctagaatggtctgcagtcctactgcacctaataaaacacagaggatacctatcacaacggaaaaacgaaggagaaaccgcagacaaagaactcggagcactcctcaagggagtagccgacaacgcccacgccctccaaaccggggacttccgaacgccagcagaactagccctaaacaaattcgaaaaagaatccggccatataaggaaccagcgcggcgactactcccacaccttttccaggaaagaccttcaagcggaactgattctgctattcgaaaaacaaaaagagttcggcaacccacacgtctcgggcggcctcaaagaaggaatagaaaccttactcatgacacaacgtcccgcactctcaggcgacgcagtgcaaaagatgctcggccactgcacatttgaaccggccgagcccaaagcagcgaaaaacacatacacagccgaacgttttatctggctcacaaaacttaacaacctaagaatactcgaacaaggatccgaacgcccactaacagacacagaacgcgcaaccctaatggacgaaccctaccgcaaaagcaaactgacgtatgcccaggcccgcaagctcctcggcctggaagacaccgccttcttcaaaggcctgcgctacggcaaagacaacgcagaagcgagtaccctaatggaaatgaaagcctaccatgcaatcagcagagctctagaaaaggaagggctcaaggacaagaaaagcccgctgaatctaagccccgaactacaagacgaaataggcacagcctttagtctattcaaaaccgacgaagacataaccggccgactcaaagacagagtccaacctgaaatcctcgaagccctgctgaaacacatcagcttcgacaaattcgtccaaatcagcctcaaagcactccgacgcatcgtgccactgatggaacaaggcaaacgatacgacgaagcatgcgccgaaatatacggagaccattacggaaagaaaaacaccgaggagaaaatatacctccctcctatcccagcggacgaaatcagaaacccagtagttcttcgggcactatcacaggcacgaaaagtcataaatggagtagtaagacgctacggatcaccggcccgaatccacatcgagacagctcgggaagtaggcaaatcgttcaaagaccgtaaagaaatagaaaagcgccaagaagaaaacagaaaagacagagaaaaagctgcagccaaattccgggaatacttcccaaacttcgtgggagaacctaaatcaaaagacatattaaaactaagactgtacgagcaacagcacggtaaatgcctctacagcggaaaggaaatcaatctaggcagactaaacgaaaaaggatacgtcgagatagaccacgctctcccgttctccagaacatgggacgacagctttaacaacaaagtcctagtccttggtagcgaaaatcagaacaagggaaaccagacgccatacgaatacttcaacggcaaagacaactccagagagtggcaagagttcaaggcaagagtagaaacctcccgattcccacgctcaaagaaacagagaatactactccaaaaattcgacgaagacggcttcaaagaacgaaacctaaatgatacacgctacgtgaaccgcttcctctgccaattcgttgccgaccgaatgcggctaacgggaaaagggaagaaaagagtattcgccagcaacggccaaatcaccaacttactgcgcggattctggggattacgaaaagtacgagccgagaacgaccgccaccacgcgttagacgcagtcgttgtggcatgcagcacggtcgccatgcaacaaaagataacccgcttcgtcaggtacaaagagatgaacgcgttcgacggcaaaaccatagacaaagaaaccggagaagtactgcaccagaaaactcacttcccacaaccctgggaatttttcgcacaagaggtcatgataagggtcttcggaaaaccggacggcaaaccggagttcgaagaagccgacacaccagagaagctccgcaccctcctggcagagaagctatcaagtcggcccgaagcagtccacgaatatgtcactcccctatttgtcagccgcgccccaaaccgcaagatgagcggacaaggtcacatggagacagtcaaatccgcaaagcgcctcgacgagggcgtatcggtgctaagagtacccctcacccaactaaaactcaaagatcttgagaaaatggtaaacagagaaagagaacccaaactctatgaagcgctaaaagcccgccttgaagcgcacaaagacgacccagctaaggccttcgcggaaccgttctacaaatacgataaagccggaaacaggacccaacaagtcaaagccgtgagggtagaacaggtacagaaaaccggggtctgggtccggaaccacaacggaatcgccgacaatgccaccatggtaagagtcgacgtattcgaaaaaggcgacaaatactacctcgtccctatctacagctggcaggtagccaaaggcatactccccgaccgcgcagtagtacagggcaaagatgaagaggactggcaactaatagacgactcctttaacttcaaattctccctccaccccaatgacctagtcgaagtcatcactaagaaagcacgaatgttcgggtacttcgcctcctgccaccgcgggaccggaaacataaacatacgcatccacgacctggaccacaaaatagggaaaaacggtatactcgagggcatcggggtcaaaaccgccctgtccttccaaaaataccaaatcgacgaactaggcaaagaaatcaggccgtgccgactaaagaaacgacctcccgtccgttga

SEQ ID NO: 6194 - RNA, 3249 nt, synthetic construct
  misc_feature 1..3249: note = Cas9 variant
  source 1..3249: mol_type = other RNA
atggcagcgttcaaacccaaccccatcaattacatactcggcttagacataggcatagcctcggtcggatgggccatggtcgaaatagacgaggaggaaaaccccatacgactcatcgacctaggggtgcgagtattcgaacgggccgaagtccccaaaacgggcgacagtcttgcaatggccagaagactcgcacggagcgtcagaagactgacccgccgacgtgcccacagactactcagaacaaggcgcctactcaaaagggaaggggtccttcaagcagcaaactttgacgaaaacggcctcataaaaagtctccccaacacactctggcaattgcgggcagcagcactagaccgaaaactgacgcccctcgagtggtccgcagtactcctccatctcataaaacaccgcgggtacctctcccaacgcaaaaacgagggcgagactgccgacaaagaactaggagccctacttaaaggtgtagcaggcaacgctcacgcactacaaaccggagacttccgaacacccgcagaactggcccttaacaagttcgagaaagagagcggacacatccgcaaccaaagaggggactattctcatacattcagccgcaaagacctacaggccgagctaaacctactattcgaaaaacaaaaagagttcgggaacccgcacataagcgacggcctaaaagagggaatagaaaccctactcatgacccagcgaccagcgctttcaggcgacgctgtccagaaaatgctagggcactgcaccttcgaaccaacggaacccaaagcggccaaaaatacatacacgaccgaacgattcatatggctcacaaagctcaacaacctaagaatcctcgagcaagggtccgagcgcccgctaacggacaccgaacgggcaacgctaatggatgagccttacagaaagagcaaactaacctacgcacaagcccgaaaactgctcgaactagacgacattgcatttttcaaaggcctccgctacggcaaagataacgcagaggcctcgacactcatggaaatgaaagcctaccacgcaatctcacgagcactcgaaaaagagggcctaaaagacaagaaaagcccactcaacctatccccagaactccaagacgaaataggcaccgccttcagtcttttcaaaacagacgaagacatcacagggcgcttgaaagaccgcatccaaccagaaatactagaagcgctactgaaacacattaactttgataaattcgtccaaatcagcctcaaggccctccgacgaatcgttcccctcatggagcaaggcaaaagatatgacgaagcatgcgcagaaatttacggagaccactacggaaagaaaaacaccgaagagaaaatagacctcccaccaatacccgccgacgaaatacacaaccctgtcgttttacgcgcactcagtcaagcacggaaagtaatcaacggcgtcgtccgccggtacggatcacccgcgaggattcacatcgaaaccgcacgagaagtgggtaagagcttcaaagaccgaaaagaaatcgaaaaacgccaagaggaaaaccgtaaagacagagaaaaagcagcagcaaagttccgcgaatacttcccaaacttcgtgggcgaacccaagtccaaagacatcctaaagctgcgactctacgaacagcagcacggcaaatgcctatactcaggcaaggaaatcaacctaggcaggctcaatgaaaaagggtacgtcgaaatagatcacgccctacccttctctcgcacctgggacgacagcttcaacaacaaagtgctcgtcctcggttccgaaaaccaaaacaaaggaaaccaaacaccatacgaatacttcaacgggaaagacaactctcgcgaatggcaggagttcaaagctcgcgtagaaacctcccggtttccgcgatcaaagaaacaacggattctcctccagaaattcgacgaggacgggttcaaagagcgaaacctcaacgacactagatacgtcaaccgcttcctctgccagttcgtagccgaccgcatgcggctcacgggcaaaggaaagaaacgagtgttcgcgtccaacggccaaattaccaacctcctacgagggttctggggcctccgaaaagtaagagccgagaacgaccggcaccatgcactcgacgcagtagtcgtcgcatgctccaccgtcgcaatgcaacagaaaataacacgcttcgtacgctacaaagagatgaacgccttcgacggcaaaacgatcgacaaagaaaccggcgaggtgttacatcagaaaacccacttcccccaaccctgggagttcttcgcccaagaagtaatgattcgagtattcggtaaaccagacggcaaaccagagttcgaggaggccgatacacccgaaaaactacgaaccctactcacggaaaaactaagctccaggccagaggccgtacacgaatacgtcacacccctgttcgtcagccgcgcacccaatcgaaaaatgagcggacaaggtcacatggaaaccgtcaaatccgccaaaagactagacgaagggatcagcgtactaagagtcccattaacgcaattaaaactcaaagacctggagaaaatggtcaaccgggaacgggaacccaaactatacgaagccctcaaagcacgtctcgaagcacataaggacgacccggccaaagccttcgccgagcctttctataaatacgacaaagccggcaacaggacccaacaagtaaaagcgatgcgtgtcgaacaagtacaaaagactggtgtgtgggtgcgaaaccacaacggaatagcggacaacgcgaccatggtgagagtcgacgtattcgaaaaaggcgataaatactacctcgtaccgatctatagctggcaagtagccaaaggcatactaccggaccgcgcagtcgtccaaggaaaagatgaggaggactggcaactcatagacgactcatttaacttcaaattttccctgcaccccaacgacctcgtagaggtcataacgaaaaaggccagaatgttcggttacttcgcaagctgccaccgcggcacaggcaacatcaacattcgcatccacgacctcgatcacaaaataggcaaaaacggaatcctagaaggaataggcgtaaagacagcgctctcgttccaaaaatatcaaatagacgaattaggaaaagaaatcagaccgtgtagactaaagaaacgaccacccgtccgctga

SEQ ID NO: 6195 - RNA, 3249 nt, synthetic construct
  misc_feature 1..3249: note = Cas9 variant
  source 1..3249: mol_type = other RNA
atggccgccttcaaacccaacccaataaattacatactcggcctagacatcggcatagcgagcgtcggctgggccatggtcgagatcgacgaagacgaaaacccgatctgcctcatcgacctaggggtacgcgtcttcgaacgggccgaagtacccaaaactggggacagccttgccatggcacgacggctcgctcgctccgtaagacgattaacacgcagacgtgcacaccgattactccgagcgcgacgtctcctgaaacgggaaggcgtactacaagcagcggacttcgacgaaaacggcttaataaaaagccttccgaacacaccctggcaactacgcgcagcagcccttgacagaaaactaacaccccttgaatggtccgcggtgctattacacctgataaaacacaggggatacctatcacagaggaagaacgaaggagaaaccgcagacaaagaactcggcgccctcctcaaaggggtagccgacaacgcacacgcactgcagactggagacttccgaacccccgcagagctagcactaaacaaattcgagaaggaatcaggccacatacggaaccagagaggagattactcccacaccttttcccgcaaagacctccaagcggaactgaacctcctcttcgagaaacaaaaagagttcggaaacccgcacatctcagatggacttaaggagggaatcgagacccttctcatgacccaaagacccgcactatcaggagacgccgtccagaaaatgctaggacactgcaccttcgagccggccgaacccaaggccgccaaaaacacatatacagcagagcgcttcatatggttaactaaactcaataacctccgaatcctagaacaaggctccgaaagaccactcactgacaccgaacgcacgacactcatcgacgagccttacagaaaatcaaaactcacatacgcacaagcaagaaaactcctcgaactcgataacacagcattcttcaaagggctacggtacggaaaagataatgccgaagcgtcgaccctcatggaaatgaaagcctatcatgccatctcacgagccctggaaaaggagggactaaaggacaagaaatcgcccctcaacctatcccccgaactccaagacgagataggaacagcattctcgctattcaaaaccgacgaagacatcacgggccgactaaaagaccgcgtacaacccgagatactggaagcactactgaaacacatctctttcgacaaattcgtgcagataagcctaaaagcactacgaaggatagtaccactaatggaacaaggtaaacgctacgatgaggcttgcgccgaaatctacggcgaccactacggcaaaaagaacacggaagagaaaatcgatctaccaccaatcccagccgatgaaatccgaaatcctgtggtactccgcgcactctcccaagcccgaaaagtcatcaatggcgtcgtccgccgctacggcagcccggcccgcatccacatagaaaccgcccgggaagtcggaaagagctttaaagaccgcaaagaaatcgaaaagcgccaagaagaaaaccgcaaagaccgcgaaaaggccgcaaccaaattccgcgaatacttcccaaacttcgtcggcgaacccaaaagcaaagatatactgaagctgagactatacgaacaacagcatggaaagtgcctatacagcggaaaggaaataaacctaggacgactcaacgaaaagggatacgtagaaatcgatcatgcactcccattcagcagaacatgggacgattcattcaacaacaaagtcctagtactgggctcagaaaaccaaaacaaaggcaatcaaaccccatacgaatacttcaacggaaaagataattcgagagaatggcaagagttcaaagctagagtggaaaccagcagattcccaagatccaaaaagcaaagaatactgcttcagaaattcgacgaagaaggcttcaaggaacgaaacctaaacgacacccgctacgtaaacagattcctgtgccaattcgtggcggaccatatgctcctaaccggcaaaggcaaacgccgcgtattcgcatccaacggacaaatcaccaacctgctacgcggcttctggggcctcaggaaagtgcgagcagagaacgaccgccatcacgcactcgacgccgtcgtcgtagcatgctcgaccgttgctatgcaacagaaaatcacgcgcttcgtacgctataaagaaatgaacgccttcgacggaaaaacaatcgacaaagaaaccggcgaggtcctacaccagaaaacccacttcccccaaccatgggagttcttcgcccaagaagttatgatccgcgtcttcggtaaaccagacggaaagcccgagttcgaagaagccgatacccccgaaaaactacgcacactcctagccgaaaaactaagctcccgccccgaagcagtacacgaatacgtgacacccctcttcgtgtcacgcgccccaaatcgaaaaatgagcggacaaggacacatggagaccgtaaagagcgccaaacgactcgacgaaggcgtctcagtcctccgggtcccactcacgcaactcaaactcaaagacctggaaaagatggtaaaccgcgagcgcgagcccaagctatacgaagcattaaaagcccgcctcgaggcccataaggacgacccggcaaaggcattcgcggagccattctacaaatacgataaagcaggaaacaggacacaacaagtgaaagcggtacgagtggagcaagttcagaaaacgggcgtgtgggtgcgaaaccacaacggcatcgcagacaacgcaaccatggtccgcgtagacgtcttcgagaaaggcgacaagtactacttagtaccaatatacagctggcaagtcgcgaagggcattctaccagacagagcagtagtgcaaggaaaagacgaagaagactggcaactcatagatgacagcttcaactttaaattctccctacaccccaacgacctcgtagaagttatcacaaagaaagcccgaatgttcgggtacttcgcaagctgccaccgcggtaccgggaacatcaatatacgcatacacgatctggaccacaaaatagggaaaaacggcattctggaaggcataggcgtcaaaaccgcgctgtcatttcaaaaataccaaatagatgaactcggtaaagaaatacgcccctgccggctaaagaaacgcccaccagtcagatga

SEQ ID NO: 6196 - RNA, 3249 nt, synthetic construct
  misc_feature 1..3249: note = Cas9 variant
  source 1..3249: mol_type = other RNA
atggcagcgttcaagcccaacccgatgaactacatcctaggattagacatcggaatcgcaagcgtaggctgggcaatcgtagaaattgacgaagaagagaacccgatcaggctcatagacctgggcgtccgagtcttcgaacgggccgaagtcccgaagaccggagactcactggccgcagcacgccggctggcgagatcggtacgcaggctaacgcgccgacgtgcacacaggctactgcgagcaagacgtctgctaaagcgagagggagtactccaagccgctgactttgacgagaacgggctgataaagagcctccccaacaccccatggcaactccgcgccgcagcactagaccggaaattaaccccactagaatggagcgcagtcctactgcacctaataaaacatcgcggatacctcagccagcgtaaaaacgaaggagaaacagccgacaaggaactaggagcactgctaaaaggcgtcgcagacaacacacacgcactccagacaggcgacttccgaaccccagcagaactcgcactaaacaagttcgagaaagagagcgggcacatccggaatcagcgaggagactacagccacacatttaacaggaaagacctacaggcagagctaaacttgctattcgaaaaacaaaaagagttcggaaacccccacgtgagcgatggcctcaaagaaggaatagaaacgcttctcatgacccaacgcccggcactatcaggtgacgcagtccagaaaatgctcggacattgtaccttcgagcccacagagcccaaggccgcaaagaacacctacacggccgaacgcttcgtatggctcacaaaattaaacaacctacgaatcttagaacaaggaagcgaaagacccctcactgacaccgaacgcgccacactcatggacgaaccataccgaaaaagcaagctcacgtacgcacaagcccgaaaactgttagacctagatgacaccgccttctttaagggactacgctacggaaaggacaacgcagaagcgagcaccctcatggagatgaaggcttaccacgccatctcacgcgcactcgaaaaggaaggcctcaaagacaagaaaagtcctctcaacctctccccagaactccaagacgagatcggaacggcattcagcctgttcaaaacagacgaagacatcaccggacgcctcaaagaccgcgttcaacccgagatcctcgaagccctgttaaaacatatctcattcgacaaattcgtacaaatctccttgaaagcgctaagacggatcgtcccactgatggaacaaggtaacagatacgacgaagcatgcacagaaatttacggcgaccactacggaaagaaaaacacagaagagaaaatctacctgccgcccataccagccgacgaaatcagaaaccccgtcgtgctccgagcactcagccaggcaaggaaggtaatcaatggagtcgtgcgacgctacggcagtcccgcccgcattcacatcgaaacggcacgagaagtcggaaagagcttcaaagacaggaaggaaatcgaaaagcgccaagaagaaaataggaaggatcgcgaaaaatcagcggcaaagttcagagaatacttcccaaacttcgtaggggaacccaaaagtaaggacatactaaaactccgcctctacgaacaacaacacggaaaatgtttgtacagcggcaaagaaataaacctgggacgcctcaatgagaaaggctacgtcgaaatcgaccacgccctccccttctctcgaacttgggacgacagcttcaacaacaaagtcctggcactcggcagcgaaaaccaaaacaaagggaaccaaaccccatacgaatacttcaacggcaaagacaactcgcgcgaatggcaggaatttaaagcacgagtagaaacatcccgattccccagatcgaagaaacaacgaatcctcctacaaaaattcgacgaagacggcttcaaagaacggaaccttaacgacaccaggtacataaacagattcctatgccaattcgtcgctgaccacatgttactgaccggaaaaggaaagcgccgcgtattcgctagcaacggccaaatcacaaacctactcagaggcttctggggactgcgtaaagtcagagctgaaaacgaccgacaccacgccttggacgcagtggtcgtagcctgttccactatagctatgcaacagaaaatcaccaggttcgtgagatacaaagaaatgaacgccttcgacggaaaaacgatcgacaaagaaaccggcgaagtgctccatcaaaaggcccacttcccccaaccttgggagttcttcgctcaagaagtcatgattcgagtattcggcaaaccagatggaaaaccggagttcgaagaagcggacacacccgaaaagctccgaaccctactagccgaaaaactgagctctcgacccgaagccgtccacaaatacgtcacgccactcttcatcagcagggccccgaaccgaaaaatgagtggacaaggccacatggagacagtaaaatcagcgaaaagactggacgaaggcatctcagtactacgagtacccctaacccaactgaaactcaaagacctcgagaaaatggtgaatcgcgaacgcgagcccaaactatacgaagccctcaaagcccgactagaagcccacaaggacgacccagccaaagcctttgcggaacctttctacaaatacgacaaagcaggcaacaggacgcaacaggtgaaggccgtacgcgtagaacaagtccaaaagaccggggtctgggtccacaaccacaacgggatagcggacaacgcgaccatagtacgcgtggacgtattcgagaagggtggcaaatactacctagtccccatctacagctggcaagtagccaaaggcatcctcccagacagagctgtcgtacagggaaaagacgaagaagactggacggtcatggacgactccttcgagttcaaattcgttctgtacgcaaacgatctcatcaaactcacagccaaaaagaacgagttcctaggctacttcgtgagtctcaaccgcgccacaggagccatcgacatacgcacccacgacacagatagcacaaaaggcaaaaacggaattttccaatcagtaggagtaaaaaccgccctctcgttccaaaaataccagatcgacgaactaggaaaggaaatcagaccctgccgactcaagaaacgaccacctgttcgctga

SEQ ID NO: 6197 - RNA, 3249 nt, synthetic construct
  misc_feature 1..3249: note = Cas9 variant
  source 1..3249: mol_type = other RNA
atggcagcattcaaaccaaactcgatcaattatatcctagggctcgacataggcatcgcgagcgtcggctgggccatggtcgaaatcgataaagaggagaacccaatcagactaatcgacctcggcgtccgagtcttcgaacgggccgaagtgcccaagacaggcgattcccttgccgccgcgcggcgcctcgcccgatccgtaagaagactaacccgccgcagggcccaccgactcctacgcaccagacgcctactaaaacgggaaggagtcctgcaagccgcaaacttcgacaagaacggactcataaaatcacttcccaatacactatggcaactacgagcagcggccctggacagaaaactcacacccctggaatggagtgccgtgctgctacacctaataaaacaccgaggatacctctcacaacgcaaaaacgaaggcgaaacagcagacaaagaactcggcgccctactcaaaggagtggcagggaacgcacatgcactacagacgggtgactttcgaacccctgccgaactggcgctcaacaagttcgaaaaagaatcaggccacatacgaaaccagagaggcgactactcccacacgtttagccgtaaagacctccaagcggaactaaacctgctattcgaaaagcaaaaagagttcggaaacccccacatatcaggaggtctaaaagaaggaatcgaaacactcctcatgacacaacgaccggcccttagcggggatgcagtacagaaaatgctgggccactgcactttcgaaccgaccgagccaaaggcagctaaaaacacatatacaaccgagagattcatttggctgaccaagctaaacaacctccgcatcctcgaacagggaagcgaacgccccctcaccgacaccgaaagggccacactcatggacgagccataccgcaaatcgaagttaacgtacgcacaggctcgcaagctcctatccctagaggacaccgccttctttaaaggactacgctacggcaaagacaacgcggaggctagcacgctcatggaaatgaaagcctaccacaccatcagccgagccctcgagaaggaaggactaaaagataagaaaagccccctaaacctaagcccggagctgcaggacgaaattggcaccgcattctcactgttcaaaaccgacgaagacataacgggcagactcaaagaccgcatacagccagaaatcctcgaggccctcctcaaacacatcagcttcgataaattcgtccaaataagcctcaaagcccttcgccgcatagtcccgctcatggagcagggcaaaagatacgacgaggcttgcgccgaaatatacggggaccactacggcaagaaaaacaccgaagagaaaatatacctcccgccaatccccgccgacgaaatacgcaatcccgtggtgctacgcgcactgtcacaagcccgtaaagtcataaacggggtggtgcgaagatacggaagcccggcccgtatacatatcgaaacagcaagagaagttggcaaatcattcaaagaccgaaaagaaatcgaaaaacggcaagaagaaaaccgaaaagaccgagagaaagccgcggctaagttccgagaatacttcccgaactttgtaggagaacccaaatcaaaggacatccttaaactacgactatacgaacaacagcacggcaaatgcctctacagcggaaaagaaatcaacctcgtcagactaaatgagaaagggtacgtcgaaatcgaccacgccctgcccttcagccgcacctgggacgacagcttcaacaacaaagtacttgtgctaggtagcgaaaaccagaacaagggcaaccaaacaccatacgaatactttaacggcaaggacaactcgagagaatggcaagagttcaaagcccgcgttgaaacgtcacgttttccaagaagcaagaaacaacgaatactcctccaaaaattcgacgaagacggcttcaaagaacgtaacctaaatgacacaagatacgtcaaccgctttctctgccaattcgtcgccgaccatatactgctcacaggaaagggcaaacgacgagtctttgcgtccaatggacaaataaccaacctactacgcggattctggggactccgtaaagtccgagcggaaaacgatcgacaccatgcactcgacgcagtagtcgtagcctgctccacggtcgccatgcaacagaaaataacacgcttcgtacgatataaagaaatgaacgcattcgacggcaagaccatagataaagaaaccggggaagttctgcaccagaaaacacactttccccaaccctgggagttcttcgcccaagaagtaatgatcagagtattcggaaagccagatgggaaacccgagttcgaagaagcagacacgctcgagaaactccgaacactcctagcagagaaattgagcagccgccccgaggcagtacacgaatacgtaacacccctatttgtgagtcgagccccaaaccgtaaaatgtcaggccaaggccatatggaaaccgtcaagtccgcaaaaagactagacgagggagtaagcgtactgcgcgtgccacttacccaactcaaactaaaagacctcgagaaaatggtgaaccgcgaacgtgaaccaaaactctacgaagccctcaaagccagactagaggcacacaaagacgacccagctaaagccttcgcagaaccgttctacaaatacgacaaggcaggaaaccgaacccaacaagtaaaagctgtccgcgttgaacaagtacagaaaacgggcgtatgggtccgcaaccacaacgggatagccgacaacgccacaatggtccgggtcgacgtcttcgaaaaaggcgacaaatactatctggtaccgatatacagctggcaagtagccaagggtatactgcccgaccgcgccgtagtccaaggaaaagacgaagaagactggcaactcatcgacgactccttcaatttcaaattttccctgcacccaaacgacctagtagaagtcataacaaagaaagcccgaatgttcgggtactttgccagctgccacagaggcacgggaaacatcaacatacgtatacacgacctcgaccacaaaattggcaaaaatggcatcctcgagggtataggagtgaaaaccgcactctccttccaaaagtatcagatcgacgaacttggcaaagaaatacgaccgtgcaggctaaagaaacgacccccggtccgctga

SEQ ID NO: 6198 - RNA, 3249 nt, synthetic construct
  misc_feature 1..3249: note = Cas9 variant
  source 1..3249: mol_type = other RNA
atggccgccttcaaacccaaccccataaactacatcctaggactcgacatcggcatcgcatcagtcggctgggccatggtggaaatcgacgaagaagaaaaccccatccgccttatcgacctgggcgtccgagtcttcgagcgagccgaggtccccaaaaccggagattcgttagccatggtgcgcagactcgcacgcagcgtccgccgattaacaaggcgcagggcccacagactgctacgcgcccggagactcctcaagagagaaggagtactccaagccgccgacttcgacgaaaacggtctgatcaagtccctacccaacaccccctggcaactacgggcggcagcactagaccggaaactcacgccactggagtggagcgcagtgcttctacacctgatcaagcaccgaggctacctctcacaaaggaagaacgaaggggagacagcagacaaagaacttggagccctcctaaaaggagtagcagacaacgcgcacgcgttacaaaccggagacttccggacaccagccgaattagccctcaataaattcgaaaaagaatcaggccacatccgcaaccagcgcggggactactcccacaccttcagccgcaaggacctacaggcagagctgattctcctatttgaaaaacaaaaagagttcgggaacccccacatctccggaggactcaaagaaggcatagagacactactaatgactcaacgccctgccctgagcggggacgcagtacagaaaatgctggggcactgtacgttcgaaccagcggaacccaaagccgcaaagaacacctacactgcggaaagattcatctggctgaccaaactgaacaacctccgaatactcgaacaaggcagcgagcgacctctcacagatacagaaagagccaccctgatggacgaaccatacaggaaatccaaactcacgtacgcccaggccagaaagttactaggacttgaagacacagcctttttcaaaggcctacggtacgggaaagacaacgccgaagcaagcaccctcatggagatgaaagcctaccacgcaatcagtcgggcactagaaaaggaaggcctcaaagacaagaaatccccgctcaatctgagtccggagctgcaagacgaaatcggcaccgccttcagcctattcaaaacagacgaagacattaccggaagactcaaagaccgaatccagccagaaatactcgaggcccttttgaaacatatatcctttgacaaatttgtacaaattagcctgaaagccctacgacgtatcgtacccttaatggagcaaggcaagcgatacgatgaagcctgcgccgaaatttacggggatcattacggcaagaaaaacaccgaggagaaaatttacctgccacccatacccgcagatgaaatcagaaaccccgtcgtcctgagagccctgagccaagccagaaaagtcataaacggagtcgtccgccgatacggcagcccagcgcgcatacacatagaaaccgcgagagaggtcggcaaatccttcaaagatcgaaaagagatagaaaagagacaagaagaaaaccgaaaagaccgcgaaaaggccgcggccaaattcagagaatacttcccaaacttcgttggagaaccgaaatccaaagacatactcaaactccgcctatacgagcagcaacacggcaaatgcctatacagcggcaaagaaatcaatctcggccggctaaacgaaaagggctacgtcgaaatcgaccacgccctacccttcagcaggacctgggacgacagctttaacaacaaggtcctggtcctaggctccgaaaatcagaacaaaggaaatcaaacaccatacgaatacttcaacggaaaggacaactcccgagaatggcaagagttcaaagcccgcgtcgaaacgagcaggttcccccggagcaagaaacaacgaatactcctacaaaaattcgacgaagacggttttaaggaacgaaacctaaacgatacccgatacgtgaaccgcttcctctgccaattcgtggcggacaggatgcgactcacaggaaaaggaaagaaacgagtgttcgcgagtaacgggcagatcaccaacctcttaaggggattctggggactgagaaaagtcagagcggaaaacgacagacaccatgccctagacgccgtcgtcgtggcatgcagcacagtcgcaatgcaacagaaaataacacgcttcgtcaggtacaaagaaatgaacgcattcgacggcaagacaatcgacaaagaaaccggcgaagtcctgcaccagaaaacgcactttccccaaccatgggagttcttcgcacaagaagtaatgataagagtattcggaaagcccgatgggaaaccggagttcgaagaagcagacacaccagaaaaacttcgaacactgctcgcagaaaagctatcctcaagaccggaagcagtacacgaatacgtgacacccctcttcgtatcacgcgccccaaacagaaagatgagcggacaggggcacatggaaaccgtcaaaagtgccaaacggctcgacgaaggagtatcggtactacgagtccccctaactcaactcaaactcaaagacctcgagaaaatggtcaatagggaacgcgaacccaaactctatgaagcgctaaaggcgcggctagaagcccacaaggacgaccccgccaaagccttcgccgagccattttacaaatacgacaaagccggcaaccgcacccaacaagtcaaagccgtccgagtcgagcaagtacaaaagaccggcgtatgggttcgaaaccataacggaattgccgacaacgccacaatggtacgagtcgatgtcttcgaaaaaggcgacaaatactacctcgtccccatatacagctggcaagtggccaaaggcatcctgccggaccgagcagtcgtacaagggaaagacgaagaagactggcaactaatagacgactccttcaacttcaaattcagcttacaccccaacgacctagtagaggtcatcaccaagaaagcaagaatgttcggatacttcgcgtcgtgccaccgcggtacaggaaacatcaacataaggatccacgacctagaccacaaaataggcaaaaacgggatactagaaggtataggagtaaaaacggccttatcattccaaaaataccaaatagacgaactcggcaaagaaatacgaccctgccggctcaaaaagcgaccgcccgtgagatga

SEQ ID NO: 6199 - RNA, 3249 nt, synthetic construct
  misc_feature 1..3249: note = Cas9 variant
  source 1..3249: mol_type = other RNA
atgagagtactaggcctcgatgccggcatagcgagcctcggatgggcattaatagaaatcgaagaaagcaaccgaggggaactgtcgcaaggaacaatcatcggagcaggaacatggatgttcgacgcacccgaagaaaagacgcaggccggagcaaaactaaaatcggaacaacggagaacattcagaggccaacggagggtcgtacgaaggcggcgacaaaggatgaacgaggtgagaagaatactacacagtcacggcctgttaccgagctcagaccgtgatgcactaaagcagcccggactagacccatggcggatcagggctgaagcactagacagattactcgggccggtcgagctagcggtagcgctcgggcacattgcacgacaccgcggattcaaaagcaacagtaaaggggcgaaaaccaacgacccagcggatgacacatcgaagatgaagcgggccgtaaacgaaacccgggaaaaactagcaagattcgggtccgcggcaaagatgctcgtagaggatgaaagtttcgtgctacgccaaaccccaaccaaaaatggcgccagcgaaattgtaagaagattccgaaacagagaaggagactacagcaggagcctcctcagagacgacctcgcggcggagatgagggcgctatttacggcacaggcaagattccagagcgcgatagcaaccgccgacctacaaaccgcattcacaaaggcggcattcttccaacgaccactgcaagatagcgaaaaactggtagggccctgcccattcgaagtcgacgagaaacgagcacccaaacgaggatactcattcgagctattcagatttctaagtagactaaatcacgtaacccttcgggatggaaaacaggaaagaacactcacccgagacgagctagccctagcagccgcggacttcggcgcggcagcaaaggtgagcttcacagcactccgaaagaagctcaaattaccagaaactacggtattcgttggggtcaaagcggatgaagagagcaagctagacgtggtcgcaaggagcggaaaagccgctgaagggactgcaagactgcgatcagtaatagtggacgcactaggggaactcgcctggggagccttactctgcagcccagaaaagctagataagatagcggaagtaataagtttcaggagcgatatcggaagaataagcgagggtctcgcgcaagccggatgcaacgcacccctcgtagacgccctgaccgcagcggcaagcgacggacgcttcgatccgttcacgggagcaggccatatcagcagcaaggccgcaagaaacatattaagtgggctgcggcaaggaatgacatacgataaagcatgctgtgccgcagactacgaccacacagcaagcagggaaagaggggcattcgacgtaggaggtcacgggcgagaagcattaaaacgaatactccaggaggaaagaataagccgcgaactcgtagggagcccaacggcaaggaaagcgctgatcgaaagcatcaaacaagtaaaagccatagtagagcgctacggcgtaccagacaggatacacgtagaactagcacgagacgtcgggaaaagcatagaagaaagggaagagataacgagaggtatagagaaaaggaaccgacagaaggacaagctgcgaggattgttcgaaaaggaagtgggtcggccaccacaggacggagcaaggggaaaagaagaactacttagattcgaactatggagcgagcaaatgggacgctgcctgtacacggacgattacatatcaccgtcccagctagtagccacagacgacgcagtgcaagtcgaccacatactaccatggtcaaggttcgccgacgacagctacgcgaataagacactctgcatggcaaaagcaaaccaagacaagaaaggaagaacgccatacgagtggttcaaagcagagaaaactgacacagaatgggacgcatttatcgtcagagtggaagcactcgcagacatgaaagggttcaagaagaggaactacaaactaagaaacgcggaagaggcggccgcgaaattcagaaaccgaaacctgaacgacacgaggtgggcctgcaggctactcgcagaagcactaaagcaactctatcccaaaggagagaaggacaaagacggaaaagagcgaagaagggtattttcacgaccaggcgccctgacggataggttgagacgagcgtggggactacaatggatgaagaaaagcacgaaaggagaccgtattccagatgacagacaccatgcattagacgcaatagtaatagcagcaacgaccgaatcgttactgcaaagagccacgcgcgaagtacaagagatagaggacaaaggactacactacgacctggtcaaaaacgtgacaccgccctggccgggcttccgcgagcaggccgtcgaggcggttgagaaagtcttcgtagcaagagccgagcgacgccgagcacgcggaaaagcgcacgacgcaacaataagacatatagcagtcagagagggagagcagagagtctacgaaaggcgaaaagtggcagaactaaaactagcggacctcgacagagtaaaggacgcagagagaaacgcacggctgatagaaaaactcagaaactggatagaggcaggaagtccaaaagacgacccgcccttatcaccgaagggggacccaatattcaaagtgcgacttgtaacgaaatccaaagtcaacatcgcactagacacgggcaacccaaagagaccgggaacagtagatcgaggagagatggcaagagtagatgtattccgaaaagcatcgaagaaaggaaaatacgaatattacctagtacctatatacccacacgacatagcaacgatgaaaaccccacccatacgcgcagtacaagcatacaaaccagaggacgaatggcccgaaatggactcgagttacgagttctgctggtcactggtacccatgacttacctccaggtaataagcagtaaaggagagatattcgaaggatactaccgaggaatgaatcgcagcgtcggcgccatacaactatcggcacacagcaacagcagcgacgtcgtccaggggatcggggcgagaacactcacagagttcaagaaattcaacgtagaccggtttggacgaaaacacgaagtagaacgagaactacgaacctggcgcggggaaacgtggaggggaaaagcatacatatga

SEQ ID NO: 6200 - RNA, 3255 nt, synthetic construct
  misc_feature 1..3255: note = Cas9 variant
  source 1..3255: mol_type = other RNA
atgaaaaacaccctatacgggatcggtctggacatcggcgtggccagcgtaggatgggcagtggtaggcctaaacggcacaggagaacccgtaggactacacagactcggcgtccgaatcttcgacaaagcagaacaacccaaaaccggagaaagcctagccgctcctcgacgaatggccagagggatgcgccggcgactccgtagaaaagccctaaggagagcagacgtatacgcccttctagaacggagcggcctgagcacccgcgaagcactagcccacatgttcgaagcaggcggcctcgaagacatatacgccctacgaacccgagccttagacgaacccgtcggcaaagctgagttctcacgaatcctactgcatctcgcccaacggaggggcttcaaatcaaacaggcgtaccgcctccgacggagaagacggccgactcctagcggccgtcaacgaaaatcgccgaagaatggcccaaggcggatggcgaaccgtcggagaaatgctctaccgacacgaggctttcgccttacacaaaagaaacaaagcagatgaatacctctctaccgtaggcagagacatggtagctgaagaagcaagcctcctattccaacgacaacgagaactaggctgcgcctgggcaacccccgagctacaagcagagtacctatcgatactactccgccaacgcagcttcgacgagggaccaggaggcaactccccctacgggggaaaccaagtagaaaagatggtaggccgatgcacgttcgagccagacgaaccccgagccgccaaagccgcgtacagttttgaatacttctctctcctccagaaaatcaaccacatacgcctcgtggaaaacggcgaaacacgaccgctgacacaacaacaacgccaacaactactcagcctagcgcataaaactcccgacgtgtccttggcacggataagaaaagaactcgccctgccagaaaccgtccaattcaacggagtccgatgcagggcaaacgaaacgttagaagaaagcgaaaagaaagaaaaatttgcatgtctacccgcataccacaaaatgcggaaagcccttgacggagtagtaaagggccgaatttccagcctcagcatctcacaacgagacgcagcagcaaccgcactcagcctgtacaaaaacgaagacaccctgagagccaaactaaccgaagccggtttccaagcaccagaaatcgatgccctagcaggcctcacgggattcagtaaattcggacacctcagcttgaaagcatgtcgcaagctgatcccacacctagaacaaggactcacctacgaccaagcctgctcagcggccggctacgacttcaaaggacacggagcaggagaaagggccttcaccctgccagccgcggcacctgaaatggaacaaataacatcgcccgtagtacgccgcgccgttgcccaaaccataaaagtagtaaacggaatcatccgcgaaatggacgcaagcccagcatgggtaagaatcgaactagcccgcgaactgagtaaaacattcggagaacgacaagagatggaccgcagcatgagggaaaacgcagcgcaaaacgagagactgatgcaggaactgagggacactttccacctcttaagccccaccgggcaagacctcgttaagtatcgcctctggaaggaacaggacggagtctgcgcgtacagcttacgccggctggacgtcgaacggctattcgagccaggctacgtagacgtggaccacatcgtcccctattcattgtcattcgacgaccgcagatcaaacaaggtcctggtactatcatccgaaaacagacaaaaaggaaaccgactcccacttcaatacctacaaggaaaacgccgagaagactttatagtatggaccaacagcagcgttcgagattatcgaaagagacagaacctcctaagagaaaaactctcgggcgacgaagccgagggcttcagacaaaggaacctacaagacacacagcacatggcgagattcttatacaattacataagcgaccaccttgcctttgcccaatcggaggccctaggcaagaaacgcgtatttgccgtcagcggagcggtaacgagccatctgcggaaacgctggggactctccaaagtacgcgcagacggcgacctccaccacgcacttgacgcagccgtaatagcatgcaccacagacggtatgatacgacgcatctcagggtattacggacacatcgaaggagaatatctgcaagacgcggacggagctggatcgcaacacgcccgaacgaaagagcgcttccccgcgccctggccaaggttcagagacgaactcatagttcggctcagcgaacagccaggcgaacacctactggacatcaacccagagttctactgtgaatatggtacagaacacatccgcccggtatttgtgtcacgaatgccgcgccgcaaagtcaccggaccaggacataaagaaaccataaaaggagcagccgcggcagacgaaggactactcacagtacggaaagcgctgaccgaattaaaactcgacaaagacggcgaaataaaagactactacatgccatcttcagacacactactatacgaagcactaaaggcccaactacgccgattcgggggagacagcaaaaaggctttcgcagagcctttttacaaacccaaagccgacggcacacccggccctctcgtgaggaaagtaaaaaccaccgagaaagcaacgctgaccgtgccagtacacggcggagccgcaagcaacgatacgatggtcagggtcgacgtattccttgtcccaggagacggatactactgggtaccagtctacaccgccgacacactcaaaccagaactacccaacagggccgtcgtacaggggaaaccatactcggaatggaaagaaatgcgagaggaagacttcatcttctcactgtaccccaacgacctcgtctacgtagaacacaaaagcgggctaaaattcaccctgcaaaacgcagatagtacattagagaaaacgcgaacccaaacatccgccttcgtatatttcgtaggcgggtcgatatccaccgcaagtataacaatccgtacgcacgacaacgcctatggcataccaagcctcggggtcaagaccctgaagacattccacaagtaccaagtcgacgtactgggaaacgtatttccagtccacaaagaaacccgacaaaaatttcggtga

SEQ ID NO: 6201 - RNA, 3255 nt, synthetic construct
  misc_feature 1..3255: note = Cas9 variant
  source 1..3255: mol_type = other RNA
atgaaaaacacactatacgggatcggactggacatcggggtagcaagcgtcggatgggcagttgtcggcctcaatggaacaggtgaaccagtaggcctgcaccgtctcggcgtcaggatcttcgataaggcggaacaaccaaaaacgggagaaagcctagcggcaccgcgacgcatggcacgcggcatgcgtcgtagactaaggagaaaagcccttcggagggccgacgtctatgcactcctggaacgtagcggactatcgactcgggaggcactcgcccaaatgttcgaagccggtggcctcgaagacatatacgcactcaggacgcgcgcattagatgaacccgtaggcaaagcagaatttagccgcatattactacatctagcacagcgcagagggttcaaaagcaaccgccggacagcatccgacggcgaagacggtagattactagccgcagtcaacgaaaaccgacgacgaatggcacaaggtggctggaggacggtgggcgaaatgctctaccgacacgaagcgttcgccctacacaaacggaacaaagccgatgactacctgagcacagtaggcagagacatggttgccgaagaagccagcctactcttccaacgccaacgcgaactcggctgcgcatgggcaacaccagaactccaggccgaatacctatccatcctcttacgccaacgcagctttgacgaaggacccggaggtgactcaccgtacggaggcaaccaagtagagaaaatggtgggccgatgcacctttgaaccagatgaaccacgcgcagctaaggccgcatactcctttgaatactttagcctgctccagaaaataaaccacatcagactcgccgagaacggagaaacaagaccgctaacccaaccacaacgacaacaactactaagcctagcacacaaaaccccggacatgtcccttgcgcgcatcagaaaagaactagccctccccgagacagttcaattcaacggcgtccgctgcagagccaacgaaaccctagaggaatctgagaaaaaggaaaaattcgcatgcctaccagcgtaccacaaaatgagaaaagcactcggaggagtcgtaaaaggtcgcatatcatcactctcaatttcacagcgcgacgccgcagcaacagccctctccctatacaaaaacgaagacacactcagagccaaactaaccgaggcaggctttcaagcaccagaaatcgacgccttagccggcctcacaggattctcgaaatttggacacctgtcgctaaaagcatgcagaaaactaataccacatctcgagcaggggctgacgtacgaccaggcttgcagtgcagcaggatacgacttcaagggacatggtgccggagagcgagccttcacacttccggccgccgccccagaaatggaacaaatcacctcacccgtagtaagacgagccgtagcgcagacaatcaaagtcgtcaacggcataatcagagaaatggacgcaagccccgcctgggtaagaatcgagctagcccgagaactgtcaaaaaccttcggcgaacgccaagaaatggatcgaagcatgcgcgaaaacgcagccaaaaacgaaaggctaatgcaggaattacgagacaccttccacctccttagccccaccgggcaagacctagtgaaataccgcctatggaaagaacaagacggagtctgtgcatacagccttcaacgcctagacgtagaacaactatttgaacccggatacgtcgacgtagaccacatagtaccgtacagcctctcattcgacgatcgcaggtccaacaaggtcctagtgctaagctcagagaaccgtcaaaaagggaatcgactcccattacagtacctccaaggcaaaagacgcgaagacttcatagtatggacgaacagctccgtgcacgactaccgcaaacgacagaatttactaagggaaaaactatcagacgacgaagcggaaggattcagacaacgcaacctacaggacacgcaacacatggctcgcttcctttacaactacattagtgaccacctggccttcgcgcaatccgaggccctcgggaagaaaagagtcttcgccgttagcggcgcagtaacatcacacctcaggaaaagatggggactcagcaaagtgagggccgacggggacctacaccacgcgctagacgccgccgtcgttgcgtgcaccacagacggaatgatccggagaatttctgggtattacggccacattgaaggggaatacttccaagacgccgacggagccggcagccaacacgcgagaacgaaggagcgtttcccagccccatggccgcgcttccgcgacgaattaatagtccgcctcagcgagcaaccgggagaacccctactagacatcaacccagctttctactgcgagtacggcaccgaacacatcagaccggtatttgtcagcagaatgccacgccggaaagtgaccgggccatcccacaaagaaacagtaaagggcgccgcagccgcagacgaaggcctactaacagttaggaaagcactaacagaactcaagctagacaaggacggcgaaataaaagactactacatgccctcctcagataccttgctatacgaagccttgaaagcccaactccggcgcttcggcggcgacggcaaaaaggctttcgcggagcccttctataaaccaaaagccgatggaacaccagggcccctagtgcgaaaagtgaaaacaacagaaaaagccacactcaccgtaccagttcacggcggggcagcctccaacgacactatggtgagaatcgacgtctttttcatgccaggggacggttactactgggttcccctctacgtcgccgacacactgaaacccgaactaccaaaccgagccgtcgttgcccataaaccttactccgaatggcaggagatgcgagaagaagactttgtattcagcctctacccaaacgatctcgtctacgtcgaacacaaatcagaactaaaattcaccgtccagaacgcagacagcaccctagagaaaaccagaacgcaagccagcgcattcgtatacttcgtgagcggaggaataagcggcgggacgatcaccgtccgcacacatgacaacagctacggaatcccaagcctcggactaaaaacgctcaaatcactctgcaaatatcaagtcgacgtgctcggaaatgtcttccccgtgcacaaagaaacccgacagaaattccgctga

SEQ ID NO: 6202 - RNA, 3255 nt, synthetic construct
  misc_feature 1..3255: note = Cas9 variant
  source 1..3255: mol_type = other RNA
atgaaaaacaccttatacggcattggcctggacataggcgtagcctccgtcggttgggcagtagtcggcctcaacgggacgggggaaccagtagggctacatcgcctcggcgtaagaatcttcgacaaggcggaacaacccaaaacaggggaatcactagcagcaccacgccgcatggccaggggcatgagaagaaggctacgcagaaaagccctgcgacgcgcagacgtatatgcactgctcgaacgcagcggactgagcacacgcgaagaactggcccaaatgttcgaagcaggagggctcgaagacatatacgcattacgcacaagagccctagatgaaccggtaggaaaggccgagttcagcagaatcctcctccacctggcacaaagacgtggattcaagtccaaccgacgcacagcgtcggacggagaggacggcagactactcgccgcggtgaacgaaaacagacgacgaatggctcagggcggttggagaacagtcggcgagatgctctacagacatgaggccttcgccctacataaacgcaacaaagcagacgactacctctccacagtcggacgggacatggttgcagaagaagcatccatactattcgaaaggcagagggcaatggggtgcagctgggcagcacctgaactacaagccgagtacctatctattctcctccgccaacggtccttcgacgaaggtcccggaggcaactcaccctacgggggcaatcaagtggagaaaatggtgggccgatgcacattcgaaccggacgaaccgcgtgcagccaaagccgcttactcgttcgaatactttagcctgctgcaaaaactaaaccacattcggctagcagaaaacggcgagaccaggccgctcacccaaccccaaagacaacagttactcagcctcgcacataagaccccagacatcagtctggcaagaatacgaaaagagctagccctacccgaaacagtacaattcaatggcgtccgatgtcgagctaatgaaaccctagaagaaagtgaaaagaaggaaaaattcgcctgcctccccgcttaccataaaatgcgaaaagctctagacggcgtcgtaaaaggccgaatctcatcactctcaatcagccaaagagacgcagcagcgaccgccctctccctatacaaaaacgaggacacactgcgcgcaaaactgacagaagcaggcttccaagcacccgaaattgacgccctggcaggactaacaggattctcaaagtttggacacctcagcctcaaggcttgtcgcaaactaatcccgcacctggaacaaggactcacatatgaccaggcctgtaccgccgcaggatacgacttcaaaggccacggcgcgggggaaagggccttcacactccccgccgcagcaccagaaatggaacaaataacatcccccgtagtcaggagagccgtcgcacagaccataaaagtcgtaaacggcatcataagagaaatggacgcctcacccgcgtgggtccgaatcgaactggcgcgcgaactaagtaagacattcggcgaacgacaagaaatggacagaagcatgcgcgagaacgccgcacaaaacgaacgactcatgcaggaactaagagacaccttccacctcctcagccccacaggccaagaccttgtcaaataccgactgtggaaagagcaagacggagtatgcgcctactccctccgtagactcgacgtggaaagactattcgaacccggatacgtagacgtagaccacatcgtcccctatagcctctctttcgacgaccgccgaagtaacaaagtcttggtactctcaagcgaaaacagacaaaagggaaacaggctcccactccaatatcttcagggcaaaaggcgagaggatttcatagtgtggacaaacagctccgtgcatgactaccgaaaacggcagaacctcctgcgcgagaaattatcaggagatgaggcagaaggattccgccagcggaatctacaggatacgcagcatatggctcggtttctctacaactacatcagcgaccacctagcattcgcccagagcgaagcactcggcaagaaacgcgtattcgccgtaagcggagcagtcacttcccaccttaggaaacgatgggggctcagcaaagtcagagccgacggggacctgcaccacgccctcgacgccgcagtagttgcctgcacaacagacggcatgatacggcgcatatcgggatactatggccacatcgaaggcgagtacctacaagacgcggatggagcaggaagccaacacgcccgcaccaaagagaggtttcccgcgccgtggccacggttccgcgatgagctaatcgtgagactctcggaacagccagccgaaccactactcgacatcaacccagaattttactgtgagtacggcacagaacatatacgccccgtcttcgtctctcgcatgccgagaagaaaagtcacaggcccaggccataaggaaaccatcaaaggcgctgcggcagccgacgaaggactgctgacagttcgcaaggccctaaccgaactaaaactagacaaagacggcgagataaaagactactacatgcccagctcagacacactgctatatgaagcactaaaggcccagctgcgtcggttcggaggcgacggcaagaaagcattcgcagagcccttctacaaaccaaaagcagacggaacccccggcccactcgtgcggaaggttaaaaccacagaaaaagcaacattaacggtaccagttcacggcggagccgccagcaacgacacaatggtacgagtagacgtgttccttgtgccaggcgacggatactactgggtcccagtctataccgccgacacgctcaaacccgaactaccaaacagagcagtagtccaaggtaagccatacagcgaatggaaagaaatgagagaagaagatttcatattttccctgtaccccaacgacctggtgtacgtcgagcacaaatcaggccttaaattcaccctacaaaacgccgactccaccctagagaaaacacgcacccaaacctcggcatttgcatactttgtgagcgggtccatcagcaccgcctccatcacgatcagaacacatgacaacgcctatggaatcccaagcctcggagtcaaaacactaaagaccttccacaaataccaagtggatgtcctcggaaatgtattcccggttcacaaagaaacacgacaaaaattcagatga

SEQ ID NO: 6203 - RNA, 3255 nt, synthetic construct
  misc_feature 1..3255: note = Cas9 variant
  source 1..3255: mol_type = other RNA
atgaggctagggctcgacatcggaacaaacagcataggctggtggctatacggaacggaaggcgggcgcataacagaagtcgtagacgggggagtgcgaatcttctcagacggaagagaccctcaaagcaaagcctcgctggctgtcgacagacgggccgcgcgctcgcaaagacgccgacgcgaccgctacctccgcaggaaggccgcactaatgaaacgcatggcgcaggtaggccttatgccggcagacccagcagaggccaaagtgctagaagtactcaacccatacgaactaagggcctcaggcctggacgggccactaccactgacccatttcggccgcgccctcttccatctgaaccaacgcagaggattcaaatcgaatcggaaaaccgaccgcggagacaatgagagcggaaaaataaaagacgcgaccgcgagactagaccaagcaatgatggccaaaggagcgcgcacgtacggagaatttctacacatgagacgcgcggccgcactcgaccccaagtccgtaccctcggtacgaactaggttaacagtcgcgcgcagagacgacgccgaaaaagaagaagcgggctacgacttctacccggacaggaaacacctcagcgaagagttcgacaaactatgggcggctcaggccagacacgcaccagacgtactcacagaagatctacgagacgaaatagccacaataatattccatcagcggcctctgaaaacaccagaagtaggactatgcctattcaccggacaacacggtgtcccagaacgcgacaagcgaatcccgagtgcacacccgctcaatcaacgacgcatactaatggaaactgtaaataaccttaaagtcgcagcgcaaggagaaccgagcaggccattgacccgggaagaacgagaccaaatagtacacgccctggacaacaagaaacatacgaaaagtctcagcggcatgaccatgaaactgaaagcactaggcaaagtaataaaactccgaccggaacaaggattcacactagaaacagcaaacagagacgcgatcgcttgcgacccagtgcgagcaagcctatcccacccagacagattcggagcacgctggagcacactcgagagcgcgggccagtgggacgtcgtacaaaggatcagggcagtgcaatcagacgcggaacacgccgacctcgttggctggctcatggacgtacacggactcgaccgagaccacgccgaagagacggcgaacgcacccttacctgaaggctatgggaggctcgggttaacggcaacgacacgcatactagctgccttagaggccgacgtactcaactacagcgccgccgtcgcggcgtgcggctggcaccactctgacggaagaaccggcgaagttctcgaatcactaccctattacggagagatactagaaaggcacgtaataccaggcacaggcgacccgaacgatgatgacgtgaaacgctacggacggataacaaaccccacggtccacatagggctgaaccaactgcgtaggttagtaaaccgaatcataaccgtatacgggcgcccagacgagatcgtggtcgagctagcacgcgacctgaagctcagcgaggaccagaagaaagacgtacagcgagatataaagaaaaacaccgaggccgctataaggcgcggcaagaaactcgaagaaatgggagtgcccaatacaggcgcaaaccggatggtactccgactctgggaagatctcggagacgacgtgatgacaagaaactgcccttacactggaaaacgaataagcgccggaatgctatttgacgggtcatgcgatgtcgaccatattctcccctatagcagaacactcgacgacagtttcgccaaccgaacactttgcctaaaagaagcgaaccggcagaaaaccgacaaaacgccctgggaggcatggggagaaaccgaacaatgggaagcaatcgcagcgaacttaaagaacctaccagcaaataaagcgtggcgattcgcaccagatgctatggaacggttcgagggcgaaaaagatttctccgcaagagcactggcagacacacaatacctgagcagaatagcccgcgcatacttagacgcgctatatgacggagacgacggtaaaagtcatgtatgggtcgtaccgggacgactaacagaaatgctccggcgacactgggggttaaacggggtagcagcactaaccgacagcgacaaacaaaccgtgaaagccaaaaatcgcacggaccaccgccaccacgcaattgacgccgcagtagtcgcagcaacagatagaggactgataaaacgtatcgcagacatggcaaaacgcgacgaatttaacggggccgaagaggtagcgagaagcatccctccaccctgggaaggattccgcgacgacgtttcagcacaagtgacgcgaataatagttagccaccgcgcggaccatggcagaatcgaccccgcagcgagaaaatcagggagagacagcacaagtggccagctacacaacgacacagcttacggaatcgggcgggacgggacagtagtcagtcgaaaaccgctagcgagcctatcaccaaacgatatagtcgtcaccaaaagaggagctaacatacgcgatgtggaccttcagaaacacctagcccgagtaacccacggactagacggaaaggccttcgaggcagcactcttagccttcgcagcaagcccaatactacccgataacacggataacccatacttcggactaagaagagtacgactcgaggagaccctacaagaaagcgcacgagtagaggtagcagaccaagaaggcaggccctacaaagcatacaaaggcgatagcaatcactgctacgaaatctggtgcctgccagatggcaagataaaaccgcaagttgtaaccacatatgaggcacaccaatccggtgcagagaagaaaccacatccagccgctaagcgtctaatgagaatattcaagagagatatggtcatgctagagagagacggagagacgatcataggatatgtacagaaaatgaaacaaaacgggagcatattcgtggcacctcacacagaagcaaacgcagacgcgcgagaccgcgacccaaaagacgactttaagctgattcaacttggagccggctcgctagtgaaagcgaaagcacgtagagtaatcgtcgacgaaatgggccgactcagggaccccggtccaccactatga

SEQ ID NO: 6204 - RNA, 3258 nt, synthetic construct
  misc_feature 1..3258: note = Cas9 variant
  source 1..3258: mol_type = other RNA
atggacaaagggacaaactccataggctgggctgcactgaggctggacgaacaaggagagcctgttggcataatagaagccggcgtcagaatctacgccgacggcagagaacccaaatcaggcacatcactagccgaggggcgcagaatcgccaggggaatgagcagaaggcgagacaggtacaaaaggcgacggagaacagtactaaacacgctgacagagttcggactcatgccagccacaaaagcagcgaggaaagccctggtagcagaaacgaatgatagacgattcggggaagtagcaagcaacgtgtacgcattacgagcaagggcactcgatgaaaaactacccctctaccaactagggagagcactcttccacctcaaccagagacggggattcaaatcaaatcgaaagactgataaacgcgacaacgaccagggaaagatagcgtcggcgataagcaggctagggcgaaaattagacgaggcgggggcccgaacgctcggggagttcctacacaaacaacacgcagcaggaaaatgggtaagggtcaggccatcccgcgtaccgggcgaagacgacaaagaagaggacggatacgggttctatcccgaacgcagcttcctcgaacgagagttcgcagcgatctgggaggcgcaagcagcattctaccctgaactccttacagaagaacgtagagaccacctccactgggtaatgtttttccaacgacccctaaaacggcccacggttggcaaatgctcgttccatcccgacgaagatcgactgcccaaagcccacccactattccaagagttcaggctgattaaagaactaaacgaacttgaagtggtacaccgaggagatcggagggaaaagctaacccccgaccaaagagaccgattattcaatcagctacgaacacaaaggtcgtcagcattcacagcactccgaaaaacaatcaaagcaccaaccggcaccaggttcaacaaagagagtgacgccagagacaaactgaagggagacgaagtggccgcagaaatgagccacaaagacagatttggacaagcgtggataggcatgccactggccgaaagatgggcagtagtcgcaatgctattggataccgaggacccactcgaagtaaaagcatggctggaggaacgatatgggttcgcagcagatcgcatagacgcaatcgccgccgcaaaactacccaccggatacggacgcctcggagagacagccctgagggacatgctcgacgaattaaggaacggcaccgtcaaagacgacgccgggcgcgacgtagttctcacagaaaggcaagccatggacaacatctggggcgacaaccccgcgctccaacgagccgtaacagacgcgcgagagctcccgccataccaagaagtactgggaagaaggatcccaccgggaacgggcaaacccgccgacccatacgacgtacaaaagggaagactaacaaacccaacggtacatatcgggttaaaccaactaaaacgcatcgtgaacgtcctaatgcgacgacacgggagacctgaacagatagcactagagctagcaagagacctcaaactgaacgaagaacaaaaagcagagaaaaaccgcgaaatcgcaaggaacaccaaagcagccgaagctagaggtaagaaattagaggaactcggacacgccaataacggatacaaccgcgtactactcaaactctgggaggacttaaacctcaagcagccagaaaacagagaatgcatctactgcgggaaagctataggaataggaacactactaagcaaccaagtagacattgatcatatacttccatggagcaaaacgctcgatgacagtcaagcaaacaggatcgtgtgccatgtagagtgcaacagacaaaaagggaaccacgcaccagcagaggtaccacaatggcacgaccgttacgacgacattttggcccgagccgagagactaccacgaaacaaagcgtggagattcgggagggaagcaatgaagaaattcaaagacgacgagagcttccttgcgcgacagctgacggacactcaatacctaagcagattggcccacgaatacctaggagcgctctatccagacgaagaaccggacgaatggggcggcccagcgagaagaaaccacgtcagggtaataccaggccgcatgaccgaaatgctacgaagacaatggggcttaaacgccataatctcggaccacaaccagaaaaaccgaaacgatcaccgccaccacgccatagacgcaatagtagtgggggtgacaacacgaagactcttacaaaggatcgcgaccgtggcgggaggcagagaagccctagcactggaagaaacgataggtaaaattgaaccaccatggccaggcttctacgacgacgtaaaggccgccatagaccgcatagtcgtaagccacaaaccggaccacgggtcgctaccgaaacctggcaaaccaggacgcacagcagggcaactacacaacgacaccgcatacggctttacaggcgaagcaagaaacggggtgccaataatggtccaccgagtacccttcgcatcactaaccgaaaaagacataccaagcattagggacaggcaactcgccgatgctctatacgcggcgatctcaggaataagcgggaaagcggaactagccgcagcactagcacggttctcagaaagcggaccgtacaaagggatcagacacgtaagagtggtagagcccgtaagcgtcatagccataaaagaccaagcgggcaaagcctacaaaggatataaaggagatgcaaactaccgctacgacgtatgggaactgccaaacgggaaatggacgcacgaagtcgtaagtatgtttaacgcgcaccgcccggactggcaatcggaaatacgaagtaagaacccagcggccaggaaagtcctgagcctgcaccaaaacgatatggtcgcgtacgaacacccacaagacggctatactataggcagagtcgtaaaattcagcgcgggcggccagatggcactggcaggcaacagagaaggaggagccctgaaaagcagagacgccgacccggaagatcgattccgctacttttacaaatcaggaggggccatgagggacgtccagctaagacaggttcgtgtagacgaaaccggcagggtctttgaccccggaccccaagaccgagagtcaagaaacgcacgaaaacaaaacgacgccggatga

SEQ ID NO: 6205 - RNA, 3264 nt, synthetic construct
  misc_feature 1..3264: note = Cas9 variant
  source 1..3264: mol_type = other RNA
atgcgctacaagatcggcctcgacatcggaataacctccgtcggctgggcagtaatgaacctagacatcccccgaatagaggacctaggagtgcgaatcttcgaccgggccgaaaacccccaaacgggcgaaagcctagcgctaccccgacgcctcgcgcggagcgccagacggcgcctgcgacgcagaaaacaccggctggaacgcatccgaagacttgtaatccgagaaggcatcttgacaaaagaagaactcgacaagctgttcgaggaaaaacacgagatagacgtatggcaactgcgcgtagaagcactcgaccgtaaacttaacaacgacgagctcgcaagagtcctactccacctcgccaaacgacgcggatttaagagtaaccgaaaatccgaacgcagcaacaaagagaactccacaatgctaaaacatatcgaggagaaccgcgcaatactatccagctatcgaaccgtgggcgagatgatagtaaaagacccaaagttcgctctacacaagagaaacaaaggcgaaaactacactaacaccattgcgagggacgacctcgaacgagaaatcagactcatctttagcaaacaacgcgagttcggcaacatgtcatgtacagaagagttcgaaaacgaatacataaccatatgggcgagtcaacgcccggttgccagcaaagacgacatcgaaaagaaagtaggattctgcacctttgagcctaaagaaaagcgagcacccaaagccacatacaccttccagagcttcattgcctgggaacacattaataaacttcgcctcataagcccctccggggcgcgcggccttaccgacgaagaacggcgcctactatacgaacaagccttccagaaaaacaaaataacctaccatgacatccgcaccctcctccacctccccgatgacacttacttcaaaggcatcgtctacgacagaggggaatcccgaaaacaaaatgagaacatcagattcctcgaactcgacgcctatcaccaaatcaggaaagccgtggacaaagtgtacggtaaaggaaaatcatcctccttcctacccatcgacttcgacaccttcggctacgcactcacattattcaaagacgatgcagacatacacagctacctgagaaacgaatacgagcaaaatggtaaacggatgcccaacctagcaaacaaagtatacgacaacgaactaatcgaagaactcctaaacctgtccttcacgaaattcggccacctttcacttaaggccctcagatccatcctaccctatatggaacaaggcgaagtatattctagcgcatgcgagagagccggatacacctttaccggacccaaaaagaaacagaaaaccatgttgctcccaaatattcccccaatcgccaaccccgtagtgatgagagctctgacccaagcccgcaaagtcgtaaacgccatcataaagaaatacggctcccccgtatctatacacatagagctcgcacgagacctcagccaaacattcgacgaacgacgaaaaaccaagaaggagcaagacgaaaatcgcaagaaaaacgaaacagctatcagacaactcatggaatacggcctaaccctcaaccccaccggccatgacatagtaaaattcaagctgtggagcgagcaaaacggacgctgcgcctacagcctccaaccaatagagatagagcgactactagagccaggttacgtcgaagtcgaccacgtaatcccctatagccgcagcctagacgattcctacacaaacaaggtgctagttctaacccgcgaaaaccgagagaagggtaaccgcataccagccgaatacctcggcgttggcacagaacgctggcaacaattcgagaccttcgtactcacaaacaaacaattcagcaaaaagaaaagggaccggctactccgcctacactatgacgaaaacgaggaaaccgagttcaaaaaccgaaacctgaacgacactcgctacatatctagattcttcgcaaacttcataagagaacacctcaagtttgcggaatctgacgacaaacaaaaggtatatacagtgaacgggcgggtcacggcacacctacgttcacggtgggagttcaacaaaaacagagaagaatccgatctacaccacgctgtggacgcagtaattgtcgcctgcaccacgcccagtgacatcgccaaagtaacagcattctaccaaagacgagaacaaaataaagaattagcaaagaagaaagaaccccacttcccgcaaccgtggccacacttcgccgacgaactccgcgcacggttatcaaaacaccccaaagaatcgataaaagcactgaacctcgggaactacgacgaccaaaaacttgagagcctgcaacccgtctttgtatcccggatgcccaaacgatccgtcacaggcgctgcacaccaagaaaccctccgacgctacgtaggcatcgacgaaagatccgggaaaatccaaacagtcgtaaaaacaaaactcagcgaaataaaactggacgcgtcaggacacttccccatgtacgggaaagagagcgatccgcgcacatacgaagccatccgacaaagactattggaacacaacaatgaccccaagaaagccttccaggaacccctatacaaaccaaagaaaaacggggagcccgggccagtcatacgcactgtcaaaatcatcgacacgaaaaaccaggtcattcctttaaacgacggcaaaacggtcgcatacaacagcaacatagtgcgtgtagacgtcttcgaaaaagacggaaaatactactgtgtaccggtatacacgatggacatcatgaaaggcatactacccaacaaagcaatagaacccaacaaaccatacagcgaatggaaagaaatgacagaagactacacatttcgattctcactctaccccaacgacctaattaggattgagctgccacgcgagaaaaccgtgaaaacggccgccggagaagagatcaacgtgaaagacgtcttcgtctactacaaaacaatagactcagcgaatggaggcctagaactcatctcccacgatcaccgcttctccctacgaggcgtcggaagtaggaccctcaaacgattcgaaaaataccaagttgacgtcctaggtaacatctacaaagtccgaggggaaaagagggtagggctcgcctcctcggcacactccaaacccggcaagaccatccgcccgctccagagcacaagagactga

SEQ ID NO: 6206 - RNA, 3264 nt, synthetic construct
  misc_feature 1..3264: note = Cas9 variant
  source 1..3264: mol_type = other RNA
atgctccgcatgaaatacgccataggccttgacatcggcatagcaagcgtcggctacgccgtcttggcccttgaccacgaagaaaacccgtggggcatcatacgtctagggagccggatcttcgacgtcgcagaaaacccaaaagacggggcctcacttgcactcccccgacgcgaagcccgcagcgtccgacggaggttacggagacatcaccatcgcctagaacgcattaaaaacctccttataaacaccgagttcataacaaaagacgaactcctacacctatacgacggtaacctatccgacgtctacgagctccgcgtcaaagcgctcgactactcagttaccaacgccgaactcacacgcattctactgcacctggcccagcggcgcgggttcaaaagcaaccgaaaatcagatgccaacgacaaagaagccggccaactcctcgaagcagtctctgcaaatgcaaagcgaatgcaagaaaaccactacagaacggtaggagaaatgttctacaaagacgatctcttttccaagtataaacggaacaaagggggcacttacctcaccaccgtccaccgagacatgatcgctgccgaagcccgcaccatcttggaaaagcagtttgccctaggcaacaacatatgcacccaggacttcatcgacaagtacctaagtatcctcctgtcccagcgacaattcgacgaaggccccggcgaaccgtcgccctacgcaggcaatcaaatagcgaacatgatcggaaagtgtacattcgaacccaatgagtaccgagccgcaaaagcatcttactcgttcgagaggtttaaccttctacaaaaggtaaaccacctacggcttctcctagaaggcaagtccatcgcactagacaatgaacaaagaaagaaaatcatcgccctggcccacgacaaagccgatctccgctacagccacatccgcaaagccctcggcctcgatgaaaaagtcctcttcaacacgataacctacaacgacgacgtttccgtaatcgagaaaaagactaaattcaactttctccaagcataccaccaaatcaagaaagtactagcagaagatatgcaaaagctcaccaccgaacaactagacaacatcggtcaaatactctccacgtacaaatcagacaacaaaagaacagaagaactatccgccctcggcctcgaaaagaaaataatagacgcactacttggaataaacggactgagcaaatttgcccacctatccctcaaagcgctacgcaaaataaacccctacctcgaagaagggaaaatatacaacgaagcctgcacagcagccggctacgacttcaaagcccacgccaacacacaaaagaccgaactcttacccgcatacaaagaagaaatggacgacatcacctcccccgtcgcccgtcgcgcgatcgcccaatccataaaagtaatcaacgcaatcatacgtgagcagaaaggcagcccactctacatcaacattgaactggccagagaaatggccaaaggtttcgacgaacgcacacaaatagacaaagctaacaaagagaaccaggcaaagaacgagcgaatcatggagcgcatccgaaccgagttccacaaagcaaacccaacaggaatggaccttattaagctcaagctctgggaagaacaggacggtcgttccccatacagccaaaaagccatctctataaaccgcctcttcgaacccggctacgtcgacatagaccacattgtgccctacagcatctcatttgatgactcattcaaaaacaaagtcctagtgtttagcgacgaaaaccgtgataagggaaatcgactcccaatcgcatacctacaatcaaagttcggcgccaaagccgctgaaaacttcatgatctgggtccagtcaaacataaaagattacaagaaacgacagaagctcctgaaaagggaaatcacagaagaagatatcaataaatttaaagagcgcaacctccaagacaccaaaaccatctcccggtttctctacaactacatcaacgactacctactcttcgctccctcagacaccggcaaaaagaaaagagtcaccgcggtaaacggaaccatcaccgcctacctccgaaagcgatggggcataaacaagatacgcgctaacggcgacaaacaccacgcagtcgatgccgtcgtaatcgcctgtaccaccgacaaaatgatcaaggaccttagctcgttctcaagatatcacgagctcgaatacacgcacaccgatacagagagctttctagtcaactcactgacaggggaaatactaaaacggttcccctacccctgggaggacttccgccccgaactgatggccaggctttccgacaatccagccgacgccttacggaaactaaacttaatattctaccacggcatcgacctaagcactataaaacccatattcgtctcccgtatgcctcggcacaaagtgaccggcgccgcccacaaagcaaccataaagtcagcaagatgccttgacaacggcatcgtaatctgcaagacctcactccaaaacctaaaactagacaaagaaggagagattgctaactattacgcacccgaatccgacactatactctacaacgcacttaaggaaagactgaggagctacgacaacaaaccagccaaggccttcgccgaaccattctacaagccaaaagccgatggcacgccaggtccactcgtcaagaaagtaaaagtatacgaaaaatcaaccctaaatgtcgcagtccaacaaaacaccgcggtcgccgacaacgacagtatggttcgtgtcgacgtcttccacgtcaaaggcaacggatactacctcgttcccatatatatcgccgacaccctaaagaaagagctcccaaacaaagccatcgtcgcatacaaaccctacgcagattggccggtgatggatgactccaacttcatcttttcactataccccaacgacctaataaaatttgaacacaaaaattccgtaaaatttgcaaaagtcaacaaagaatccacactcaacgacttctactccacgaaatccgagatagtctacttcaaaggttgtaacatcaacaccggggccatcaccatcataaaccacgaaaacacatatgtggttagcagcctcggcgtcaaaaccctcccgtcactggaaaaatatcaggccgatgtgctcggaaactacaccaaagttaagaaagaagttcgcaaacccttccgctga

SEQ ID NO: 6207 - RNA, 3264 nt, synthetic construct
  misc_feature 1..3264: note = Cas9 variant
  source 1..3264: mol_type = other RNA
atgcgttacaagataggactcgacatcggcatcacaagcgtcgggtgggccgtaataaacctcgacatcccacgaatcgaagacctgggagtgcgtatattcgatcgcgccgaaaacccacagaccggagagtccctcgcactcccacgtcgcctagcccgaagcgcaagacgccgtctacgccgacgcaagcacaggctagaacgaatccgccgactcatcatcagggaaggcatcctcacaaaagaagaacttgacaaattattcgaagaaaaacacgaaatagacgtctggcagcttcgagtagaagcgctagaccgcaaacttaacaacgacgaactggcccgggtactgctacacctcgccaaacgcagaggcttcaaaagcaaccgaaaatccgagcggagcaataaagaaaattcaaccatgctaaaacacatagaggaaaaccgagctatcctgtcgtcctatcggactgtgggagaaatgatcgtaaaagaccccaaattcgccctacacaaacgaaataaaggagagaactacactaacacgatagctcgcgacgatctcgaacgggaaatccgattaatattctccaaacaacgcgagttcggaaacatgagctgcaccgaagagttcgaaaacgaatacatcgcaatatgggcttcacaacgcccagttgcatcaaaggacgatatcgaaaagaaagtcggcttctgtaccttcgaacccaaggaaaaacgagcccccaaagccacgtacaccttccagagcttcatcgcctgggaacatataaataaactccgcctaatctccccctcaggaacacgaggcctgaccgacgaagagagaagactactctatgagcaagccttccagaaaaacaagataacataccacgacataaggacactactacatctacctgacgacacatacttcaaaggaatcgtatacgaccgtggcgaatcccgtaaacaaaatgaaaacatacgcttcctagagctcgacgcctaccaccaaatccgcaaagcggtcgacaaagtctacggcaagggaaaatcatcgtcattcctcccgatagacttcgacaccttcggatacgcactaacattgtttaaggacgacgccgacataagatcataccttcgcaatgaatacgaacaaaacggcaaacgaatgccaaacctggcaaataaggtctatgacaacgaactaatagaagaactattaaacctcagcttcaccaaatttggacacctctccctaaaagcactccgcagcatcttaccatacatggaacaaggagaagtttactccagcgcatgcgaacgagcaggctacacgtttaccggaccgaaaaagaaacaaaagaccatgctcctcccaaacattcccccgatcgcaaaccccgtcgtcatgcgagccctaacgcaagcccgaaaagtagtcaacgcaatcatcaagaaatacggaagccccgtcagcatacacatcgaactagcgcgcgacctatcgcaaaccttcgacgaacgtcgaaaaacaaagaaagaacaagacgaaaaccgtaagaaaaacgaaacagccatcagacaactcatggagtacggactcaccctaaatccaaccggccatgacatcgtaaaattcaaactctggtcggaacaaaacggccgatgcgcatacagcctacaaccaatcgaaattgaacgactcctagaaccaggatacaccgaagtagaccacgttatcccatactcgagatctctcgacgacagttacacaaataaagtcctcgtcctcacaaaagagaaccgcgaaaaaggcaaccgaatccccgccgaatacctcggagtcggaacagaacgctggcagcaattcgaaacattcgtcttaaccaacaaacaattctcgaagaagaaacgggaccgacttctccgactacactacgacgagaacgaagaaaccgaatttaaaaaccggaacctaaatgacacaagatacatatcccgcttcttcgccaacttcatccgcgaacacctcaaattcgccgaatccgacgataaacaaaaagtttacaccgtcaatggcagggtgaccgcccatctacggtcaagatgggagttcaacaaaaaccgggaagaatctgatctccaccacgcagtcgacgctgtgatagtcgcatgcacaaccccctccgacatagctaaagtgaccgccttctaccaacgccgcgaacaaaacaaagaactcgccaagaaaaccgagccccacttcccgcaaccctggccgcacttcgccgacgaactacgcgcacgcctaagcaaacaccccaaagaatcgatcaaagcactaaacctgggcaactacgacgaccaaaaactcgaaagcctacaacccgtgtttgtctcccgaatgccgaaacgcagcgtaactggtgcggcgcaccaagaaacactacggcgatacgtcggcatagacgagcgatcaggaaagatacaaacagtcgtcaaaaccaaactaagtgagatcaagctagacgcaagcggacactttcccatgtacggaaaagagagcgacccacgcacgtacgaggccatacggcagagactcctcgaacacaacaacgaccctaaaaaggctttccaagaaccactttacaaacccaagaagaacggcgagcccggtcccgttatccgcaccgtaaagatcatcgataccaaaaaccaagtcatacctcttaacgacggcaagacggtagcatacaacagcaacatagtccgagtggacgtattcgaaaaagacgggaagtactactgcgtcccagtatacaccatggacatcatgaaaggcatactgccaaacaaagccatagaaccaaacaaaccatacagcgagtggaaagaaatgaccgaagactacacattccgcttctccctataccccaacgacctcatccgcatagaactacccagagagaagatcatcaaaaccgcgggaggcgaggaaattaaaatcaaagacctcttcgcctactacaaaaccatccacagcgggacggccggtctcgaacttgtaagccacgactgcagcttcagcctaagcggggtcggcagtcggacactaaaaagattcgaaaaataccaggtggacgtactgggcaacatctacaaagtgcgaggggagaaacgggtcggtctagcttccagcgcacactccaagaccggtgaaacaatccggccactccaaagcacacgcgactga

SEQ ID NO: 6208 - RNA, 3264 nt, synthetic construct
  misc_feature 1..3264: note = Cas9 variant
  source 1..3264: mol_type = other RNA
atgcggtacaagataggcctcgacatagggataacgagcgtaggttgggccgtcatcaacctcgacctaccccggatagaggacctaggcgtgcgcatattcgaccgtgccgaaaatccccagacaggggagtccctcgccctaccccgcaggctagcacgctcggcccgccgacgtctgcgacgccgaagacaccgcttagagcgaatacgaagactactaacgcgagagaacgtcctaacgcaagaggaactggacaaactgttcgaaaagaaacacgaaatcgacgtctggcaactcagggtcgaggccttagacagaaaactcaacaacgacgaactagcccgtgtccttctccacctggctaaaagaagaggattcaaatcaaatcgcaaatcagagcggtccaacaaagaaaactccaccatgctaaaacacatagaggaaaacaggagcatcctcacaggctatcggaccgtaggcgaaatgatagtgcgggacccgaaattcgtactccataaacgcaataaaggcgaaaactacaccaacaccatagcacgcgatgatctcgaacgtgaaatccaactcatattcgccaggcaaagggagttcgggaacatgatctgcaccgaagccttcgagaacgaatacatcgccatctggtcctcccaacgacccgtcgcctccaaggatgacatagaaaagaaagtaggcttctgtaccttcgaaccgaaagaaaaacgcgcacccaaagccacgtacaccttccagagcttcatagcgtgggaacacataaacaaactaagactcgtatccccctctggcacacgggaactcacagacgaagaacggcggctattgtacgaacaagccttccagaaaaacaaactaacctaccacgacataagaaccctgctgcatctcccagacgacacatacttcaaagggatagtctacgactggggagaaccactaaaacaaaacgaaaacatccgcttcctagaactcgacgcgtaccatcaaattcgcaaaacagtagacaaagtctacgggcgcggaaaaagcagctccttcttgcccatagacttcgacacatttgggtacgccttaactctctttaaagacgacgcccacatccgctcctacctccgcaacgaatatgaacaaaatgggaagcgaatcgcaaacctagccaacaaagtctacgacaatgaactgatagaggaactcctcaacctctcattcaccaaattcggacacctctctttaaaagccctacggaacattctcccatacatggaacaaggcgaagtctactcgtcggcctgcgaaagagccggctacaccttcacaggccccactaaaaagcaaaagaccgtcctcttacctactataccaccaatcgctaacccagtcgtaatgcgcgcgcttacacaagcacgaaaagtcgtcaacgccatcatcaaaaagtacgggagcccagtcagcattcatatcgaactagcacgagacctcagccagactttcgatgaacgcaagaaaaccaagaaagaacaggacgagaaccgaaaacgaaatgaaaccgctataaggcagctcatcgaatatggcctaaccagaaaccccaccggccatgacatcgtcaaattcaaactttggtcagaacaaaacggccgctgcgcctactcactccagccaatcgaaatcaaacgactactcgaaccgggctacgtagaagtagaccacgtcatcccgtacagcagatcgctcgacgactcctacaccaataaagtactcgtactaaccaaagaaaaccgcgaaaaaggcaaccgaatcccagcagaatacctgggagtcggtaccgagcggtggcagcagttcgaaacattcgtactaacaaacaaacaattctccaaaaagaaacgcgaccgcctactccgacttcactacgatgagaacgaagaagcagaatggaaaaaccggagcttaaacgacacccgatacatcagcaggttcttcgcaaacttcatacgagagcatctgaaattcgccgacagcgacgacaaacagaaagtgtatacggtcaatggcggcgtcaccgcgcacctacgctctcgatgggatttcaacaaaaaccgcgaagaaagcgacctgcaccacgccgtcgacgccgcgatagtagcatgcacaacgctctcggacatagcgagggtaaccgccttctaccaacgacgagagcaagcaaaagaactggccaagaaaacagaaccccatttcccccaaccatggccccacttcgcggacgaactccgagcacggctcagcaaaaaccccaaagaatcaatcaaagccctcaacctaggcaactacgacaacgagaagctagaatctctgcaaccagtattcgtatcccgcatgcctaagagaagcgtgacaggagcagcccatcaagaaacactacggagatacataggtatcgacgaacgttcaggtaagatccaaaccgtcgttaagaccaagctcagcgaaataaagctcgacgccagcggccacttccctatgtacgggaaagaatccgacccccgcacctatgaggcaatacggttacgcctacttgaacacaacaacgatcccaggaaggcctttcaggaaccgttatacaagccaaagaaaaacggcgaactcggccccatcataagaacagtaaaaatcatagacaccaaaaaccaggtgatcccgcttaacgacgggaaaacagtagcctacaactccaacatcgtccgagtggacgtcttcgaaaaagatggaaagtactactgcgtaccggtctacacaatggacataatgaaaaaggtcctgcccaacaaagccatagagcccaacaaaccctactcagaatggaaagaaatgacagaagattacacattccgattcagcctctaccccaacgacctcatacgcatcgagctccctcgtgagaagacagtcaagacgacggccggtcatgagatcaatatcaaagacgtcttcgtatactacaagacaatagactcagcaacaggaggcctagaactgatcagccatgacaacagcttctccctacgtgggataggctcgcgcaccctcaagcgcttcgaaaaataccaggtagacgtcctaggcaacatctacaaagtgcgcggagaaaagagagtcggactcgctagcagcgcgcatcctgaaacccgcgaaacaatccggcccctgcaaagcacccgtgactga

SEQ ID NO: 6209 - RNA, 3264 nt, synthetic construct
  misc_feature 1..3264: note = Cas9 variant
  source 1..3264: mol_type = other RNA
atgaaaaagctagtcctaggcctagacataggagtggcatccgtgggctggggaatcatcgacgccgagaacggcgacgtcgtagacaccggggtccggcttttcagctctcgagacgcctcagaaaatgagagcaggcgcacaagccgccagtcacgacgcctctcacgccgaaagaaacaccgcagagaacgaatcaaacaattacttctggcccacgatatggacatctgcgacatcgtaaacgaaaacccgtatgaactaagagtcaaaggcctaaacgaaaaattagaagtctccgaaatctacgtagcgctaacccacctcgccaaacgacgcggtgtctcctacctcgacgacgtagtcgaagaaggcggaaccatcaaatccgaacacttgaacaaaaacatggaagaaatcaaatcaggcaaaatgccatgcgagatacaacttgaaagatttgaaaaatacggccaagtccgaggtatgatcgaaatcaaccaggatactgaagaaagttccttcctagtgaacatcttcagaacttcggactacataaaagaggccaaaaccatcctagcgacccaacagaagtttcacaaacagattaccaacgagttcatcgatgagtacatacacatcatggcatcaaaacgagactatttcattggccctggaaacgagaaaagccgaaccgattacggcgtataccgcacgaacggcgacacatgggacaacttattcgaaatcctcataggcaaatgctcagtatttccggaagaaacacgggcagcgcgctccagctacgtcgcacaggagttcaaccttctaaacgacctcaacaacttaaagatcagtaatctcgaaagcggcaaactcagtgcctcacaaaagcacgacatcgtggaaaaggtcaagaacagcaagaaattcggcaccaaagacctgctaaaatatatagcatccgtgtgcgaatgcaaaatcgaggacattggaggatgccgagtagacaaaaatcgcaaacccataatgcacaccttcgaaaattacaggaaagtacacaacgccctcaatgaagccggtgtagacctacgcctgtcggaaaccgattacgatgagctaatgaagatcatgacactcaacagcgaaaccctggaaatcaagaaacagtgcaaagaaaaactaccacagctcaccgaggattacctcaacgtatgcttggtcttaaacaaaaagggtgcgttcagcggatggcacgccctaagcctcaaagcaatgaaactcatgatgcctgaactatacggaacctcgaaaaaccagatgcaaatcatccacaccatgcaactaggcaaagcctatctaaagcccctaaaccaacaaaaatacctaaactcggaagccatcctcgaagaaatctacaaccctatcgccgctcgaagcatacgccaaacgatcaaagtcaccaacgccatactaaagaaatacggccacctagacagcgtcatcatcgagatgcccagggactaccaaacatccgaggacgagcgaaaaatgatcgaaaagatgcagaaagaaaacgaaaaagagaagaaagcagcgctcaaacgcgctcgcgaagaatacccgttccccgacgaagccttccgaaaccacaaagaactcgcaacaaagctacgactctggtaccaacaagatcagttctgcgtatactccggccgcaagatcagcgtagtcgaccttgtacgcaaccccaaccaattcgaaatcgaccacatcatcccccagtcagtaagtctagacgactccctaaacaacaaagtcctttgcttcagtgaggagaaccaaaagaaaggacaacaaacgccgttctactatcacaaaggcaagtctggtaactggacttatgaacagtacaaactattcgtagagaagttgttcgacaagaagaaaataagcaacaagaaacgggaactcctactcttcgaagaggacatcaacaagtgggacgttcgccgcggcttcatagcacggaatctagtcgacactagatacgccagccgagtgatactaaactcataccaacagtacttcggcaaccatgaaatgggcacaaaggtaaaggtagtacgcggcaaattcacatcccaactacgcaagaagtggcgcatattcaaggaccgcaacgaaagccattcacaccacgccatcgacgcactaatcgtcgcagccaccgcaaacctacgcctatggaagaaaaacaccctcggcgtaagcgacgagggcaaagtttacgacaaagaaaccggcgagatcctcccattcgagaaactgacggaatcggaatataacgaaatgatgaataaggaaccatacctcaacttcaaaacgaaactccagaacatagaaaccaaagttaagtactcatacagagtaagcaagaaagtcaaccgcaaaatctccgatgcgacgatatactcaacccgagaacgcgatggaatcgactacatcgtgggaaagatcaaaaacatctacgacgtcaagacatacaaagaccaattcctcaaacgctacaaaaagaacaaagaacagttcctaatgtaccaacacgacccccaaacgttcgccatactcgagaacataatggccacctaccaagacgctgaaaacccgttcctagcctacaagaaagaatacggggtcataagaaaatacagcaagaaaggcggtggaagcccagtcacatcgcttaaattcatcgacaaagtgttgggccagaaaatcgacctgaccgccaaaaaccaagcagccctcccgaaaaacaagaaagtggtcctccagagcatcacaccctaccgcgcagacgtttactacgacgagatcgacaaaagataccatctcatcggcgtcaaatacagcctcttctcgttctcaaaacagggatacgtgataaatccaatcgcgtaccagaaactgctcgagaaagagcaaatccactcagaaatgaaattctgcttcagcctctatcgggaggatatcatcgagttcggggaagacccggactcactgacccgctaccggttctggtcgaaaaacgaaagcggaaagaacaaaatagaggtcaaaccgatcgaaaagccaaacttcgaaaaacaaaccgtcctaaccatcacgaaaaagatcaaaatactcaacaaataccaaacagacgtactgggaaactcgttcaaagcacaagaggaaaaagacccgcgcaacatcgaatga

SEQ ID NO: 6210 - RNA, 3264 nt, synthetic construct
  misc_feature 1..3264: note = Cas9 variant
  source 1..3264: mol_type = other RNA
atgcgctacaaaataggcctagacataggaatcaccagcgtcggatgggcggtcatgaacctcgacatccccaggatcgaagacctaggtgttagaattttcgaccgagccgaaaacccccaaaccggagaaagcctagccctaccccgaaggcttgctcgctcagctcgccgcagactccgacgccggaagcaccgactcgagcgaatccgacggctagtcattcgagaaggcattcttacaaaagaagaactcgacaaactattcgaggagaaacatgagatcgacgtatggcaactgcgagtcgaagcccttgaccgaaaacttaacaacgacgaactcgcacgggtactcctccacttagcgaaacggcgaggctttaaatccaaccgtaaaagcgaacggtcgaacaaggagaactcgaccatgctcaaacacatcgaagagaaccgagccatcctatcatcgtaccggactgtaggcgaaatgatcgtaaaagacccgaaatttgccctccacaaaagaaacaaaggcgaaaactacacaaataccatcgcgcgcgacgacctagaaagagaaataagattgatcttctcaaagcagcgagagttcggaaacatgagctgcacagaagagttcgaaaacgaatacataacaatctgggcaagccaacgccccgtagcctccaaggatgacatcgaaaagaaagtcggcttctgcaccttcgaaccaaaagaaaaacgagccccgaaggccacttacaccttccagagcttcatcgcctgggaacacattaacaaactccgcctaatctcaccctcaggcgcccgcggcctcaccgacgaagaaaggcgccttctgtatgagcaagcattccagaaaaacaaaattacctaccacgacattcggacacttctacacctccccgacgacacctacttcaagggaatcgtttacgaccgcggcgaatcccgaaagcaaaacgaaaacatccgcttcttagaactagacgcgtaccaccaaatacgtaaggcggtcgacaaggtctacggcaaaggcaaaagcagcagtttcctacccatcgactttgacaccttcggatacgccctcacactcttcaaagacgacgcagacatccacagctacctcagaaacgaatacgagcaaaacgggaaacgcatgcccaacctcgcgaacaaggtctacgacaacgagctaatagaagaacttctaaacctatccttcacgaagttcggacacctatccctcaaagcacttcgcagcatacttccctacatggaacaaggagaagtatactccagcgcgtgcgagcgggccggctacaccttcaccggccccaagaagaaacagaaaacaatgctactcccaaacatacccccaatcgcgaacccagtcgttatgcgggccctcacccaagcccgaaaagtagtgaacgcaatcatcaagaaatacggcagcccagtttcaatccacatcgaactcgcccgggacctctcccaaacattcgacgagcgacggaaaaccaagaaagagcaggacgaaaaccgaaagaaaaatgagacggctatacgacagctcatggaatacggcctcacactaaatcctaccggccatgacatcgtaaaattcaaactatggtcagaacaaaacggaagatgcgcatactcccttcaacccatcgaaatcgaaaggctccttgaacccggatatgtcgaagtagaccacgtcataccgtactctcgatctctagacgactcctacacaaacaaagtcctcgtcttaacacgcgaaaaccgagaaaaagggaaccgcataccagcggaatacctcggcgtaggcacagaacgatggcaacaattcgagaccttcgtcctaacaaacaaacaattctccaaaaagaaacgagaccgcctccttcgactacactacgacgaaaacgaagaaactgagtttaaaaaccgaaacctcaacgacacacgctacatctcgaggttcttcgcaaacttcatacgggaacaccttaaattcgccgagagcgacgataaacagaaagtatacactgtcaacggacgagtgacagcacacctacgctcgcgatgggagttcaacaaaaaccgcgaagaatcagacctccaccacgcagtcgacgccgccatcgtcgcttgcacaaccccatcagacatcgctaaggtcaccgccttctaccaacgacgggagcaaaacaaagaactagcgaagaaaacagaaccacacttcccccagccctggccgcacttcgcggacgaactgcgcgccagactaagcaaacaccctaaagaatccatcaaagcgctaaacctcggaaactacgacgaccaaaaactagaaagcctccaacccgtattcgtatcccgaatgcccaaacgctccgtcaccggtgcagcacaccaagaaaccctacgccggtacgtaggcatcgacgagcgctcgggaaaaatccaaaccgtagtaaaaacaaaactatccgaaatcaaattagacgcctcggggcactttcccatgtacggcaaagaaagcgacccccgcacctatgaagcaatccgccaacgcctcctcgaacacaacaacgacccaaagaaagcctttcaggaacctctgtacaaacccaagaaaaacggggaacccggcccagtaattcgaaccgtcaaaatcattgacaccaaaaaccaagtaataccacttaacgacggcaaaaccgtggcgtacaacagcaatatagtcagagtagacgtattcgagaaagacggaaaatactattgtgtaccggtatacaccatggacataatgaaaggcatactccccaacaaggccatagagcccaacaaaccctattcagagtggaaggaaatgacggaggactataccttccgcttctccctctaccccaacgatctaatacgcattgagttacccagggagaaaaccgtcaaaacagcagcaggcgaagaaattaacgtgaaggacgtcttcgtctactacaagaccatcgactccgccaacggcggattagaactcatcagccacgatcatcgtttcagccttagaggcgtcggaagcaggacactcaaacgttttgaaaaataccaagttgacgtcctcggcaacatatacaaagtacgcggtgaaaaacgggtcgggctggcaagttccgcccacagcaaaaccggagaaacagtacgcccactccaaagtacccgcgactga

SEQ ID NO: 6211 - RNA, 3264 nt, synthetic construct
  misc_feature 1..3264: note = Cas9 variant
  source 1..3264: mol_type = other RNA
atgcgctacaaaattgggttagacatcggaataacgtcagtaggctgggcggtaatgaacttggacatcccgcggattgaagacctaggcgtgcgcatcttcgaccgcgcagaaaacccacaaacaggcgagagcctcgcgctacccagacgcctcgcacgatccgcccgcagacgcctccggcgccgcaaacaccgtctcgaaaggatacgccgcctagtcataagagaaggaatactgaccaaagaggaactagacaaactcttcgaggaaaaacacgaaatcgacgtatggcaactccgtgtagaagccctagaccgcaaactaaacaacgacgaactcgccagggtactcctccacctcgcaaaacgacgaggattcaaaagcaacagaaaaagtgaacgctccaataaggaaaactcaacaatgctgaaacacatcgaagaaaatcgagccatcctcagctcataccgtaccgtaggagaaatgatcgttaaagaccccaaatttgcactacataaacggaacaagggagaaaactataccaacacaatagcccgcgacgacctggaacgagaaatccgccttatcttcagcaagcaacgagagttcggaaacatgagctgcacagaagaatttgaaaacgagtacatcacaatatgggccagccagcgccccgtagcatccaaagacgacatcgaaaagaaagtaggcttctgtacgttcgaaccaaaagagaaaagggcccccaaagccacctacaccttccagtccttcatcgcctgggaacacatcaacaaactgcgcctaatatccccatcgggcgcccgcggactcactgacgaagaacgccgcctgctctacgagcaagcatttcagaaaaacaaaataacctaccacgatatcagaaccttactgcacctaccggatgacacatacttcaaaggcatcgtttacgaccgcggagagtctcgcaaacaaaacgaaaatatacggttcctcgaactcgatgcctaccaccaaatcagaaaggcagtcgacaaggtctacggcaaaggcaaatcatcatcctttctcccgatcgacttcgacaccttcggctacgccctcacccttttcaaagacgacgcagacattcacagctacctaaggaacgagtacgaacaaaacgggaaacggatgccaaacctagcaaacaaagtctacgataacgaactaatagaggaactgctaaatctcagcttcacaaagtttggacacctatccctgaaggccctccgatccatcttaccgtatatggaacaaggagaggtctactcaagtgcatgcgaacgcgcgggctacaccttcaccggacccaaaaagaaacagaaaactatgctcctacccaatatcccgccaatcgccaatcccgtagtaatgcgggctcttacacaagcacggaaagtcgtcaacgccataatcaagaagtacggatcacccgtatcaatccacatagaactcgccagagatctatcccaaacatttgatgaaaggaggaaaaccaagaaagaacaggacgaaaaccgcaagaaaaacgaaacagccatcaggcaactcatggaatatggactcacgctcaacccaaccgggcatgacatcgtcaaattcaaactctggagcgaacaaaacggccgatgtgcctactccctccaaccgatcgaaatcgagcgcctcctcgaacccggatatgtcgaggtcgaccacgtaatcccctactcccgctcacttgacgacagctacacgaacaaagtcctagtacttacacgcgagaaccgcgaaaaaggaaaccggataccagcagaatacctaggcgtagggaccgaaaggtggcaacagttcgaaacattcgtactcactaacaaacagtttagcaaaaagaaaagggacagactcctccgactgcactacgacgaaaacgaagaaacagagttcaaaaatcgaaatttgaatgacacccgatacataagcagattcttcgcaaacttcatacgagaacacctcaaattcgccgagtccgacgacaaacaaaaagtatacacagttaacggcagagttacggcccacctaaggagcagatgggaatttaacaaaaaccgcgaagaatcagacctacaccacgccgtagacgcagtcatcgtagcctgcaccacaccctccgatatcgcgaaagtcaccgccttctaccaacgacgagaacaaaacaaagagctagctaaaaagacagaaccgcacttcccacagccgtggccacacttcgcagacgaacttcgtgcccgcctgagcaaacaccccaaggaaagcatcaaagcactaaacctcggaaactatgacgaccaaaagctagaaagcctgcagccagtattcgtcagccgcatgccgaaacgaagcgtcacaggcgccgcccaccaggaaacactacgcagatatgtaggcatcgacgaacgctccggaaagatacaaacagtagtaaaaacaaagctctcagaaatcaaactagacgcctccggacacttcccgatgtacggaaaggaaagcgacccacgcacatatgaagcaatacgtcagcgactattagaacacaacaacgaccccaagaaagcgttccaagaaccactatacaaacccaagaaaaacggagagcccggccccgtaatccggaccgtcaaaatcatagacaccaaaaaccaagtgatacccctaaatgacgggaaaacagtagcctacaactccaacatcgtgcgcgtcgacgtcttcgagaaagacggcaaatactactgcgtgccagtctacaccatggatataatgaagggcatcctgcccaacaaggctatcgaacccaacaaaccctactcggaatggaaggaaatgacggaggactacacctttcgcttcagcctatacccgaatgaccttataagaatagagctcccacgcgaaaagaccgtaaaaacagcggccggtgaagagatcaacgttaaagacgtgttcgtgtactacaaaaccatagacagtgcaaatggcggcctggaactaatatcccacgaccaccgcttctccctgagaggcgtcgggagccgcacccttaagcgtttcgaaaaatatcaagtggacgtactcgggaacatatacaaggtacgtggcgaaaaacgagtaggactagcctcttctgcacactcgaaaccgggcaaaacaatacgacccctacaatccacccgggactga

SEQ ID NO: 6212 - RNA, 3264 nt, synthetic construct
  misc_feature 1..3264: note = Cas9 variant
  source 1..3264: mol_type = other RNA
atgaggtacaaaataggcctagacatagggatcaccagcgtaggctgggcagtcatcaacctcgacatcccccgaatcgaagacctgggcgtgcgaatattcgaccgagcagaaaacccccaaaccggcgaatccctcgcattgccccgccgcttagcccgctcggcgaggcgccgcctacgacggcgcaaacaccgtctggaacggataagacgactgatcatcagggaaggcatactaacaaaagaagaactggacaagctgtttgaagaaaaacacgaaatcgacgtgtggcagttacgagttgaggcattagaccgcaaactaaacaacgacgaactagccagagtccttctccacctcgcaaaaagacgaggcttcaaatcgaacaggaaatctgaaaggtcgaataaggagaactccacgatgcttaagcacatagaggaaaaccgcgccatcctcagcgggtaccgaacagtaggcgagatgatagtcaaagaccccaaattcgccctccacaaacgcaacaaaggagaaaactacacaaacaccatcgcccgcgacgacttagagcacgaaatccggttaatcttctccaaacagcgcgagttcggcaacatgagctgcactgaaaaattcgaaaatgaatacattacaatctgggcctcccagcgcccagtcgcgtcgaaagacgatatagagaaaaaggtaggattctgcaccttcgagccaaaagaaaaacgcgcacccaaggccacttacaccttccaatcattcattgcctgggaacacatcaacaaactccgcctaatattcccatcaggcgcccgaggtctgaccgatgaagaacgccgtctactatatgaacaagccttccagaaaaacaaaataacataccacgacatccgcacactgttacacctccccgacgacacatacttcaaaggaatagtgtacgaccgaggagaaagcagaaaacaaaacgagaacatccgcttcctagaactcgatgcctaccaccaaatccggaaagccgttgacaaagtatacggaaaaggcaagtccagctccttcctacccatagactttgacactttcggatacgcactaacactcttcaaagacgacgcagacatacacagctacctaagaaacgaatacgaacaaaacggaaaacggatgccaaacctcgccaacaaagtatacgacaacgagctcatcgaagaactcctaaacctctccttcacgaagttcggccatctcagcctgaaagcactacggtcaatcttaccatacatggagcaaggcgaagtctactcctccgcctgcgaacgagcaggatacacattcaccggcccgaaaaagaagcagaaaaccatgctactacccaacataccgcccatcgccaacccggtcgtgatgcgggcactaacgcaagcccgaaaggtcgtcaacgccataataaagaaatacggaagccccgtcagcatacacatcgagctcgcccgggacctatcccaaaccttcgacgaacgcaggaaaaccaagaaagaacaagacgagaaccgcaagaaaaacgagacagcgatacggcaactcatggaatatgggctcacgctcaaccccactggccacgacatcgttaaattcaaactatggagcgagcaaaacggacgatgcgcttactccctacaacccatagaaatcgagcgcctactcgaaccaggctacgtagaagtcgatcacgtcatcccatacagccgctcactagacgacagctataccaacaaagtattagtcctaacaagggaaaaccgtgaaaaaggcaatcgcatacccgccgagtacctcggcgtcgggaccgagcgatggcaacaattcgaaacgttcgtcctcacaaataagcaattcagcaaaaagaaacgggaccgcctgctccggctacactacgacgaaaacgaggagaccgagttcaaaaacagaaacctcaacgacaccaggtacatcagccgattcttcgcaaactttatccgggaacatctcaaattcgcagaatccgacgacaaacaaaaagtatacaccgtgaacggccgcgtcacctcccacctccgctcccgttgggacttcaacaaaaacagggaagaaagcgacctacaccacgctgtggacgccgcgatagtcgcgtgcaccaccccatcagacatagcaaaagttacggcgttctaccaacggcgagaacaaaacaaagaactagccaagaaaacggaaccccacttcccccaaccctggccacacttcgctgatgaactcagagcccgcctcagcaaacaccctaaagaatccatcaaagcgctcaacctgggaaactacgacgaccaaaaactcgaaagcctccaacccgtcttcgtaagccgtatgccaaaacgatcagtcaccggcgctgcccaccaagaaacccttaggaggtatatcgggatcgacgaacgaagtggcaaaattcaaaccgtcgtaaaaacaaaactctcggagataaaactagacgcctcaggccacttccccatgtacggcaaagaatcggaccctcgcacctacgaagcgataagacaaagattactggagcataacaacgaccccaagaaagcatttcaagagccactctacaaacccaaaaagaacggcgaacccggccccatcatacgcaccgtgaaaataatagacactaaaaaccaagtaatccccctgaacgacggcaaaacagtagcgtacaacagcaatatagtacgcgtggacgtcttcgaaaaagatggcaagtactactgtgtacccgtctacaccatggacatcatgaagggtatactccccaacaaagcaatagagcccaacaaaccctattcagaatggaaagaaatgaccgaagactacaccttccggttcagcctataccccaacgacctcatccgtatagaactaccaagagagaaaaccgtcaaaacaaccacaggagaagaaatcaacgtcaaagatgtattcgtgtactacaaaactatagactcagcaaccggcggcctcgaactgataagccacgataatcgattctcgctacgaggtgtaggctcccgaaccctcaaacgattcgaaaagtaccaggtagacgtcctaggaaacatttacaaggtgcgcggggaaaaacgagtaggcttggcctcctccgcccactccaaaacaggagaaacaatcagacccctacagagtacacgcgactga

SEQ ID NO: 6213 - RNA, 3264 nt, synthetic construct
  misc_feature 1..3264: note = Cas9 variant
  source 1..3264: mol_type = other RNA
atgcgatataaaataggactagacatcggcattacctccgtggggtgggcagtcatcaacctagatatacccaggatcgaagatctcggagtccgcattttcgaccgcgcagaaaatccccagaccggcgaatcactcgccctcccgcgacgcctcgcgcgaagcgccaggagacgcctcagacgtcgaaaacaccgtcttgagagaataaggcgattgctcatccgcgagggagtcttaacgaaggaggagctggacaaactcttcgaggaaaaacacgaaatcgacgtatggcaactacgcgtcgaagcgctggaccgaaaactcaacaatgatgaactcgtccgcgtactcctccacctcgccaaacgacgaggtttcaagtcgaaccggcaatccgaaagatcaaacaaagaaaacagcaccatgctcaaacatattgaagagaaccgcgccatactatccggctacagaacggtaggagagatgatcgtaaaagaccccaaattcgcgctacacaaacgaaacaaaggcgagaactataccaacacaatagcccgcgacgatctagaacgagaaatacgactgatattctcaaaacaacgtgaatttggaaacatgagctgcaccgaggagttcgaaaacgaatacatcgcgatctgggccagccagcgaccggtggcctccaaagacgacatcgaaaagaaggtaggcttctgcactttcgaaccaaaggaaaaacgcgccccaaaggccacatacacattccaatcctttatcgcatgggaacacatcaacaaactcagactaattagccccagcggaacccgaggacttacggacgaggaacgcagactcctgtacgaacaagccttccagaaaaacaaaattacctaccacgacatccggaccttactccatctccccgacgacacgtacttcaaaggaatcgtatacgactggggcgaaagcctaaaacaaaacgagaacatacgcttcctcgaactcgacgcataccaccaaatcaggaaagcgatagacaaggtttatgggaaaggcaaaagctccagcttcctccccatagacttcgatacattcggttacgcactcacactattcaaggacgacgccgacatccgctcctatttgcggaacgaatacgaacagaacggcaagcgaatcgcaaacctagcaaacaaggtctacgacaacgaactcatcgaggagctcctgaaccttagttttaccaaattcggccacctgagcctcaaagccctcaggaacatcctcccctacatggaacagggtgaagtatactcaagcgcgtgtgagaaagcaggctacacattcaccggccccaaaaagaagcagaagaccgtactgctcccaacgataccacctatcgtcaacccggttgtcatgagggcactcacccaagcacgaaaagtcgtcaacgccatcataaagaaatacggtagcccggtctccatccacatcgaactcgcccgagacctctctcaaacctttgacgagcgtcgaaaaaccaaacgcgagcaagatgaaaaccgaaaacggaacgaaaccgcgatcaggcaactaatggaatatggacttactctgaaccccacaggactcgacatcgtaaagttcaaactctggagcgagcaaaacggcagatgtgcatactcactacaacccatagaaatcgagaggctacttgaaccaggctatgtcgaagttgatcatgtgatcccgtacagccgcagcctggacgacagttacacgaacaaggtcctcgtcctcaccaaggaaaacagagaaaaggggaatcgcataccagccgaatacttaggcgtcggaacagaacgatggcaacaattcgagacgttcgtcctcaccaacaaacaattctccaagaagaaaagggaccgcctcctcagactccactatgacgaaaacgaagagatggaatttaaaagccgcaatctcaacgacacccgatacattagccgctttttcgccaatttcataagggagcatctaaaattcgccgagtcagacgacaaacaaaaagtctacaccgtgaacgggcgcgtaacctcccacctcagatcaagatgggacttcaacaagaacagagaagaaagcgacctccaccacgccgtcgacgcagccatcgtagcttgcaccacgccatcagatatcgcaaaggtaaccgccttctaccagcggcgtgaacagaacaaagaactggccaagaaaaccgaaccacaattcccacaaccatggccccactttgccgacgaactccgcgcccgcctaagcaaacacccaaaagaatcaataaaagccctaaaccttggcaactacgacgaccagaaactcgaatcacttcagcccgtattcgtgtcccgaatgccaaaacgaagtgtaaccggggccgcccatcaggagacactccgtcggtacatcggaatagacgaacgttccgggaaaatccaaacagtagttaaaaccaaactcagcgaaataaaactcgacgcctcaggacacttcccaatgtacggcaaggaatccgacccacgcacatatgaagcaataagacagcgcctcttagaacacaacaacgacccaaagaaagcattccaggagcccctatacaaacccaagaaaaacggcgaacccggccccataatccgcacagtcaaaataatcgacaccaaaaaccaagttatcccgcttaacgatggaaagacagtcgcctacaacagcaatatcgtaagaatagacgtgttcgaaaaagacggcaaatactattgcgtccccgtctacacaatggacatcatgaaaggagtactccccaacaaagcaatcgagcccaacaaaccgtattccgagtggaaagagatgaccgaagactataccttccgcttctccctgtatcccaacgacctaatacgcattgaactaccgcgcgagaaaacagtcaaaacagccgcaggcgaagaaataaacatcaaggacatgttcgtatactacaaaaccatcgactcagcaaatggaggcctcgaactaatttctcatgacaactccttctcacttcgaggcgtgggatcccgcacactaaaacgcttcgaaaaataccaggtcgatgtactaggcaacatctataaagtacgcggcgagaaaagagtagggctggcttcaagcgcacactccaaaactggagaaacaatccgccccctacagtcgacaagagactga

SEQ ID NO: 6214 - RNA, 3267 nt, synthetic construct
  misc_feature 1..3267: note = Cas9 variant
  source 1..3267: mol_type = other RNA
atgcccaaagagttcgaccccctcaaacccgccaaatacagattagctttggacataggatccaagtcaataggatttgccatcatattcctaaaggaggacgtaaacaaactactcaagccatacgccatcgtccggtccggagtcaggatattcggagacggacgaacccctgccgcccccggacagctaggatccagccttgcagccgaacgacgcgtcaagcgcagcatacggcgccagtacgcccgaaaacgcaaacgccttcaacgactcctccgcaacttgaaggaactcggctttttccccgatgactctaaactctgcaagagcttcgaggacctcaacccctacgaactccgccacaaaggactcaccaaagaactaaaacctcacgagttcggcagattgctcatgcatatggccaaaaatcgaggtttccagagtaaccgcaaagtggacctattggccgacaacatagacagccaagcaaaggcagaaacgtccgccatgaaaagtgccatcgcgacccttcaaagccggctcaatggagagttcgaaacgctaggcgcctacctgtacgaacgtttcaaaaagggcgagacaatcaaaagcagcaaaacacagaagggacaaaaggcagagtatgagttcagcattagccgcaggatggttaaacaagagttcgaccgactctgggcagcccaagaacaattcaacccagaactcttcaacgaacaagccaagaacaccctaaaagacaccatcttctttcagcgtaacctcctcccacaaaaggtcggaaaatgcacctttctaccagaacacgaacgagcctccaaggcactaccatcatcccaatactttcgcatcatcagcgaactgaataagatatcattcaccgacgcggaaggactcatcctcccaatatcactcgaacagcgcaacaaacttctaaaatctctgcgcatcaaacaaaaactatcattcgacagaatcagaactgaactcaacctcgacagcaccgtacttattaacctagaacacgccagcaaggattccatcgaaggggacaaaacgggctacctcctaagcaagaaagagtacttcgggcccgcctggagggacctcagtctggaaacacaagacgccatcgtcaccgcactcctcacacacgaaaacgaagccgaactcgtgcaaaagctagtagacgacttcaacatagcacatgacgtagccaaagccttagccaacgcacgcctagagagccagtacatgagactaagcaaagaagccatcgaacgattaatacccgaactcgagaaaggcgtcgactcccaggacggctataaagtacccgtaaaatatcatgaagccaccgaagccgcaggcttcggacaccactcggccttacaagaaaattgggccgacttccccaccctcgacctcaaacaactacactccgatgacaacgacaaatatacggtcgccgaactaccactgccctactacggaaaagtcatcacaagacaagttgccttcggaacaggcgacgtcaacgacccagtggaaaaacgattcggtaaaatcgcaaacccgaccgtccacatttgcctgaaccaagtgcgggtactcctagacgaaatcatcgcaaaatacggatatccttacgaagttaacatagagctagcccgggaacttaaacagaaccacgaacagcggcaacgatctatcaagcaacaagccgccaacaagaaagagaacgaagaaataagacgcgaaataaagcaagcatacaaagtagagaaggcacggataatcacggactccgaaatatcaagagcagacatcgagaagtggaggttatggcgacgctcgaaaagtaaactctgtgtctacagcggcaagaaaatatgcgaaaccatgatcctaaataacgaagtggaggtcgaccacatcctacctcgaagccgaaccggcgacaactcctaccaaaacaaagtcctagtacttaacaaagcgaaccgcatcaagtcaaaccgcaccccctgggaagccaaagaattattcgaggcccaaggctggagctacgaggacatactaaatcgcatgcgagcactagacaaacaccaactgtttagattcgccgagaactcgatggatatctgggacaaaaactaccgcagcttcgaagctcgagcgctaaatgacacccgatacattagccgggtcgtcaaggattatctcaaagtcgtatgccacaaagaccggatagtagtaagcaatggcgcccacactgcactaatacgccgggagttcggtctaaacgacctcttaggaaagaaaggcgagaaaaaccgagacgaccaccgacaccacgcgatcgacgcgtgcgtcatcggcgcactagataggagcatgctccgaaaactacaaatcgcaatggaagtcgccgaaaaacaaaactctgccaggaacttcgtcggcctacaagaaccctggttcaacttctccacacaagtaagacggtccatagggcagatctacgtatcacacaagccaaaccacaactacgaaggcgaaatcttcgaggcctcgatctacgggctaagactcatcagcgacaaacgcacagaaaaatacgtcggcatcaaacgcaaccccgagaccggtaaaactgacaagcccaagaaatccgtggtcgtcatttccgacccgaaaacccaaaatcgctacggactcagacacaaattccacagcgaaggcttacccaagaaatattatgggctctcatcgtcaagcgttttctgcctagagatctacagagacgaaaaaggaaactggcaagcatacaccataccccgatacgaagcctaccgaatagtcaaacgcagaggcgtaaacgctctatacgacaataaacgaagcaacttcgaaggtcgaccgctcgtgatgcgacttatgcgagacgactgcatagcattcgaaaagaacggagtgaaagaagtgtaccggatccagaaaataaacggcctcaagaaaaacataacacttacgagacacttcgacgccaacgttgacgaccgctaccgacgaatgttaaaagcccaaaaggccgaaaaagctggggaagatttcgacagcgaagacctatgtgacgacctcgtattcagctccttcggcgcctcctccctctacagcaacaaggcacgaaaggtcaccatatcacccatgggcgtactacgcgaccccggcttcaagggctga

SEQ ID NO: 6215 - RNA, 3267 nt, synthetic construct
  misc_feature 1..3267: note = Cas9 variant
  source 1..3267: mol_type = other RNA
atgaagaaactcgtgctcggactagatatcggggtcgcatctgtaggctggggcatcatcgacgcggaaaacggcgacgtcctcgacgcgggcgtcaggctgttctcaagccgagacgcatccgaaaacgaaagtcgccgaaccagccgcaggcaatcacgacggctgtcccggagaaagaaacaccggcgtgaacgtatcaaacaactactcctcgcacacgacatggacgtctgcgacatcgtcaatgaaaatccataccaactacgcgtcaaggggctcaatgaaaaactcgaaatctccgagatatacgtcgcactcacccacctcgccaaacgacgtggcgtaagctacctggacgacgttgtagaagagggaggcgccatcaaaagcgaacacctcaacaaaaatatggaagaaataaaatcaggaaagatgccgtgcgaaatccaactagaaagattcgaaaagtacggtcaagtacgaggcatgatagaaatcaaccaagacaccgaggaaagcagcttcctcgtcaacatattccgcacaagcgactacatcaaagaagccaaaaccatcctcgccacccaacagaaattccacaaacaaataactaacgagttcatcgacgaatacatcaacataatggcgtcgaaaagggactacttcatagggcccgggaacgagaaaagcaggaccgattacggagtgtaccgaaccaacggcgacacctgggacaatctattcgaaatcctgataggcaagtgttcggtattcccggaggaaacacgcgccgctcgcagcagctacgtcgcgcaagagttcaacctactaaacgaccttaataacctcaaaatctcatcgctagaatccggcaaactcagcaccagccagaaacacgacatcgtcgaaaaagtcaaaaacagcaagaaatttggaaccaaagacctgctaaaatacatcgccagcgtatgcgaatgtaaaattgaaaacatagacggatgccgaaaagacaaaaaccgcaagcccataatgcacaccttcgaaaactaccgcaaagtccacaacgccctaaacgaggccggcgttgacctaagactcagcgaagcagactacgacgaacttatgaaaataatgacactgaactcggaaaccctcgaaataaagaaacaatgcaaagaaaaactcccacatctcaccgaggactacctcaatgtctgtctagtgctaaacaagaaaggcgccttcagcggatggcacgccctctcacttaaggcaatgaaactcatgatgccagagttatacggaacctccaaaaatcaaatgcaaatcatccacacgatgcagctaggcaaagcatacatcaaaccactcaaccaacagaagtacttgaatagcgaggccattctagaagagatatataaccccatcgccgcgcgctcaataagacaaactatcaaagtcacaaacgccatcctaaagaaatacggccccctagacagcgtaatcatagaaatgccgcgagactaccagacgtcggaggacgaacgcaaaatgatagagaaaatgcaaaaagagaacgaaaaagagaaaaaggccgcactgaaacgcgcccgcgaagaatacccgttccccgacgaggcgttcaggaaccataaagaactcgccacaaaactcagactgtggtaccagcaagaccaattctgcgtctacagcggacgcaaaatcagcgtcgtcgacctggtacgcaacccaaaccaattcgagatagatcacatcatcccacaatccgtaagtctggacgactcgttaaataacaaagtcctgtgcttctccgaagagaaccaaaagaaaggacaacagacccccttctactaccataaaggaaaaagcgggaactggacctacgagcaatacaaactcttcgttgagaagctattcgacaagaaaaagataagcaacaagaaaagggagctcctcctctttgaggaggacatcaacaaatgggacgtccgcaggggcttcatagcgcggaacctagtagacacccggtacgcctcgcgcgtcatcttaaattcctaccaacaatacttcggcaaccacgagatgggaaccaaagtaaaagtcgtccgaggcaaattcaccagccaactacgaaagaaatggaaaatcttcaaagacagaaatgagtctcattcccaccatgccatcgacgcgctcattgtcgccgctaccgctaacttacggctctggaagaagaacaaactcggcatatcggacgagggcaaagtttacgacaaggaaacgggagaaatcctaccattcgagaaactcaccgccagcgagtacaacgaaatgatgaacaaagagccatacctaaacttcaaaaccaagctgcagaacatagaaaccaaggtcaaatacagctataaggtctccaagaaagtcaaccgaaaaataagcaatgacacaatctactcaacccgagaacgggacgggatcgactacatcgtggggaaaatcaagaacatatacgacgtgaaaacctacaaagaccaattccttaaaaggtacaaaaagaacaaagagcaattcctcatgtaccagcatgacccccaaaccttcgcaatcttagaatcaatcatggcgacttacccagacgcagaaaaccccttcttggcatacaagaaagaacacggcgtaataaggaaatacgccaaaaacaaggcaggagcacccgtaacgtcgctaaaattcatcgacggagcgttagggcagaaaatagacgtaacctacaagaataaagcagcactcccgaaaaacaagaaagtcgtcttgcaaagtatcaaaccctaccgcgcagacgtgtattacgacgagggcaataaacgctaccacctcatcggggtaaaatactcactattcagcttcagcaaacaaggctacgtcatcaaccctatagcctatcaaaagctactggaaaaggaacaaatccacagtgagatgaaattctgcttctccctctaccgcgaagacataatagaaagcggcgaagaccccgacagcctgacccgctaccgattctggtcgaaaaacgagtcaggcaaaaacaagattgaagttaaaccgatcgaaaagccgaacttcgaagacagaaaagtcatcacaatcacaaagaaaatcaaaatactaaacaaataccaaaccgacgtcctaggaaacagtttcaaagcccaagaggagaaagaccctcggagcatagagtga

SEQ ID NO: 6216 - RNA, 3267 nt, synthetic construct
  misc_feature 1..3267: note = Cas9 variant
  source 1..3267: mol_type = other RNA
atgaactataaaatgggcctagacatcggcatagcctccgtcggctgggcagtaatcaacctagacctcaaacgtattgaagaccttggagtcagaatcttcgacaaagcagagcacccccaaaacggggagtctctagcgctcccacgcagaatcgcccgaagcgcccgccgcagactccgaagacgaaaacatcgcctcgaaagaatcagaagactcctcgtaagcgaaaacgtcctcaccaaagaagagatgaaccttttgttcaagcagaagaaacaaatcgacgtatggcaactacgagtcgatgccctcgaaaggaaactaaacaacgacgaactcgcgcgcgtcctcctccacctagcaaaacgccgcggattcaaatcaaacagaaaatcagaaagaaactccaaagaatcctcggagttcctgaaaaacatcgaagaaaaccaaagcatcctagctcaatacagaagcgtaggcgaaatgatagttaaagactccaagttcgcatatcacaagagaaacaaactagacagctacagcaacatgatcgcacgcgatgacctcgaacgagaaataaaactcatctttgaaaagcaacgcgagttcaacaaccccgtctgcaccgaaagactagaagaaaaatacctaaacatatggagcagccaacgccccttcgctagcaaggaggacatcgaaaagaaagtaggattctgcactttcgagccgaaagagaagagggcccccaaagccacatacaccttccagtcctttatcgtctgggagcacatcaacaagctccggctcgtgagccccgacgagacacgcgccctaaccgaaatagagagaaacctgctatacaaacaagccttcagcaaaaacaaaatgacctactacgacatacggaaactattaaacctctcagacgacatccacttcaaaggcctgctctacgacccgaaatcgtccctcaaacagatcgaaaacatccgcttcctcgaactagacagctaccacaaaatccgcaaatgcatagaaaacgtctacggaaaagacggaatccgaatgttcaacgagaccgacatcgacaccttcggctacgccctcaccatctttaaggacgacgaagacatcgtcgcgtacctgcaaaacgaatacatcaccaaaaacggcaaaagagtgtccaacctcgcaaacaaagtctacgacaaaagcctaatcgacgagctcctaaacctgtcattctcaaaattcgcacacctctccatgaaagccatccgtaacatactcccctacatggaacagggcgagatctacagtaaagcctgtgaactagcaggatataacttcaccggacccaaaaagaaagagaaagcacttctcttgccggtaatcccaaacatcgccaatcccgtcgtaatgcgggcactcacgcaaagcaggaaggtcgtcaacgctataatcaaaaagtacggttccccagtcagcattcacatcgagctcgcccgcgacctgtcacacagcttcgacgaacggaaaaagatccaaaaagaccaaaccgagaatcgaaagaaaaatgagacagccatcaagcaactaattgagtacgaactaaccaaaaacccaaccgggctagatatagtaaaattcaaactctggtcagagcaacaagggagatgcatgtactctctaaaaccaatagaactcgaacgcctcctcgagcccggatacgtagaagtagatcacatactcccatactcaaggagcctcgatgacagctacgccaacaaagtactggtactaacgaaagagaacagagaaaagggcaaccacaccccagtcgagtacctaggtctcggaagcgaaagatggaagaaattcgagaaattcgtactcgcaaacaaacaattctcgaaaaagaagaaacaaaacctccttagactaaggtacgaagagactgaagaaaaagagttcaaagaacgcaacctaaacgacacccgatacatctccaagttcttcgctaacttcattaaagaacaccttaagttcgcagacggcgacggaggccagaaagtgtacaccatcaacggcaaaataacagcacacctaaggagccgatgggacttcaacaaaaatcgcgaagagagcgatctacaccacgcggttgacgcagtaatcgtcgcctgcgcaacacagggaatgataaagaaaatcaccgaattttataaagcccgagagcagaacaaggaatccgcgaagaagaaagagccaatcttcccccaaccatggccacatttcgccgacgagctcaaagctcgcctctccaaattcccccaggagagcatcgaagcattcgccctaggcaattacgaccgaaagaaactagaatcactgcgccccgtattcgtctcacgaatgcccaaacgaagcgtcacgggcgcggcccaccaagaaacactacgacgatgcgtaggcatagacgagcaatcgggaaaaatccagaccgccgttaaaaccaaactctccgacattaagctggacaaggacggccacttcccaatgtaccaaaaggaatccgacccacggacatatgaagccatccgccagcggctcctcgaacacaacaacgaccccaagaaagccttccaggagcccctgtacaaaccaaagaaaaacggggaacccggcccggtaataagaaccgtcaaaatcatcgacaccaaaaacaaagtagttcacctcgacggcagcaaaaccgtcgcatacaactcaaatatagtacgcacagatgtcttcgaaaaagatggtaaatactactgtgtacctgtatacacaatggacatcatgaaaggcaccctcccaaacaaagcaatcgaagcgaacaaaccctatagcgaatggaaggagatgaccgaggaatacacctttcagttctccctcttcccgaacgacctggtccgcatcgtcctcccacgcgagaaaaccataaagacgtcaactaacgaagaaatcataatcaaggacatatttgcatactacaaaaccatagacagcgcaactggcggacttgaactaatctcacatgaccgaaacttctcccttagaggggttggcagcaaaaccctaaaacgcttcgaaaaatatcaagtcgacgtcctaggaaacatacacaaagtcaaaggcgaaaagcgcgtcgggctcgccgcacccacgaaccaaaagaaaggcaaaaccgtagacagtctccagtcagtaagtgactga

SEQ ID NO: 6217 - RNA, 3270 nt, synthetic construct
  misc_feature 1..3270: note = Cas9 variant
  source 1..3270: mol_type = other RNA
atgaccgccttcaaacccaaccctttgaattacatcttgggcctagacataggaatagcatcagtagggtgggctatggtagaaatcgacgacaaagagaacccggtccgcctaatagatctcggcgtccgcgtctttgaacgagcagaaatgcccaaaacaggagactccctcgcagccgcacgacgcctcgctcggtccgtgaggcggctcacccgcagacgagcccaccgactgctcagagcaaggcgactactaaagcacgaaggtgtactaaaacccgaggacttcgacgaaaacgggctcgtaaagccactgccctacatccccaaacaaccacgaaacaccccatggcagctccgagccgcagccctggaccgtaaactcaccccactagaatgggcagcagtacttctccacttagtaaaacataggggctatctatcacaaaggaaaaacgagggagagaccgacgacaaggaactgggagccctcttaaagggagtcgccgataacactcacgccctccaagcagggaactttcggacaccggcagaactcgcattgaacaaatttgaaaaggaaagcggacatatcagaaaccaaaggggcgattactcgcacacattctcccgtaaagacctgcaggcggaactggtactactattcgaaaaacaaaaagagttcgggaacccctacgtatcggacgacctgaaaaacggaatagaaaacctgttaatgacacaacgccccgcactttccggagacgcaattcagaaaatgctaggccattgcacattcgaaccagccgaaccaaaagccgccaaaaacacatacacagcagaaaggttcatctggctgacaaaactcaacaacttgcgaatactcaaccaaggtaacgaacgcccgcttacggacgcagaacgcactacactaatggacgagccatacaaaaagtcgaagctaacgtacgcccaagccagaaaacttctagacctcgacgacaccgcgttcttcaagggcctccgctacggtaaagacaacgccgaatcagcaacactcatggaaatgaaggcttaccatgccatttcacgcgccctcgaaaaagaggggctcaaagacaagaaatccccactcagcctcagcccagaactccaagatgaaataggcacggcatttagcttattcaaaacggatgaagagataactggccgcctaaaaggctgccttcaaccagaaatactcgacgccctcctaaaacacatcagctttgacaaattcgtccaaataagcctcaaggcccttcgccgaattgtaccgctcatggaacaaggaaaaagatacgacgaagcctgcgccgaaatctacggagaccaccacggtcgacgaaacagcgaagagaccctatatctcccgcccataccagccgacgagatccgaaacccggtagtcctgcgcgcgctctcgcaggcacggaaagtaatcaacggggtcggccgaagatacggcagtcctgcccgcatacacatagagaccgcacgagaagtaggcaaatcattcaaagaccggaaagaaatcgaaaaacgacaagaggaaaaccgtaaagacagagaaaaagcggccgccgagttccaggaatacttccctaacttcgtcggagaacccaaatccaaagacatactaaaacttcgcctatacagacaacaaaactgcaaatgcctatactcaggaaaagagatcaacctcggccggctaaacgaaaaaggatacgtagaaatcgaccacgcactcccgttcagccgaacctgggacgactcattcaataacaaagtactggtcctgggctcagaaaaccaaaataaaggcaaccggacgccatacgaatacctcaacggaaaagataactccagagagtggcaggagttcaaagcacgcgtggaaacatcccgattcccccactccaagaaacagagaatattactgcaaaaattcgacgaagaaggcttcaaagaacgaaacctcaacgatacgagatacgtaaaccgattcctatgcaaattcgtagcagatcacatgcaattaacgggcaagggcaagcgcagagtattcgccagcaacggccaaatcactaatctactacggggcttctggggactgaggaaagtccgcgcggaaaacgacaggcaccacgcactagacgcagtggtcgtagcatgcagcaccgtggcaatgcaacagaggatcacacgattcgtgagatacaaagaaatgaacgcatttgatggaaaaaccgtagacaaggagaccggagaggtccttcatcagaaaacccacttcccccaaccatgggaatttttcgcacaggaggtcatgatccgagtattcggaaaaccagacggaaaaccagaactcgaagaggccgacacccccgaaaaactaagagcactactggcagaaaaactcagttcacgacccgaagctgtacatgagtatgtcgcaccattattcgtatctagagccccaaaccgaaaaatgtccggacaaggacacatggaaacgataaaatcacccaaacgccttgacgaaggcatctcagtcgtgcgcgttcccctaacacaactaaaactgaaagacctcgagaaaatggtaaaccgggaacgtgaacccaagctctacgaagcactcaaagcccgcctggaagcccacaaagacgacccagccaaagcattcgccgaacccttctacaaacaggacaaggcaggaaatcgcacccaacaagtaaaggcagttcgaatcgaacaagtccagaaaacgggcgtatgggtccgaaaccaaaacgggatagccgacaatgccaccatggtcagagtcgacgtcttcgagaagggaggcaagtactacctggtaccaatctacagctggcaagtcgcaaaaggcatcctacccgacaaagcaattatcgcattcaaggacgaagaagagtggcaactaatcgacgactctttcaacttcaaattccccctccaccccaacgacctcgtcgaagtcataacaaagaaagcgcgtatattcggctactttgccagctgccaccgcggcaccggaaacatcaacattagaatacacgacctagacaacaaagtcggcaaaaacggaatcctagagggaatcggcgtcaaaaccgccctatcattccaaaagtaccaaatcgacgaactaggcaaagaaatccgcccatgcagactaaagaaaaggcccccagtacgctga

SEQ ID NO: 6218 - RNA, 3270 nt, synthetic construct
  misc_feature 1..3270: note = Cas9 variant
  source 1..3270: mol_type = other RNA
atgaatgtacgatacaaaataggcctcgacatcggcatcaccagcgtaggatgggcagtcgtcaaccttgacattcctagaatcgaagacctaggcgtccgcattttcgatcgagccgaaaatccacaaaccggagaatccctcgccctaccaagacgactcgcccgcagcgcgcgacggcgcctgcgccggagaaagcaccgcctggaacgaattagacgactactgataagggaggggattctcatgaaagaggaactagacaaactcttcgaggagcgccacgaaatcgacgtatggcagctcagagtggaggccctggatcgcaaactcaactcagacgagctcgcacgagtactactccatctcgccaaaagaagaggctttaaatccaacaggaaatcagaacacaactctcgcgaaaactccaccatgctcaaacacatcgaagaaaaccgcgccatactaagctcctaccgaacagtggccgaaatgatagtcaaagaccctaaattcgccctccataaaagaaacaagggcgagcattatacaaacacgatcgcaagggacgatctggagcgcgaaatccagctcatattcacgaaacaaagggagttcggcaacatgaactgtaccaaagagttcgaaaacgaatatatcgccatctgggcctcccaaagaccatttgcctccaaagacgacatcgaaaagaaagtaggattctgcacgttcgaaccaaaagagaaaagggcaccaaaagcaacttacacctttcagagcttcatcgcatgggaacacatcaacaaactccgtctcgttagtccggcgggaaccaggggactcacagacgaagaaagacgactcctgtacgaacaagccttccagaaaaacaaaatcacataccacgatataagaaccctcctccggctgcccgacgacacctacttcaagggcgtcgtgtacgaccgaaacatgccactcaaacaaaacgaaaccatacgcttcctcgaattggatgcctaccaccaaattcggaaggtcatcgacaaagcgtacgggaaaggaaaatccagctcattcctcccaatcgacttcgacaccttcggatacgccctcactctcttcaaggacgatgccgatgtcagaagctacttacaaaacgaatacgaacaaaacggcaaaccaatgcccaacctcgccaacaaaacctacgacaacgaactaatagaggaactactaaatctcagctttaccaaatttggacacctatccctcaaagcgctccacaacatcctgccatacatggaacaaggcgaagtctatagcagtgcctgtgaacgggcagggtacaaattcaccggaccgcgtaagaaacagaaaaccatgctactccccaatatcccatcaatagccaatcccgtcgtcatgcgggcactgacccaagcgagaaaagtcgtcaatgcaatcatcaagaaatacgggtcaccagtcagtattcacatcgaacttgcccgcgacctaagtcaaaccttcgacgaacgccgaaaaacaaaacgcgagcaagacgaaaaccgcaagaaaaacgaaaccgcgattcgacaactgatggagtacgggctcacactcaacccaacgggccatgacattgtcaaattcaaactctggtcagaacagaacggcagatgcgcctactcactccaaccgatagaaatcgagcgactcctggaacctgggtacacagaagtggaccacgtcataccatactcgcgctccctggacgactcgtacaccaacaaagtcctagtcctaacgaaagagaaccgagagaaagggaaccgaacccctgcagaatacctcggcgtcggaacggaacgctggcaccaattcgaaacattcgtcctcacaaacaaacagttctccaaaaagaaaagagaccgtctccttagactacactacgatgaaaacgaagagaccgagttcaaaaaccgcaacctcaacgatacacggtacatctcacggttcttcgccaacttcatccgcgaacacctcaaattcgcggaaagcgacgacaaacagaaagtatacaccgttaacggccgcatcacagcccaccttcgctcacgctgggagttcaacaaaaaccgggaagaatcagacctccaccatgcggtcgacgctgccatagtagcatgcacaacaccatccgacatcgcaaaaatcacggccttctaccaacgaagagaacaaaacaaagaactcgccaagaaaaccgaaccacatttcccacaaccctggccacacttcgcggacgaactacgcgccagactatcaaaacaccccaaagaaagtatcaaagctctaaacctaggaaactatgacaacgagaaacttgaatcactccaccccgtcttcgtaagccgaatgcccaaacgctccgtcaccggagccgcgcaccaagaaaccctgaggcgctacgtcggaatagatgaacgttcaggaaaaatccaaacggtagtgaaaacgaaattgagcgaaatcaaactggatgcatccggacatttccctatgtacgggaaagaatcggacccgcgaacgtacgaagctatccgacagcggctgttggagcacaataacgacccaaagaaagccttccaagaaccgctttacaaacctaagaaaaatggggaaccaggcccaataattagaaccgtgaaaataatagacaccaaaaaccaagtcgtccctctcaacgacggcaaaaccgtcgcatacaacagtaacatagtcagagtcgacgtattcgagaaagacggaaaatactactgcgtacccgtatatacgatggatataatgaaaggcgtcctcccaaacaaagcaattgaacccaataaaccatactccgaatggaaagaaatgaccgaagactacaccttccagttcagcctgtaccccaacgacctaataagaatagaactcccgcgagagaaagccatccgaacatccaccggtgaggaaattaagatcaaggatttcttcgcatactataaaaccatccactctggcacaggcggtatggaactgatctctcacgaccgcagcttctccctctcgggcgtaggaagtaggaccctcaaaagattcgagaagtaccaagtagacgtcctaggcaacatatacaaagtacgcggggaaaaacgcgtcggactggcgtccagcgcccactccaagaccggaaaaaccgtccgcccactccaaagcacacgagactga

SEQ ID NO: 6219 - RNA, 3273 nt, synthetic construct
  misc_feature 1..3273: note = Cas9 variant
  source 1..3273: mol_type = other RNA
atgagatggcgcctaggactggacatgggcgctggttcactaggatggtgtgcagtcggacttgacgaccaaggatacccggattcaatcctggcagccggatcccacatcttcggagatgggcgagcaccatcccgaggggaccagcaagggaccccactgggcgtcgagcgcagggcagcaaaggcaatgaggcgcagacgcgatcgcttcctgggaagacaggcaaaactgcttgcgagactcacactcgcgggcttgttcccagcagaccccgtgagagcgaaagcactcgagctcctggacccatacgtactaagagcccgcgcactggacgaagcacttccacctcaccagctaggacgagcgttctttcacctcaaccagcgtaggggcttcaagtcaaacagaaagacagaccgaggcgtagacgacgaggccggaaagatcgcaatcggcatcgacagattacgcgctgcaatagcagcggctgaagcaagaaccatgggagagttcctacacaaacgacggcaatcagccccggacgtaaatcaaataccaagtgtaagaacgcgattacgaccagaaacaggcgaagaagcaaaaggtgacgggtacgatttctacccaggacgcgaactcgtggaagaggagttcgacgcaatatgggacgcacaagcaccacatcacccaagtctactaacacctgataacagagccctccttcacgaagcaatcttctatcaacgcccgctaaaagcacctaagataggcaagtgcacactactgaacaacgaacctcgcctcccaaaagcacacccattattccagagaagacgactactcgaagaagtaaacgcgctcagaatcgtgcggccgggcgaagtcgcgaccaagctaacatgcgaacaaagagacctactcatgctcaaactgaaggacaaggcaaaagttagcttcgaaaccctacggtcaaaagtactcaaactagagccagaggccaggttcaacaaagagggagaaaaccggaccgagctagtaggagacgaagtttgcgcacaaatgagtgcgaaaacaagattcggcaaagcgtgggcgcacttcacggacgagaaaaggtgggccatcctaagccgactcatcgaagaagaagacgaagaaagattagacacatggctgagaacggaacacggcctggatgccgaacaagcacgagcagtcgccggggcacggctccccgccggtttcggacgcttcggcgaaacagcaaccagaagactaatcgcggccctgcaagcggaagtaatcgtatactcagaagcagtggtcgcagcaggcttaggacaccactcagacatgcgcacgggcgaagtattagcagagctcccatactatggcatgacactggaaagacacctactcccaggcacgggagacaaagccgacccagaagaactccggatcgggagacttactaaccccacggtacacatagcactcaacaggctgaggcgaatagtaaacagactcataaaaacctacgggcgccccgaacagatagccatcgagctgggaagagaactaaaactaaccgacgaagataaacaacggctgtcaagacaaaacaacagaaaccgagcagacgccgaagcacgctccaagaaattggcagaactcggacaagccgacaacggggcaaacagagcacgactgaaactgtgggaagaactaaaccgcgaaaacgctctggaccgcagatgcatatactcaggccaacaaatctccatagcaatgctattcagtgacgcggtcgaggtagaccacatcctcccattcgacgcaactcttgatgacagcaacaataacagaatactctgcctacgagagtggaaccgcaggaaaagaaagcagagtccttacgaagcctggggacacacagactactggccagatatcgcagcaagggcagcaagactccccaaagaaaagagatggcgctttgaaccagacgccatgcaacgattcagcgcggaggatcgattcatcgcgcgccacttagtagacactcaatacatgtcgcgactagctagagagtatctcgaagccctatacccagaaaagggcgaagggtcaggccacgtatgggtatcacctggccgactgaccgagctaataagacgaaaactaggcctgaatgaactcctgccagaccacaatttcgctggtgtcaaaaaccgactggaccatcgccaccacactatagatgccttcgtcgtggcagtgaccgaccggagtctcctgcaaggcatatcacgagcaagcgctctcgagggagaggaagggcgagagagagtcatcgtgcccgaaccatgggacggcttccgagaagcactccgcacaacactcaacaccataaccgtatggcaccgccaggatcacggcaccgccagtaaagccggactagcacaaggacgcgaccagaccgcgggcaaactccacaacgataccgcttacggactcacgggaagacaagacacaaaaggaaacgacctggtggtgagcagaaaaccactcatgtccctaaaaccagccgacatcgagcccgtacccgacgtcgcccccatcaccaaaggcgtgagagatagagacctaaggaaagccctcgcacacttcacccaagcaacggaaggaaaggggttcttacaggcgctcgaaagattcacgcggctcgggcccctgcactttcgcggtattcgacgagtgcgactaatccaacccctagccgttatcccgataaaaggccccggaggcgtcccatacaagggctatctaggaggcgaaaatttccgctgtgatgtgtgggaaatgcccgacggtgcctggaaaccggaagtaaccagcatgtttcaggcccaccaaccggggtggacgtccgccatcagagcagcgtgtccgacagcccgaaaggtcttaagcctacacaagagagacatgatcgctatagagcgcgaagaaggggtacgcacactgatggtcgtcgcccagatctggagcaacggacaagtcacgctagtcgaaccacacgaagcaggagacctcaacaaacgaaacaagagcgaagacgaccccttcggatacttcatgccgacagcgggagggctaaaacgattgaaagcaagacaggttcgagtcgacgagttgggccgagtacaagaccccggattccccgcaagaaaagccaggagacggaccaggcctaaacaggtagactga

SEQ ID NO: 6220 - RNA, 3273 nt, synthetic construct
  misc_feature 1..3273: note = Cas9 variant
  source 1..3273: mol_type = other RNA
atggactggcgactaggactagacctaggcgcaaacagcctcggatgggccgcacttaggctagaccgggcaggagaccccataggcatactggcgatggggtcgcgaatcttctcagacggccgcgaccctaaaagtggcgcgtctctggccgtggaccgcagggctgcacgagcaatgcggcgccgccgagacagattcaaacaacgacaagcagccctcctgaaatacttaataagggatggcctcttccccgcagaccaagcagacagacaacgcctcgcagacgaagacccgtacgcactgcgggccagagcgcttgacgaagaactctccctattcgagatcgggagagccctattccacctaaaccagcgaagaggattccaaagcaaccgaaaagcggaccgaggacaagacgacgaagcgggcaaaatcgcagtgggcgttgacagacttaaccaacagatggaagaacagggcgcccgaaccttaggagagttcctccaccaacgaaggcgagcagccaccgacgcaaaccacatcccctcggtgcggaccaggctccgcccagaaacgggcgaaggagcgaaaggagacggatacgacttctacccctcaagggcactcatcgcagaagagttcgaagagatctgggcagcacaagccccacattaccccgacacactaacccaacaagtccatgaccgactatacgaaatcatcttccaccagcgccccctacgcgcaccccaagtaggccagtgcaccctggtagccggagaaaccagactaccaaaagcacacccactattccagaaacgcagacttttagaggaaatcaacgcacttatgatagtgagacccggagagatagcacaacgactaaccccagaagagagagacactctatacctgaaactcaaagataagcgaacagtttcattcgcaacacttagaaagaccctaaaactggactccgccgcccggttcaacaaagagtcggaaaaccgaacagaactaaagggagacgaagtagccgccgaacttggagccaaaactcgactaggaaccaggtggcaacacctcagcggagaccagcagtgggaggtagtacaccgtctcatggcactagaaagccaagcggacgaagcagccttccgggactggatcagccaaacttacgacctactgccagaacaagccgctgcagtactcggggcacgcctcccacaaggacacggcaggttcggaccaacggcaacaacaaccctaatcgattcactcctgcacgaccgaacagaagacggcagggtagtcgtatactcagaagcagtacaacgatcagggctaggccaccactcagacctccgacacgacagagacgacgaggacgttaccgaactaccctactacggcgtggcactcgaaagacatataatgccaggcacagcggaacccaccgacccagaagagatgcgaatcgggcgactaaccaacccgacggtccacatcggactcaatcaactacgacatgtcgtaaaccgcttaattagagcctacggaccgccaaaggaaatcgccattgaactcgcacgagaactaaaactcagcgaagacgagaaaaagaaacgaaacagcgaaaaccgagacaacagactagcagcagaaggcaggtccaagaaacttgaagaaatacggcaaagagacaccggcgccaaccgcgccctcttaaaactatgggaagaactaaaccccggaaatgtcctagacagacgctgcatctatactggagagcagatcagtatagacatgctctttagcgacagagtcgaggttgaccacatccttccattcgcccaaaccctagatgattccaacggaaacaaactactctgcctgagagaagccaatcgggagaaaagaagacgctcaccatacgaagcatggggacacacagacagatggccagacatagcagaaagagcttcacgacttcccaaacccaagagatggcggttcgaacccgatgcaatgcaacgcttcgcaactgaggatggatttctcgcgcgacacctagtggacacccagtatttaggaagattagcgagagagtacctaagctggctttatccaggccgaggagaaggaagtggtcatgtgtgggtgagcccaggacgtctgaccgaaatggtccggagaaaattaggcctaaacgacctactgccagaccacaacttcggaggtggagcagaccaacccaaaaaccgcctagaccaccgacatcacgccatcgacgccctcgtagtagcaatagtcgacagaggaatgctccaagcgatagcacgagcttcgggacaagacgggagcgagggccgcgagcgaatacacataccggcaccgtgggacggctttagagacgacctccgcgtcgccgttaacggcatcatagtctcacatcgaccggaccacggcaccgtagctaaggcaggcctcgcaagaggacgagaccaaaccgccggtcgcctccacaacgacaccgcctacggcctcaccggagaaacagacgcgaaaggaaactccatcgttgtgaggcgcatcccactcagcgccatcaagaaaccagcagacatagcgcgcgtaagagacccactattacgaaacgcactagcagagtttaccaaaggccttgacggaaaagcattcgaagcccggataggccgattccacgaattagggcccctactctaccgcggcatacgaagagtccgcgtcgtagaaacattaaccgtgatacccatacgggacgccgaaggcagagcatacaagggatacaagggagacagcaactatcgatacgacgtctgggaaatgccagatggaaaatggcgctgccaggtcgtatccatgttcgacgcccaccagagcacagaacaggcccgaccacacccagctgcaagaaaaatactaagcctccaacgaaacgacatacttgcgatcgaaagaacagaaggagacagggaactcgtaagagttgtcaaattctcagaaaaacagttcgcggtcgcaccgccacacgagggaggctcactcaaaacaagagacggaaatgcagacgaccccttcagatacctttatccgagcccaaacactctcaaggggtggagagcaagacaagttagaatagacgagttgggtagagtactggaccccggctttcccgcgcgtaagagtgtgagacgaacaagacccagagccgcaccagttgactga

SEQ ID NO: 6221 - RNA, 3276 nt, synthetic construct
  misc_feature 1..3276: note = Cas9 variant
  source 1..3276: mol_type = other RNA
atgtacagtaacctcctattctctttcgacatcggcacaaattcgatcggctggtgcgtattcgcactcgatgaagcaggagaaccctacagaatagtcgacctaggcgcacgcatctacgccgacggccgagacccacaaagcaaaacatccttagcggtagcccgccgtgaagctagagcaatgagccgcagacgcgaccgctacctaaggagaagaaaggcaacccttaggactatgatcgaatacggactaatgcccggtgacaaagccggacaagaagcagtactcagggaaaccggcgaccgcgaaggaggtgacgaatcattcaacccctacgcactcagagcccgggccctgtcggagaaattaccgccggcctacatcggtcgcgtcctattccacctaggccagaggcgcggcttcaaaagcaacagaaagacagatcgaaaggacaacgacaaaggcaaaatcgcactgggcatagacgaactcacagcggcaatgcacagatccggaagcccaacactaggcgcatggctggcgatgcgcagggccgaaggccacagcgtacgactgcgcgccggcagcgaagtcttcgacgccgaaggctacgctttctacccagaacgttccctacttgaagacgagttccgacagatctgggacgcacaagccgtccaccacccagacatactgacgcccgaacgacgcgctcatctattccgagtaatgttctaccaacgcccgttaaagaaacctctcgtgggacgatgcagcttcaacccggcggagttccgactatcgagagcacatcccctatttcaagagttccgcctttacaaagaaatcaacgacctagaggtggtcctcccagaccaaagccacagaaaactgacgctcgatgaacgaaacgcgctggtcgccaaactcaagacatcccgaaaagcctcattctcagccctccggaaaacactcaaactcaccccagacctggtattcaacaaagaatcggaggcacgcaaagaactactaggagacgagatttacagcgtattagccgacgcaaaaatgttcggcgcgcgatggggcggattctcccgagcaagacaatgggaaattattactcgcctaaaagaagaagaggaccctgcatcactgagtagctggctaaaatccgagttcgggctagatgacgaaagagtcaccgcgatagccaatgccagcctaccggacggatacgggcgtctaggcgagaccgccctagcctcaatgctagaagaactaaaaaccgcggtaatcccagaatcagaagcagccagactatgcggatatgaccactccaacctcgccaaagaacaagacgaaggcctcgacaccctccccgaatatcaagaaatcctcgaacgccacataccacccgggacaggagacccagacgatatatacgacctccgcaaaggccgaatcacaaacccgacagtccatataggactgaaccaactccggcgagtagtgaacgcactcatacaccggttcggccgcccccaacgaatagtggtcgagttagcgagagacctccagctcagcgaaaaacaaaaagacgatgtcaaccgaaggatcgccaaaaatacgagggaagcagaaggccgctcccaaaagctaatcgaaatgggacagctggacacgggatacaaccgactactactgaaactatgggaggaacttaacctcgacaagcccgaagaccgagtctgcatctacagcgggaagcctataggaatagcaatgcttttcagcggagaagtcgatgtcgatcacatactcccgtggagcaaaactctcgacgattcccaagcgaacaagctcctctgcctcaagtcagccaatcgacaaaaacgcaacagaacaccaagtgacgtaccagaatggcgagaccgatacgacgaagtactagcacgagccgcacgacttccaaggaacaagagatggcgattcgccgccgacgcaatgcaacagttcgaagccgaaggaggttttctagcccgacaactaacagatacccaataccttagccgaatggcactagaatacctcagcgcactctatcccagcgaagaagcggacaaatcaggggaactaagacagaggaaaagagtacacgtcgtacccggacgactaacagagctgctacggcgcaactggggattaaacaccctcttacccgaccataatctcggcgaaatggcacaagagaaaaacagacgcgaccaccgacaccacgcaatcgacgcagcggtaataggaaccacctccagaagcctcctacaacgcatgagcggcgccgcagccagactcgacgacgtggcattcgatgacttggtaagaaccgtcgtcaaagacaatcccccatggccgggctttagagaggaactactggcagcaataggacgggtgaccgtcagccacaagccggatcacggaacggtcagtcgcgcagcatacgcacaaggcaaaggacaaacagcgggcaaactgcacaacgacaccgcctacggactgacaggcctagtagacgcaaaaggctcccctctcgttgtaagacgcaaaccattcatggcgctggaggtaaaggacattgcaagcatacgcgacaccgaactacaatctgcactgtacggcgcgatcggctctctaacagaaaagaaagcgctccaagaagcactcatcaggttccgagacacccacccacaattcaaaggcataaggagagtccgcgtcctggaaacactctcggtcatccccatcgtagacagagacggcaaagcatacaaaggctacaaaggagacgcaaactaccgatacgaggtctgggaaactttggacggaaaatggcatacggaagtagtgtccatgttcgatgcacaccagcccggatggcaatcaccgtttcacaagcaaaacccagcggcacgccgcgtactaaaacttcagcagaacgatatggttgcctacgaacatccagccgacggctacaccatagccagagttgtaaaattctcaaacgacaagaggatatacttcgcgagccaccgggaatccggcagcctaaaagcgagggacgccgacaaaggtgaccccttctcctacttcgccaaagcaaacaacggactgcgcgacatcaaatgcaggcaagtccggattgatgccgccggcaggatattcgacccaggcccccaagaccgcgaaacacgccaggcaaacaaaggggtctga

SEQ ID NO: 6222 - RNA, 3279 nt, synthetic construct
  misc_feature 1..3279: note = Cas9 variant
  source 1..3279: mol_type = other RNA
atggcctacacgatgggaatagacgtaggaatagcctcctgcggatgggcgatcgtcgacctcgaacgacaacgcatcatcgacatcggcgttcgaaccttcgagaaagcagaaaaccccaaaaacggtgaagccctggcagtcccacggcgagaagcccgcagcagccggcgccgactccgccgtaagaaacaccgcattgagagactaaaatacatgttcgttagaaacggcctcgccgtggacatacaacaccttgagcaaacgctcaggagccaaaacgaaatcgacgtctggcaactccgcgtcgacggactcgatagaatgctcacccagaaagaatggctcagagtcctaatacacctcgcacaaaggcgcggctttcaaagcaaccgcaaaaccgacggatcgtcagaagacggccaagtgctcgtaaacgtgaccgaaaacgaccgcctgatggaggaaaaggactaccgtaccgtagccgaaatgatggtaaaagacgaaaaattctcggaccacaaacgcaacaaaaatggaaattaccacggggtcgtcagtagagcaagcctcctagtcgaaatccacacactcttcgagtcccagcgccaacaccacaattttctagcaagcaaagactttgaattggaatacatcaacatctggagctcacaacgacccgtagcaaccaaagaccaaatcgagaaaatgatcgggacctgcacattcctgccaaaagaaaaacgcgcgccaaaagcctcatggcacttccaatacttcatgttgctacaaacaataaaccacatcaggatcacgaacgcccaaggcacacgccccctgaataaagaagaaatcgagcaggtagtcaatatggccctcaccaagagcaaagtcagctaccacgacatacgcaaagtcctcgacctgtcagaggaataccagttcgtggggctggactatggaaaagaggacgaaaagaagaaagtcgagagcaaagaaacgatcatcaagctcgacgactaccacaagctaaataaaatcttcaacgaagttgagctcgcaaaaggtgaaacatgggaagcagtcgattacgacacggtcgcctacgcactcactttcttcaaggacgacgaggacatccgagactacctccaaaacaagtacaaggacagcaagaaccggctcgtgaaaaacgtagcgaacaaagaatacacaaacgagctaatagagaaagtctccacactgtcgttccgcaaggtaggacacctctcactaaaggcactgcgcaagataatacccttcctagaacaaggcatgacctacgacaaagcgtgtcaagcggccggcttcaacttccaagggatctcaaagaagaaacgctccgtagtactgccggtgatagaccaaatctccaaccccgttgtcaaccgcgcactaacccagacgcgaaaagtcataaatgcactcataaagaaatacggcagccccgaaacaatccacatagaaaccgcacgcgagctatcaaaaaggttcgacgaacggaaaaacatcacgaaagactacaaagagaaccgagacaaaaacgaacgcgcaaagaaacacctcagcgagctaggcatcatcaacccaacaggactagacatcgtaaaatacaagctctggtgcgaacaacaaggacgttgcatgtactcgaaccagcccatcagctttgaacgactaagggaatccggatacaccgaagtcgaccacatcattccctacagcagatctatgaatgactcctacaacaaccgcgtactcgtgatgacaagagaaaaccgcgaaaaatcaaaccaaacgccctacgaatacatgggcaacgacacccaacgctgggacgaatttgaacaacgcgtgacaacaaacccccaaataaagaaagagaaaagacaaaacctcctccttaaaggcttcaccaaccggcgagaactcgagatgctagaacgaaatctaaacgatacccgccacattaccaaatacctcagtcacttcatatccacaaacctggagttcagcccttcagacaaaaagaagaaagtagtcaatacaagcggtcgcataacatcccacctccgcagccgttggggcctggagaaaaaccgagaacaaaacgacctgcaccacgcaatggacgccgtagtcatcgcagtgacctccgactccttcatacagcaagtaaccaactactacaaaagaaaggaacgaagggagctaaacggagatgacaaattcccactaccctggaaattcttccgagaagaggtgatagcacgcctcagcccgaacccaaaagaacaaatagaggcactaccaaaccacttctactccgaggatgaactcgcagacctgcaaccaatattcgtctctcgcatgcccaaacggtccatcacaggcgaggcccaccaggcccaattccgccgagtagttggcaaaacaaaagagggcaaaaacataactgcgaaaaagacggcactggtagacatctcctacgacaaaaacggagacttcaacatgtacggcagagaaaccgacccagccacgtacgaagcaattaaagagagatatctggagttcggcggaaacgccaagaaagcgttctccaccgacctacacaaacccaaaaaggacggaacaaaaggcccactcatcaaaagcgtacgtataatggaaaacaagacgttagtccaccccgtaaacaaaggcaaaggagtcgtctacaactccagcatcgtccgaaccgacgtcttccaacgaaaagaaaagtactacctactacccgtctacgtcaccgatgtaacaaaagggaaactacccaacaaagtcatagcagcaaagaaaggatacgacgactggatcgaagtcgatgacagcttcaccttcctctattcgctttaccccaacgacctcatctttatccgccaaaacccaaagaagaaaataagcctaaagaaacgaatcgaaagtcacagcatcagcgacagcaaagaagtccaagaaatcttgacatactacaaaggcgtagactcaagcacagcggcaatcgagttcatcacacacgacgggtcctactacgcaaaaggagtcggagtccagaacctagactgcttcgaaaaataccaagtggacatcctgggtaattacagcaaagtcaaaggcgaaaaacgcctagaacttgaaacctccgacaacaaccacaaaggaaaggacgtaaacagcataaaatcaacatcacgctga

SEQ ID NO: 6223 - RNA, 3279 nt, synthetic construct
  misc_feature 1..3279: note = Cas9 variant
  source 1..3279: mol_type = other RNA
atgaagtattccatcggcctcgacatcggcattgcaagcgtcggatggtcagtcataaacaaagacaaagagagaatcgaagacatgggagtgcggattttccaaaaagcggaaaaccccaaagacgggagctcactggcatcgagcaggcgcgaaaaacggggatcacgacgccgcaacagacgcaaaaagcaccggctagacaggataaagaacatcctatgcgagagcggtttagtgaagaaaaacgaaatagagaaaatctacaagaacgcatacctgaaaagcccgtgggaactgcgcgcaaaaagtctagaagccaagatttcgaacaaagaaatcgcccagatactactccacatcgcaaaaagacgagggttcaagagcttcaggaaaaccgacagaaacgcggacgacaccggcaagctcctcagtggcatccaggaaaacaagaaaataatggaagaaaaaggctacctaaccattggggacatggtagccaaagacccaaaattcaacacccatgtacgcaacaaagcggggtcatacctgttctcgttcagcagaaaactcctagaggacgaggtcagaaagatacaagcaaaacagaaagaactgggcaacacccacttcacagacgacgtcctggaaaaatacatcgaggtcttcaactcccagcgaaacttcgacgagggcccatccaaaccctcaccctactacagcgaaataggccaaatagccaagatgataggcaactgcactttcgaatcatcggaaaaacgcacagccaaaaatacatggagcggagaacgattcgttttcctccagaagctcaacaacttcagaatcgtgggcctcagcggaaaacgacccctaacagaagaggagcgcgacattgtggaaaaggaagtatacctcaagaaagaggtccgatacgagaaactaaggaagatactctacctgaaggaggaagaacgattcggggacctcaactactcaaaggacgagaaacaggacaagaaaacggagaaaacgaaattcataagtctgatcggcaactacacaatcaaaaagctcaacctcagcgaaaaactaaaaagcgaaatagaagaagacaaaagcaagctcgataaaatcatagaaatcctcacattcaataagtcggacaaaacgatcgaaagcaacctcaaaaagctcgaactaagcagagaggacatagaaatactcctgagtgaagagttctccggaacgctaaacctcagcctaaaggcaataaagaaaatcctgccatacctggaaaaaggcctcagttataacgaagcgtgcgaaaaagcggattacgactacaaaaacaacgggataaaattcaaacgaggcgagctcctcccagtggtagacaaagatctcatcgcgaacccggtcgtactaagagcaataagccaaacgcggaaagtcgtaaacgccatcatccggaagtacggaactccacacacgatacacgttgaggtcgcacgcgacctcgctaagtcgtacgacgaccgccaaacaataatcaaggagaacaagaagcgagaactggaaaacgaaaagacgaagaaattcataagcgaggaatttggaatcaaaaacgtaaaaggaaaactcctattgaaatatcgcctataccaagaacaggaaggccgctgcgcatactcaaggaaggaactgtcgctctcggaggtcatcctggacgaaagcatgacggacatcgaccacatcataccctactcccgaagcatggacgactcctacagcaacaaagtccttgtactctccggcgagaacagaaagaaaagcaacctattgccaaaagaatacttcgaccgccagggacgcgactgggacacattcgtcctcaacgtaaaagccatgaaaatacacccccgcaagaaatcgaacctcctcaaggaaaaattcacccgcgaagacaacaaagactggaaaagccgcgccctaaacgacaccagatacataagccgattcgtcgcgaactacctcgaaaacgccttggagtaccgagacgacagcccaaagaaacgcgtcttcatgatccccgggcagctaacagcccaactccgagcccgctggaggctcaacaaagtccgagaaaatggagacctacaccacgcactggacgccgcagtcgtcgcggttacagaccaaaaagcgataaacaacatctcaaacatcagccgctacaaagaactcaaaaactgcaaagacgtcatccccagtatcgagtaccacgccgacgaagagaccggggaagtctacttcgaggaagtaaaggacacaagatttccgatgccatggagcggattcgacctagagctacagaagagacttgaaagcgaaaacccacgcgaagagttctacaacctgctaagtgacaaaaggtatctaggctggttcaactacgaagaaggcttcatagagaagctaaggccggtattcgtatcccgaatgccaaaccgcggagtcaaaggacaggcacatcaagagaccataaggagcagcaagaaaatctcaaaccaaatcgccgtctcaaagaaacccctcaactcgattaaacttaaagacctagagaaaatgcaaggccgagacaccgaccgcaaactatacgaagcccttaaaaaccgcctggaagaatacgacgacaaaccagaaaaagcattcgccgaacccttctacaagccaacaaactcgggaaaacgcgggccactcgtccgtggaataaaagtagaagaaaaacaaaacgttggtgtatacgtaaacggaggccaagcaagcaacggaagcatggtgagaatcgacgtcttccgcaaaaacggcaaattctacacggtacccatatacgtccaccagacactcctaaaagaactcccaaaccgagcgatcaacggaaaaccatacaaggactgggacctaattgacggcagctttgagttcctctacagcttttacccgaacgatctgatcgagatagaatttggcaagagtaagtcaataaagaacgacaacaaactaaccaaaaccgaaattccggaagtgaatctaagtgaagtactcggatactatcgaggcatggatacaagcaccggagcagccaccatagacacccaagacggcaagatccaaatgcgcataggaatcaagaccgtcaaaaacatcaagaaataccaagtcgacgtcctcggcaacgtctacaaagtaaaaagagaaaagaggcagacgttctga

SEQ ID NO: 6224 - RNA, 3285 nt, synthetic construct
  misc_feature 1..3285: note = Cas9 variant
  source 1..3285: mol_type = other RNA
atgaaatccactctcgcaatagcaagcatctcatcactcggatgggtcatcgaactgggcgaaaaccgaatcatgcggctcggactcgacatcggttctacgtcaataggatggtggatctacgaaaccaccgacggccaaattacgtccgtaatagacggaggcgtccgcatcttctccgacggccgagaccccaagagcaaaggatcactagcagtagatcgccgcgtcgccagagcccaaagaagaagacgcgatcgctacctcagacggaaagcagcactaatgaaacggatggcagaagtgggcctaatgccaagcgatcctaaacaagcaaaacaactcgaagcactagacccatacgaactcagagcaaggggcctcgatgaaactctagaactcacagaactcggacgcgcactcttccacctcaaccaacgaagaggcttcaaaagcaaccgcaaaaccgacgccggcgataacgaaagcggcaaaatcatcgacgcaacagcaagactagactgggcaatgcgtgaccatcgcgcacgaacctacggggagttcctccacatgagaagacaaaaagccgacacaccgcgcacaacaccagccgtcaggacacgactcaccattgcagccagagacggggccgaaaaggaggagtccggctacgacttctaccccgaccgacaacacctccgcgacgagtttgacgccctctgggaggctcaggcagaataccacggcgtacttacagaggacctacgtgacgaaatcgggacgataatcttccatcaacgacccctgaaaaccccaaaggtaggtaaatgcttattcaccaacgaagaaagagtagcgagcgcacacccgctgaaccaacgacgcatcctagtagagaccgttaacgccctgcgagtagcccaactcggtgaagtcgccagggcactcacgctagaagaaagagacacaatcctacacgcattagacaataaagcccacaccaaatcgctgagcgggatgtcaatcaaactaaaggcacttggcaaagtgattaaactcaggagtggccaatacttcacactagaaactgccaaccgcgacgcgatcgcgtgtgaccccgtaagagcctcactaagcaaaccagacagaataggctcctactggagcactctcgaccacaacgcccagtgggaagtcgtgaatcgcatccgggccgtacaaagcgacgcggaccaccgcgaactcgtcgcctggctggtctcccaacacagactggcagccgagcatgcagaaggcgcagcgtacgcgccgctaccggacggatactcgcgactaggaatcaccgcgacgaaacgcatactagcagccctagaagcaaacgtcataccctacagcaaggcggtagaatcatgcgggtggcaccacagcgacgagcgaaccggagaagtcctggatcgactaccctactacggcgaaatactcgatcgacacgtgatcccgggcacatacgacgacagtgacgacgatataacgcggtttggtcgcatcacaaaccccaccgtacacatagggctaaaccaactaagacgactggtaaacagaataatcgaagtccacggcaaaccagacgaaatcgtcgtagaactcgcaagagacctaaaactaagccaagaccaaaaagcagacgtcgaacgcacgatcaagaaaaacacacaggcggcaatccgcagaggagaaaagctagaagaaatgggagtacccaacaccggcgggaaccgaatggtgctgcgactatgggaagacctcaacgatgacgacgtaatgaaacgattctgcccatataccggacaaagaatctcagccgggatgctattcgacggctcctgcgacgtcgaccacatactcccattctcgcgcacactagacgacggattcacaaacaagaccctatgcctcaaagaagccaacagaaagaaacgaaactacgccccacatgaagccgcggaaaaaggactcctcgaccgcgatgcaatggactcagtggcaaaatacctaccagacaacaaagcctggcgctttgcgccggatgccatcgaaagattcgagggagaacgagacttcacagcacgagctcttaaagacacccaatatctctccagactagcacgaacatacttagacgcactatacgacggtggcgacgacaaaagccacgtctgggttgtgccgggaagactcaccgaaatgctacgccgccactggggactcaacggactagaagccctagccgactccgacgagaaaacggtgaaacgaaagaacaggacggaccaccgccaccatgccatagacgctgccgtagtagcagcaacagatcggagcctaatacagaaaatcagcaaaatagccgcctcagatgaacaagccggcgcggaagacaccctcaaaagcacacccccaccctgggacagcttcagagacgacatagccgcacagctccaaaacattacagtttcgcatagagcagatcacggacgcaccgactcgctagccaagggacgtggagaagacacaacatcaggcgccctccacgaagcaacagcactaggaatcatcgacgaaacccacgtcaccgtaagaataccaatagagagcctaaagagcggacacctaatcgaaggctcaagaaacggctatataagagatccatatctccgggatcaactaacattagcaaccaaaaatggaagcgataaagatttcacgacggtactacagaaatttttcgaccgcagcaaaaggtatggtgggacacgccgagtaaggataataaagacactacaggatacggcacgcatctcagtaccgcacaacgcaccgatcaaggcatacaaaggaggctctaatcacgctttcgaaatatggagattaccaaacggcaagatagaatcacaggtaattactacatgggaacaccacaacttaacagaaccaaaaagaccccaccccgccgcaaaacgaataatccgattacacaagacagacatggttgccatcgaaagagacggcaagacagtcatttgcttcgtccagaaaacggaccccagcaacggcgcattcctcgtaccacacttcgaggccaacgcagacggccggaaacgcaaaaatgaaccggtagagtggtatcaaatgtctgccaacagcctcattaaagcagacttaagaagagtaggagtcgacgaaatgggaagggtccgagacccaggacccccacccataagatga

SEQ ID NO: 6225 - RNA, 3285 nt, synthetic construct
  misc_feature 1..3285: note = Cas9 variant
  source 1..3285: mol_type = other RNA
atgaaataccgagtaggcttcgacctcgggacaaactcactcggttgggcagtagtgagactaaacgcctccggagaaccggatcgcattgaagtcgccgggtcgaggatcttctcagacggcagggagcccaaaagcggggcaagtcttgcaggagcgagaagagacgccagagctatgcgacgcagacgagatagattcaagcaaagacaggccgcgttaatcaagtacctaacgcaagcaggattcttccccgcagacgagagcgaacgcaaagcactcagcgcgctcgacccatacgagctgagggcccgagccctcgacgaggccctccccctcgcccatcttggcagagcactattccacctgaaccaaagacgaggattcaagagtaaccgaaaaacggacagaggaaagaacgacgataccgggaaaataaggataggcgtcgcgaggctgtacgaacagatgagagacgcagacgccagaacactgggagagttcctccacaagaggcgcgcagcagcaagcgatccaaacgccataccgcacgtacgaaccagaatcgtcacattagccgcagaagacggcaaggcaagtgacgtatacgacttctacccagaccgacagacgctagaagaagagttcgaagcgatatgggaagcgcaaacaagccaccatccggaggcactaacagaagaacgcagagcccaattctatgaaatcatctttcaccagagaccgttaaaacaaccaaagataggattttgcacactactcccacctgagaaacgactacccaaggcacatcccctattccaaagaaggcgactactagaagaagtcaacgcactaagaatcgttctaccaggaaaagagacaagagcactcgaaaaggcggaaagggatgcactactaagcaaattgaaccaacgaaagaaagcagcatacgagagcttaaggaaggcactaaaactcgacccagatgccaggttcaataaggaaagcgacaaccgcgaagacatgataggagacgagatagcggcagagatggcgcacaaatccagatttgggaaagtgtggctcggaatgagcgcagaagcacaagcacaagtcatagagcgcctgcgagggctcgaaagcgacgcagacgcagacgatttcgaagcctggctgagagacgaccacgggctagcacaagaacaagccaaggcagttacagcagccaacctgccggaaggctacggacgattcggagagacggcaacccgaaaactgatagcagcactcgaacaggaggtcattgtatacagcgaagcagtacaacgagcagggctgggccaccatagcgacctaagagacggccaggtatggaccgacaagaaaggcaacccagccctaccatactacggcgcagtactcgaacgacacatcgtaccaggcacagcggacccaaacgagacggacgacgccctccggatcggcagactaactaacccaaccgtacacataggcttaaaccaactaaggagagtggtaaatgcccttatgcgaaggtacgggcaaccacaagagatcgcaatcgaactagcacgagaactcaaattaagcgacgacagaaagaaagaaataaacacccggaacagagaaaacaggaaagccgcagagaaaagaagccaaaaactaagaaacatcggtcaggcagacaaagggggcaacagggcactcctaaaactttgggaggaactcaaccccgaaaacgtgctggacaggagatgcgtatacacaggacgcgtcatcagcatagacatgctgttcagcggagcagcggaagtagaccatatactcccgttcagtgtaagtctcgacgacagcaacggaaaccgcatactatgcctaagggaagtcaacagaataaaaaggcagaggaccccgtgggaggcacgagacgacttacgagctcacttcgggccagacgcaggatgggaagccatagccgccagggcagcacgccttccccgagagaaaagatggcgcttcgaaccagacgcagcaaaccgattcgacgcacaaggaggattcctcgcgcgccacctgacagatacgcaacacctaagccgactggcaagaagttacctaagcgcactctacccggagaccggcgaaggcagcggccacgtatgggtaagcccaggacggctaacagaaatgctcagacgggcatggtccttaaaccaccacctaccagaccacaatattgccggagctgccaaccaaccgaaaaataggaaagaccatagacaccacgcaatcgacgcaatagtcgtggcgctcgcagaccgcgcgatgctgaaccgaatcgccagggaaagtggtaaagaaggacacgaagccgccggcagactcgtggcaagcatacccgagccatgggagggcttcagtgatgaagtaggtagagcagtacgagcgataaccgtaagccacagaccagaccatggaaccgcatcgaaagcaggccgggctaaagacaaagacgcgacagcgggccgtcttcacaacgaaacagcatacgggctaacaggagaaaaagatgcgcgaggcctagacatagttgtaacccgcaaaccactatcagcattcaagaaaagtgcagacctggacgcgatacgcgacgacgacctgaaacaaaaactgaaggcttgggcagcgggaaaagaaggtggggccttcgaacaagcaatgagaagtttcggagaccccgaaagaggaccacggtcgcaccctggcctcagaagaatccgggtgaccgaacccctctcagtcattcctataagagacagagacggccggccatacaaagcatacaaaggcgacagcaactacagatttgacatctgggaactaaagacaggaaaatggaaggacgaggtagtcagcatgttcgaagcccacagaccaaactggacctccccaatacgggccgggaatcccacagccagaaaggtactgtcagtacgccagaacgatgtgatagcgatagagagggaaaacggaccagaactaatgcgcgtagtaaagtttagcgcggggagcctagcactagcaccccctcaggaagccgggtccctgaaagcccgagatgcagacaaaaacgacccctttaaatacgtatatggttcaccatcatcactccaaagatggaaggcaagacaagtacgtatagacgaactcgggagagtatttgacccaggcttcgccgtcagaagccgcagaagctcagaatga

SEQ ID NO: 6226 - RNA, 3291 nt, synthetic construct
  misc_feature 1..3291: note = Cas9 variant
  source 1..3291: mol_type = other RNA
atgaaaaacatattctcctttgacataggaacaaattcaataggatgggcagtactggcgctcgatggcaacggggacccggtcagaatagcagatgcaggagtccgcatattctcagacggccgggaccccaaatcaaaagccagcctcgcagaggcaagacgaatggcccgggcgatgtcaagaagaagggacagaacactccgacgaaagcgagccaccctaagaacactagccgaaataggcctaatgccggacaccagcagcgctcgccaggcccaactcagagaaacttcagaccccaaaagcggatcggggcaactcacccgaaacccatacgcacttcgcgcactggcactagaagaaaaactaccattattccatattggacgagccctataccacctcggacaacggagaggcttccaatccaaccgaaaaacggaccgcaaggacaacgacaaaggaaaaatagcgctaggaatagaagaactccacgctgcaatgagacaagacggagcacaaacgtacggtcaatggctcgccagacgccacgcactcgggcaagccgtccgcctcagatctggtgcgctcgacctcgaaggagagggctacgccttctatcccgagagaaagctgctggaagacgagttccatcgtatatgggaagcacaggcacgacactaccccgacatcctcacgcccgaaagacgggatcacctattcacagtaatgttctttcagagacccctaaagaaacccaaagtaggcaagtgctccttcaacaaccaagaagaacgactatcaaaagcccatcccctcttccaagagttccggctatacaaggaagtgaatgaactggaaatcgtagaacccgacctgacacacaagaaactcaccctcgaccaacgcaacgccctagtaaagaaactccaagtatcacgcgaagcatcgttcgccgccctacgaaaagtcctcaaactacgccccgaccaacgattgaacaaagagtctgaaagccgcactaaactaaaaggaaatgaagtctacgccgtcctgagcgacaaaacaaggttcgggcccagatgggggacgttttcacaagcagaacagtgggccatcatagaaagactaaaagaagaagaggatccaggccgactgttcgcttggctgcgaagcgcgttcggcattgaaggagagcaagcagccgacatagcaaacgtccacctcccagaaggacacggcaggttaggcaaaacggcacttgaggcaatgctggaggaactcaaagccgaggtcataacggaagccgaagccgctaaaagatgcgggtacgaccacgcccgactaggcgggggatcagacgaaggagaaccagagcttcccccatatcaagaaatcttacaacacagaataccacccggaacaaataaccccgacgacccatacgacattgaaaaaggccgattcaccaacccaaccgtacacatcgccctcaaccaattaaggcacgtcatgaatacactcatcaggcggtacggtaaacccgcccaaatcgcggtcgaactagctcgggacttaaagctctcagaacggcaaaaagaagaagtcaaccgaaccattgcgagaaacaccagggacgcggaacggagaggaaagacactagaagaaaatcgaatacccaacacaggctacaatagaacgctcctaaggctatgggaggaactaaaccccggcaaggtagaagacaggtgttgcatctacactgggaaacccattagcatatccatgctattcagcggagaagttgacatcgaccacatcctgccatggtcccgcacactagacgactcccacgggaacaaactactctgcctgcgggaagccaaccgagtcaaacgaaacagagcaccagccgacgtaacggaatggcgtgacaactacgacgaaatcctctcacgtgcggcaagactacctcaaaacaaacgggaccgattcgcaccggacgccatggaacggttcgaaaaggccggaggatttctagctcgccaactcacagacacacaatatctgagtcgaatggcactcgaataccttgcatgcctcttcccggctgaagaaatggacggattcggcgagctccgaagacacaggtacataaacgtatgcccgggccgactaaccgaaatgctcagacgcaactgggggttaaacagtatactcagcgactcccagctaggagaaaccgcccaagagaaaaacagaaaggaccataggcaccacgccatagacgctatagtaataggagtaaccggtagatcgctactcaatcgaatctcgtatgcagccggacgcctagaagcacaacaactcgaaacactcgtcaaagaagccgccgcaacgaacaaaccttgggacgggttcagagaagacgtcgcaaaggtcgtgggcggaatcatcgtatcacacaaaccagaccacggtaccgcgggtcgaaaagcgaaagacccggcacgccaacaaaccgcaggacgactccacaacgacacagcctacggcctaaccggggaaacagatgcccgaggcaacacgatcgtagtcagacgaaaaccattcctttcgcttaccagcaaagacatcccctccatccgggacgaagccctgcgagcagtgctggaacagcacctacgaggcatcccagacggaaaagcctttcaggccgcactagacgcgtttcgaaaacaaaaaggcttccaccattaccacggcataagacacgtaagactgaccgaacctctatccgtcataggcatcaaagaccgcgacggaaaggtatacaaaggatacaaaggcgacgcaaaccagcgatacgacgtatgggaaaccctcgatggcaaatggcacgcagaagtggtctcaatgttcgacgcccaccaaccaggatggcaatcacgcttccacgcagaaaacccaacagccaggcgggtcctccggctacagcaagacgacatggtcgcactaaacgcgccagacggcggccgactattagtacgagtcgtaaaattccgccaaaacggccaaataaccttcgccggccacaacgagtccggcaatctaaaagccagagacgcagcgtcgaacgaacaagatcccttcaaatatatcagccgaatggccagctcactcaaagactgtggctgccggcaagtcagaatagacgcaaccggacaagtgttcgaccccgggccccaagacagagcatcaagactccaaaaacaatcaaaacgatga

SEQ ID NO: 6227 - RNA, 3294 nt, synthetic construct
  misc_feature 1..3294: note = Cas9 variant
  source 1..3294: mol_type = other RNA
atgaagaaacaacctcaaagatacatactaggactagacctcggcatagccagcgtgggctgggcactaatcttagttgacggcgcagaaaacccagtaggcctactcgactgcggagtccgaacctttgaaagagcagaagtccccaaaactggagactcactcgcgctcgcacgtcggcaagcacggtccgtaagaagactcatacggcgccgtgcgcaccgactgctacgcctccgccgcctcctaaaaagagagggaatacttagcgcggcagacttcaactcagacggcctccccaacctcccaatagatgcatggcagttaagagtcgccggcctcgaacgcaaactaactaaccaagaatgggcagcagttctattacacttggtaaaacaccgcggctatcttagccaacgcaaatcagaaacccaaacagaaaacaaagaactaggccgtctgctcgccggcgtagccgaaaacagcaagctcctcagcgaatcttccgaacaataccggactccagcagaactcgccgtcaagctctttgcagaacaatctggacacctacgcaacaaaggaggagaatacacacacaccttcaacagacttgacctccaaaaagaactccacctactcttcgaaagacagtatgccctgggaaaccccttcgcatccgccgagctgcaatctaaggtagacgaactactcatgacccaacgaagcgcactgcaaggagaagccgtcctcaaaatgctaggcaaatgcacattcgaaccaagcgaatacaaggccgccaaaaacacctacagtgcagagaggttcatctggctcaccaaactaaacaacttgagaatactatacaacggagaagaaagagcccttgacgaaggagaccgaaagaaacttcttgacgaaccatacaagaaagccaaacttacctacaaacaagtccgaagcatactcaatctaccagaaagcgctgtcttcaaaggcctccgatacggcaaagactccgacggccttaaggcggaaaacggcaccctaatggaaatgaaagcataccacaaaatccgaaccatcctcgacaaagccggcctaaagggcgaatgggaaaaccgcatacgcaacccagagatactcgacaaaatagggacagccttctcactatacaaaaccgacgaggacattcaagccgccttggccgacctccggctccccgagaacgtactagacgcattactggcgggcctcaatttcgacaaattcattcaactatccctcaaggcgctacggaatatactaccactgatggagagaggtatccgctacgacgaagcctgcaaggaagtgtacggcgaccatcgtgccctcgccgaaagcaaaaaccaagtattactgcccccaataccagccgacgagatcagaaaccccgtcgtcctccgtacactgacacaggcgcgcaaggtgatcaacgcgataatccgacgatacgggagcccccaaagggtccacatcgaaacagccagagagctaggaaagtcgaaacaagaaagagacaagatcgaccgcaaaaacaaagagaaccaaaacgacagaaaccgacttgcaagtgacatacgcaaacacttcaacttcgaaccgacacccaaggacatcttgaaactcagattatacgaacaacagcacggcaaatgcctctacagtgaccttagggaggaaaaaggagagtgcctctatacaggaaacgtaatcgaactgcaccgactcttcgaagacgggtacgtagagatagaccacgcactacccctgtcacgcacgtgggacaacagcctcaacaacaaagtactggtactaaagagctccaaccaaaataaaggcaataagacaccctacgaatggctggatggcgcaaacaactcccgtcggtggcgagagttccaagcaagagtacaagggtgccacttcccatacgtcaaaaagcaacgtatccagacagccaaacttgattcaaaagcagaacaaggctttctcgaaagaaacctcaacgacacaagatacataagcaaattcatgtgccagtttatcactgcaaacctcagactggcagaaacgtccaacgcactaatggaagaggtggcaggcgaaaacccctactggaaagaacgcaaacgacaacgcgtattcgccccctctggaagcatcatagcactcctacggggcctgtggggactcaagaaagtccgcgaagacaacgacagacaccatgccctcgacgccatagtagtcgcatgcagcaccgttagcatgcaacagaaaattaccaaagcgatgcaacgacgggaaacattagagaccgtggacagtgaaacgggagaggtaaaaacacgcatcccccagccctgggacttcttcaggcaggaggtgatgatccgagtattctccgactccccacgtgaagaactggcggaaaaactaaactcgcgaccggaagcactccacgacttcgtatcacccctgttcgtaagccgagcccctaaccgaaagatgacgggacaaggacacctagagaccgttaaatctgcgaagcgcctgagcgagaacatatcagtcgtaagaaaaccactcaccgccctcaaattgaaggatatagaaaacatcgtcggataccctgaccgagagcccgccctctaccaagccctacgcgaaagattgctagcccacaaggatgaccccgtcaaagcattcgcagacaaacccttctacaaaccagcaaaggacggaggccaaggttccctagtaaaagcagttcggatcatagagaacacaaagcacggcctgaaaatacgaaacgggatcacggacaccaacggagacatggtacgcaccgacgtataccagaaaacagacaagaaaggtaaaagacaatacttcatcgtgcccgtctacgcctggcaagtcgagaaaaacgaactaccaaccgtcgactgcaaaggatatgaaatcgacgacaattatgagttctgcttctcactatacaaatacgacctaatcgaaatccaaaacccaaacgacataaaccaagaactaagggcatactacatcaactgtgatagcagcgacggtcgattttggctcgcataccacgacaagtccgctaaggaacaacaattccgaataagcacacaaaatcagccaataatcaagaaataccaagtcgacaccctaggaaaagagatccgtctctgcaaagccgagaaacgtacggctctaaacggcaaaaagaagaaatga

SEQ ID NO: 6228 - RNA, 3294 nt, synthetic construct
  misc_feature 1..3294: note = Cas9 variant
  source 1..3294: mol_type = other RNA
atgggtaaaggcgacatactcttcagtttcgacataggaacgaacagcatcgggtggtgcgtattcgcactatcagacaatggagatccgtgccgcattctcgacgctaatgcgagaatcttcgccgacggacgagaaccaaagtcaggcaactcattagcagaaggaagacgggcagcgagagccatggccaggcgccgtgaccgatacaaaagaagacggaaagcagtcctccgaacactaacagagtacgggctaatgccggcggacccaaaagcccgacaagccctcgtagccaaaacaggcgacaggggacccaaatcagaagaagcactagcagacgtatactcgctaagggctcgagccctaatggaaaaactgccgctacaccacataggccgcgccttattccacctcaatcaacgcagaggattcaaatcaaacaggaagacagacagaaaatcaaatgaaaaaggcgcgatagaaaccggagtcaatagactcctcgaagaaatgcgcgataccggagccccgacactaggcgcttacctagcgaagcgccgatccgacggtagacccgtgagagtcagggcaggagccagcgaacaagaagccgaagacggcaagcccgcaaaaacggcctacgacttctacccagtaaggaggctactggaggaagagttcgacgccatctgggaaaagcaatactcttaccatccggaagtgctgaccgaagaaagaaggggacacctcttccgggtaatgtttcaccaacggccactcaagcccgcaatagtaggaagatgcagcttcaactcggccgaaacccgactagctaaagcacacccactcttccaagagtttaggttatacaaggaggtcaatgaactcgaagtagtaatgccagaccaaagccatcgcaaactgaccctaccagaaagagacaggctggtcctaaagctcagaggccagaggaaagcgacctacgcagcactacgcaaagagctccgcctgcgcgatctcaggttcaacaaagagaccgaaaatcgaacagacatgatgggagacgaagtaaccgcagccctcgcagataaggcagtattcggcaaccgatggtccggcttcagcaccgatgaaaaatggagaatcgtcgagcgactacgagaagaagaagacccattcgcgctacacgaatggctagtatcagaacacgggctatcagacgcagaagccgaacaagcagccaaagtccatctgccagacggatatggccgattaggccccacagccgtcagcacaatgctggaggagctaaaagccgacgtaataacagaagccgacgcagcaagactagcgggatatgaccacagccttgcgcgcgccgacgaagacggtctagacagattgccaaaatatcaagaggtactcgagagaaggatcccaccgggcaccaacgacccagacgacccatacgacatagccaaaggaagaataaccaaccccacagtacacatcgcactgaaccagtttcggcacgtggtcaacgctctagcgagacgattcggcaaaccagaccaaatcgccatcgaactggcaagagagctcaaactgaacgaccgacagaaagacgaagtgaatcgggtgattggacggaacacacgagcagccgcactaaggagccaaaagctacgcgacataggccaaaaagacaacggttacaaccgagccctgctgaaactatgggaagaacttaaccccgacaaaccggaagaccgggtatgcgtttacacggggcgcccaatctgtatctccatgctattcagcggcgaggtagacgttgaccacatactaccgtggtcccgcacaatggacgacagccaagccaaccgtatattatgcgttgtagaggcaaaccgagtcaaagcaaatcgtgcacccgcggaagtagccgagtggggaggaaggtacgacgaaatactggaaagagccgcccggctcccacgaaacaaacggtggcgcttcgcaagagacgctatggaaaagtacaaggaaaatgagggcttcctcgcacgtcaactcaccgacacacaatacctaagtagactcgcccgcgagtacgccgaagccctatacccaacggaagaacctgaccgccttggcgaactaagaaggaggaaccacgtacgcgtaataccaggacgactcacggagatgctacgaagaggctggggcctaaacgcactcttacccgaccacaacttcggcgcaggccaagctaaaaacaggaaagaccaccgacaccacgcaatagacgcagcagtagtcggcgtcacgaccagagggctgctgcaacgtatcagcactgaggcaggactacgggaaaagctggcactagaagaaacaatcgcagacatcccgatgccgtggccgggctttcgcgaggaactaaaagcggcgatcgaccgcgccgtagtgagccacaaaccggaccacggcaccctcccaaaacccggagaacacggcagaacagcgggccagctccacaatgacactgcatacggcattaccggcgaaaccgacgcacgcgggaacccgatagttgtccggcgaaaacctttcctaagcctcacagacaaagacataccgtcaatccgagacaccgagctacgaggaagagtatactccgcaacatcaggcctctccggaagagaactttcagcagcactagactacttccgcaagacggacaagcagttccgcggcatacgacacgtccgagtcacagaaagcctgtcagtaataccgatcagggacagagacggaaacatatacaaaggatacaaaggggacgcaaatttccgttacgacgtgtgggaactgcccgacggcaaatggaaggcggacgtagtcaccatgtttgacgctcacaggccagaccgcgcagcggaagaacgacgcccacacccagcagccagaaaagtactttcgctcaaacaaaacgacatggtagcatgcgaacaccccaaagacggatacacaataggcagagtcgtgaaattcaacacagccggacaaatatacttcgccgcccacaacgaagggggcagcctaaaagccagggacgcagaccgagccgaccccttcaaatacttctccaaatccgcatcaggcctcaaggaaatagccgcaagacaagtccgcatagatgccacaggacaagtactagacccgggcccgcaagaccgagagtctcgactagcaaggaacaaacgtctagagagagaacgagcctga

SEQ ID NO: 6229 - RNA, 3303 nt, synthetic construct
  misc_feature 1..3303: note = Cas9 variant
  source 1..3303: mol_type = other RNA
atgaagtacaccataggactcgacatcgggacatcaagcgtaggctggggcgtaatagacacagaaagaaaccgcatccaagacctgggggtacgcctcttcgaatcagccgagaaccaaaaggacggggaaagcctcgcaaagccccgccgtgatgcaaggagtatgcgcagacgactggcccgccggggctcacggctcgaacgcgtaaagtccatattcgaaaaagcaaaatttttaacccgtggacagatggggatcacccacgcgcgaccaaacgacccctaccgcctgagagcagaaggcctcgaccggttactcagcaacgaggacctattcatagcagtctaccacctcgccaaacgccgcggatacaaatcaaaccgcaaaaacgtccttgaaggagacggagaagacgtccgcgagggtaaagccgtcttggacggagtagcacagaacaagaaactcatggccttccgcggatatcgcacagtcggcgaaatgttctttaaagacagcgttttcaccgaagccaaacgcaacaaagctggcagctataaacactgcgtcctgagagaaatgctcgaagacgaactaggaaagatactacatgcacagcgcagcctcggcaatacattagtgaccgacagcttcatatccaaacttttagagaagaaaaccggggtcttcgtttaccagcgtcccttcgccagcggaaaccaaatactcaaactcgtcggtccatgcacattcgaacccgaggagatcagagccgccaaagccacctactccttccagtacttcaacgtcctccagcgcctgaacaacctcaccattaaaaacaccgatacggggacagaaagaaaactcacctcggaagaacgcgccaaaatgatcgcattcatcttcagccacaaagacgtgcagtacgcccaaatccggctcgagctaaaactctcagatgtcgacagatttaacatggtgaactacttcgtccaaagaaaagaactcgaaacgaaaacagccgaggaactcagacgagaaattgaaaagaaaacgaaattcccgtccttgtctgattactacaccataagaaaaacagtctccgaaatagactccgcattctggattcagatagagaaacagcacgacgtcatcgacgccatcggcgaaatctttacactctacaaaaccgacgaggacataatcgcccaactaaacacaagaatcccctccatcccgcgaccagtggtcagcgccctcctcggcctcagcttcacaaagttcggtcacctatccttaaaagccctaagaaaaatcatcccgcacctagagaacggcgacacatatgacgtcgcctgcgcaaaagcagaccccaaatacacagacagagcaaaaacacgcgcccgcaaactccgcccactcgataaagaggaccacagcatcaccaacccggtcgccagacgcgccatagcacaaacaataaaagtcgtgaacgccatcattgacaagtacgacagcccctcagaggtacacatagaactcggacgagatctcgccaaaaatttcaaggagcgcatgaagatccaaaaagagcaaaagcaaaaccaagagggcaacgaacgagccatagccaagatacatgagctctacaagctcgaaaacccgaggggccaggacatcatcaaattcaggctgtggaacgaacaaaacggccaatgcatgtactcaggagaacgaatcgatgaaattcgcctattcgacaacggatacactgaaatcgatcatatcatcccctttagccggtccttcaacgacagttacagcaacaaagtcctagtactcaagatgcgaaatcaggagaaaatgaacaaaacaccctacgaatacatgggaggcgatgccgacacctggcaaagattcgaaaacctagtaaattcaatgcacaacatcggccccaggaagaaacaaaacctgctcttaaagaaatacgtagcagacgacctcaccctaagaaccctaaatgacacccgattcattgctcggtacatgaaaaactacatcgaaaacaccctcctgtttaccgaaggaccacaaaagcaacgagtctacacagtcaacggccaagccaccgcatacctgcgaaaaagatgggtcctgcacaaggaccgcaccgaaaacaaccgccaccatgcccaagacgcagttgttgtagcagtggccaccccatcccttgtccaaggaataatgaggcatgcgaaaatgggcgaaatagtggactacctacactcacaaaagtttgcccccaacgtcacagatattgaaaccggcaaacccttcgaatccgcagacatccagagcgcaaaagaacgcataatagccaaacacgaacaccgtctccgcatccccgaaccttgggaaggcttctcagacgaactcgatgccagaatgggtgacgatgtagtagaaaaactctcactccgtaaatccaacatacatggctacaaaaccacatccgacttctcgcaaatacaccccatattcgtcagccgcatgccgaaacgcaaaacaacaggcagagcccaccaagaaaccctgcgatcgccccgccgcttcaaagagttccaagagtcggtagtgcgaactcccctatcgagcataaacctcaagaaactggaggagatgtccggtaaaaactcagacaaactcctctacgacatattgcgcaaacgcctactcgcgcatggggacgacccaaagaaagcattcaccgagcccgtccacaaaccccgaaaagacgggacacaaggccccctcgttcgatcgatcaaaatggtaagcgaaggacaacgctccggcattctagtcaacaacgaacaagcacttgtggaccaagactccatgatccgcatagacatattttccaaacctaacaagaagggcaaggacgagtactacataatacccgtctacgcctaccacttcgcccagaaggaactacccaataaggtaataacagcaaaagccgaagccgactggaggactattgacgacaccttcgcatttgaattttccctatacccgaacgacctcgtcaaactaacaaagggagacgatatacgcttcgggtactactcgggctgcaaccgcgcactcgccgccattcacatcttaccacatgaccaaaatatgccactcgtgaacaacggcatcaaaactctagacaaaatcgataaatacgtcgtcgacatcctgggagagtatcataaagtgggcaaagaaacacgacaacaaatccaatga

SEQ ID NO: 6230 - RNA, 3303 nt, synthetic construct
  misc_feature 1..3303: note = Cas9 variant
  source 1..3303: mol_type = other RNA
atgggagcgacgatcgtaacggatatcagcagaagcgcattcgccttcgacatcggcaccaaaagtatcggaagtgctgtactacggttagacgacaggggagaaccaataggaataataaacgcagccgtaagaatatacgccgacggtagagaaccaaaaagcgggacgagcttagcagaaggcagaagactcgcacgaggaatgagtagaagacgcgaccggtacaagagacgacgacggacgctactcaacacactgaccgaatttggcctcatgccacccacagatgaagcaagaaaagcactactcgccgaaactaacgacagacgcttcggggcagtagcgggcaacgtatacgcgctgagggcgagggctctcgacgaaaagctcccccttcaccacctcggtcgggccctcttccacctaaaccaacgccgaggattcaaatcaaaccgaaaaaccgacaaaagagacaacgaccaaggcaagatagccagcggaatcagccgactagggcaaaagttagatgaagcgggagcacggacgctaggcgagttcctacacagacaacacagcgcaggcaaatgggtcagagtaagaccaagcagagtaccgagcaaggacgacaaagaggaggacggatacgggttctaccccgagcgcagctttctcgaacgagagttcgccgcaatctggaaggcccaggctgccttctatccagaacttctcaccgaagaacgtggagaccatctgcacagagtaatgttcttccaaagacccctaaaacgtcccaaagtaggcaaatgctcattctatcccgatgaagacaggctgccaaaagcccacccactcttccaagagttcaggctagtgaaagaactaaacgaactagaagtggtccaccgaggagacagaagagaaaaactaacgctagaacagagggacacactcttcaatcagctgcgcacacaaagaagcagcgcatttacggcgctacgaaagacactaaaagccccaaccgggacgcgattcaacaaagaaagcgacgcccgcgacaaactaaaaggcgacgaagttgccgccgagatgagccataaagacagattcgggcaagcatggataggcatgcccttggctgaaagatgggcggtgatagaaatgcttctagatacagaagacccactcgaagtaaaagcctggctcgaagaacactacggattcgctgcagaccgaatagacgcgatcgcagcggcgaaacttccaccaggctacggaagactcggcgagaccgcactcagagacatgctagacgagcttaaaaacggaaccgtcaaagacgactcaggccgtgacgtagtactcacagaacgacaggcgatggacaacatatggaaagacaacccagccttacaacgagtagtcgcagacgcgcgagagcttcccccataccaagaagtactaggacgacggatacccccaggaacgggaaaaccagaagacccatacgatgttcaaaaagggcgcctaaccaacccaacagtgcacatcggtctaaatcaactaaagagagtcgtcaacgccctggtccgccgccacgggcgacctgaccaaatcgcccttgaactagctcgcgaactcaaacttaacgaggaacagaaagcagaaaaagaccgtgaaatcgcgagaaatacgaaagcggcacaagcacgatccgagaagctacgccaattggacatagacgacaacggatacaaccgagtgttactgaaactttgggaggacctaaacctccgccaaccggaaaaccgcgaatgcatatattgcggtaaagcgatcggaatcggaacactattcagtaaccaagtagacatagaccacatccttccatggagcaaaaccctcgacgacagccaagcaaacagaatagtatgccacgtggaatgcaatagacaaaaaggcaaccacgcgccggcagaggtaccccagtggcatgacagatacgacgacatcctggccagagcagagcgactcccaaggaacaaggcatggagatttggcagggaagctatgaagaagttcaaagacgacgaatcattcctcgcacgacaactcaccgacacccaatacctatcgagaatggcccacgagtacgtagcagcattatatcctgacgaggaaccagatgagtggggagtcttcacacggcgcaaccacgtccgagtcataccgggcagaatgactgaaatgctacggcgccaatgggggctaaacgcgataatctcagaccacgaccaaaagaacaggaacgaccaccgccaccacgcaatcgacgccatagtcgtcggcgtgacaactcgacgcttactccaacgaatagcgacagcagcaggagggcgagaagcactggcactcgaagaaaccataggtaaaatcgaaccaccatggcccggcttctacgacgacgtaaaagaggcaatcgatcgaatagtcgtaagccacaaaccagaccacgggagtctccccaaaccgggcgaaccggctcgaacagccgggcagctgcacaacgacacagcctacgggttcaccggagaagaacgcaagggtgtcccgataatggttcaccgcgtgccgttcgcaacattaacagaaaaggacatcccctcaatccgcgatcgacagctagcagaagcactatacggagccatagccggaatatcggggaaagccgagctcgcagcagcattagcgcgtttctcagcatcaggaccttacaagggtataaggcacgtcagagtggtagaacccgtgagcgtcatcgcaatcaaggaccgcgacggtacaccgtataaaggctacaaaggcgacgccaactaccgatacgacgtatgggaactaccaaatggcaaatggacccacgaagtcgtaagtatgttcgacgcacacagacctgactggcaaagtgaaatacgtaacaaaaacccagcagcccgcaaagtactgtccctacaccaaaatgatatggtagcctacgagcatccccaagatgggtacaccatcggacgcgtcgtaaaattcggcagcggcgggcaaatggcactggcgggcaacagggaagggggagcattaaaaagcagggacgcggaccccgaagaccgtttcagatacttctataaaagcgggggagccatgagagacgccagactgaggcaagtacgcgtcgacgagacaggcagagtattcgatccaggaccacaagaccgagaaagcagaaacgcacgcaaacaaagcgccgccggctga

SEQ ID NO: 6231 - RNA, 3306 nt, synthetic construct
  misc_feature 1..3306: note = Cas9 variant
  source 1..3306: mol_type = other RNA
atgaaaaccctaggtttggatctgggcacaaactccttaggctgggcaatcgtagaaacaagagacgaaccaacgaaatacagcgaaggatcaattgtcgcatcaggagtaagaatcttctcccaaagcgaaatggcagggagagatccccaatcgaaagccagcctcgcggtagcccgacggcaagcacgaggatcacgacggagacgagaccgatacctcaagagacgacaacggttagttgacttactggtcgacctcggcctaatgccggcagacaaagcggcacgcgcagaactggtcaaaaatcacggagacgggaagacaggggacctctcaagcagcgtatacgcattgcgtgcccgcgcattggacgaagcactaagcccgtacgaaatagggagagccatcttccacctgaatcaaagacgcggcttcaaaagcaaccgaaaagcagatagcaacgacccggagcagggagtaatctcagaaggaatgagagcacttgacgagaaaatggcagaagcaggagcacgaacaataggtgaatggctgcacatgagaagactacaaggcctgccagtacgcgcccgaatcgcaccggacggagaaggctacgcgttctatcccagtcgaggggccctagaaagggagttcgatcgaataatggcaagacagacactgttccacacagacctcctaaccgacacagcaataagggaactacgagaggtggtctttcaccagaggccgcttaggccagtaaagcccggaaaatgcagctacaaccccctggaggaacgactagcaaaggcccaccccttgttccagaaattcagactactaaaggagctaaacgaactagaaatagtaggggaagaccaaaaacacatcaagctaacacccgaacagaggaacgcactggccctgcaactccgcacgagcctaacgaaacagggcaaggtaccattctcgaagctgagatcaacactaaaactcgggcgcgaagtccgtttcaacaaagagacggataacagaagcgaccttgagggagacgtcatatactttcggatgtcccgacccgaatgcttcggaaacagatgggcagacctccctgtggaaatgcaagccgcaataaccgaaagacttagaacggaacccgactacaaaacactcatgaattggctcaaagcagagacaggcctggacgaagtccacgcgcgagcggttgcagacacgcccgtacccgacgggttcggccgcctcggccagtcagcgctgacagcactaatcgacgcactagaaaacgaagtgggagaaggaggcttcgtaatcacagaggccgaggccgcgaaacgggtatacggaaggacgaacagcgaagcagatcccgatcgaaaaggagtagatgaactccccaaataccaagaagtactcgcccggcacatcccgcccggcaccggagaacccgacgacccgtatgacgacttcatgggaagaataacaaacccgacagtacatatagctctaaaccaattacgaagagtggtaaacgcgctaatcagaacgtacggcaagcccgacagaattgcaatcgaagtcggacgagacctaaagatgaacgaccgagaacgggacgaggtaaacagaagaataggacgaaacacaaaggccgcgatcgagaggggagtcaaattaacagaaacattcagacaactagacacaggatacaacaggctcaggctggaactctgggaagacctaaatcaaaaaccagaaaacagagtctgcatatattgcgggaaagccatcgcaggacacatgctgttcaacggcgagacagatatagaccacatcctaccgtacagtaaaacactcgatgactccaaggccaacagaatactatgctgcacctcgtgcaacagagagaaaaagaaccggccaccaagccgcgtaccacaatggagatcacgatatggagaaatactcgcccgcgcaacgaccctcccgaaaaacaagcagtggagatttgcagaagacgcaatgacccgattcggcgaagaagaaggcttcctagcaagacagctcacagacatgcagtacatctcacggctcgccctcacatacctcgcacacctgtacgactatgaagaagtagacctagacggaatctacaaaagacacgcgagagtcagagccttaccaggcagaatgaccgagatgcttcgtaggcaatgggggctaaacgagctgctacacgaccataacctcatagggggcgacgtcgccaaacccaaaaaccgcttagaccacagacaccacgccatagacgcgattgttatagcttgcacaagcagagcactgatccagcgcctggccacagcgagcgccgcagccgaagaacgcggcgcggaaagggtcgtagaaagaatagacccaccctggagcggcttccgagaagacgtccgcgcggccgtcggagcaatagtagtaagccataaacctgaccacggaacagtcggaagagagggatacgcgaaaggacgaggccaaacagccggaaaattacacaacgacacggcatacggacatacaggggagaaggatgcaagcggaaacgatatagtcgtacggcggatcgcagtaactgacatacgaagcccagcggacatccgcaaaatacggacgaacgcacacggacactcagaactccgagaccgtctatacgaagcaacaaggggtttagagggaaaggcgttcgaacaagcagtcctcgacttcgtcaaaggagacgcaaaattcagaggaatccgccacgtccgaatcaccgaagtagccaacccagtatggataacccacggagacggaaggcataagaaaggatacttaccgggaggcaacgacagattcgacgtctgggaactggccgatggccgatgggacgccgaagtcgttacaactttcgacgcccacaggcccggatttgtaccacggatgagattagaaaaccacaatgccagaaaaatcatgagcctaaagaaaggggacatgatcgcctacaacgaccccgtatcaggacaaagaattatagccatagtgagaaagttcgatcaacgaaacaagcaactgtatctggatccccacaacgaggccggcaacctagaccgaagagaaaaagagaaaacatacaagccactgagaccaatgccaaacccactcaagaaatacagaccacggcaagtcagaatagacgaaataggacaagtgttcgatccaggcccatggtgggaaagacaagacgggtga

SEQ ID NO: 6232 - RNA, 3306 nt, synthetic construct
  misc_feature 1..3306: note = Cas9 variant
  source 1..3306: mol_type = other RNA
atggagcaaacctccctcgacctgtcccaagcaatgaagaaagtcgcacagccacaaaaaccatacagactcggagtagacgtaggcgtagcaagtattggcgccgccgcagtcacagacaccgaaatactaggcatccacgtacggacgttcgaaaaaggagagatcaacggcaaaagcggccggaagccccttaacgcagactaccgcaggcaaaaagggcaacggaagcggctacgcagaaagaaaaaccgcctactctcgttaagaaggctattccggagagtcgggatgatcgaatccgcggctatcgaagcattcccaataagtagcacctcaccctggcaactacgcaccgaaggcctagacaggcgcctcactaacgaagaatgggcacaagtactataccacatcgcaaaacaccgcggcttccaaagcaaccgcagagtagacatggacgaagcaacaaaactctccgacgcagcaggagatagcccggaaacaaccactaacaccgaatctgatagcgacacaaagaaaatgctcgcaggagtcgccgacaacaaacgactactcgctgagaaaggctaccgaacaataggcgaagccgtagcacgggacccaaaattttcgcacaggatccgcaacaaagaagaatcctattcccacaccataggcagagacgaaattaacgccgaactcaactgcctgttccaggcccaaaatcactacggaaatccacacgccaccgaggaactaagtgaacaaataatcgacctaataaactggagacgcaaaacagttaccggagatgacatcaaacgaatggtaggcagatgcacactagaacccaaagagtatagagcggcaatccacagcgtaagcgcagaagagttccgctggctatcaaccctcagccgattacgtatagtaacccaaggagaatcacgccccctcacaaaatgcgaatgggacaaggtagtagacctaccctggaggcaagaagccattacatacaccagcatccgcaatgcgatagggctccgacacgacatccgatcccgattcaacatacgctacgaaacagggggaaagaaaacgaaaacggacaccaaaaacgaaacgaccaaaggtcagtccgccgacgcagtcacctccgaagtaaaaacagcagaaaaagaaaccgcatttaaagcaaaaggctaccacatcctacgaaaagcatataaagcgttcggttacgacgaacaatgggaccgagaccggttcaacacagaactactcgacacgctagccacggccgtcaccttctacaaagacgactcggagatacaagcccacctcgaaacaaacgacactccagaatacgcaatccaaatcgctctccggctccccaccctaactaagttcagcaaattatcgaacaaagcgatcctcaaaatacttccccacatgcgcgagcgacaaagctactccaatgcatgccttctagccggctacaaaaaccaccacaaacaatacgacgacacaccccaaaacggcaaaatcccaagatctgcaatcgagcacatcaaaaacaccgtcgtctacagatccctaaaccaagcaaggcgtgtaataaatgcaatggtaaaagagtacggcgcgccacaggaagtgcacatcgaactcgcccgcgacatggagaaaagcgcaaagaagaaagacgaaatcgacctatggatgaagaaacgcaaaaagaaaaacgacgaactaagagaacggttcggcaaaaacttaagccgcgacgaactcctaaaatacaaactatatgaagaacagaatggacaatgcgcatatagcctacagccaatccaattaggacgactgctagaacccaactacgtagaagtagaccacgcactcccccgatctaggtcgatggacaattcgtacaacaacaaagtcctagtactaacaaaacaaaaccgggacaagggcgacaggaccccgttcgaatacttcggagaagaccaagagagcgtagactggaagagatttacgaactgggtcgaatctaacccacaaatgccacaggcaaaaagacgcaagctcctgactaagagcctacaaaaaggaatcctagacaatttctccgccagaaacctatccgacacccgttacatcgcccgagagctcaagacccttatcgaacactacatcctcaacacaccggaaagagaaaagacgaagtacgaaagatgcgttgtcattagcgggaaacttaccgcccaaatgcggcaactatggggcatctcaaaagctcgcgacgtctccgaccgccaccacggcagcgacgcagccgtgatcgcgtgtataacgccatccatggtaagaaggatcacgcgctatctccaactccaggagagacgcgccatgccgagcgcgcctggaaagggagacgaacaccccgcggtagtcgcccgagccatcccccacgcgccagtaccctggcctacattcgaacatgacctagaagccgcgctcgagaaagtactcgtgtctcgaccccaatcacggaaatggagcggccccatccacgcagacaccatatacggcgaacacaaagaccaggaaacaaacaccgtagcaccaacacagcgaatcaaactcacccaattaacgaagagtaactacaagaacatagtaggctatgacgaagaacgaaacaaagacttcatcgaccagatagaagagagactggaatgccacaactttaacggcaaacaggcgttcggaacctcacagtcaccgatataccgaataaagaaaaacggagagctaggccccgaggtcaagaaagtgacgatcaaactgcctatcaaaaactcggtattccgcatacggcgcggctacgtcaagaatgccaaaaactccacaatatacatcaatatctaccaaaacacaaaaacgggaaaattcgaaatgcacccagtctacgcaaaggacctgacgtcctcggccaacgcgtccaaatcctttgagtacagcccagatctacaactcgtcgacacaatacgccgcggggactacatagagataacaagacgaaacggagaagtaatctccgggtactacgccacccacaacataagcacatcagtcctcgaactacaaccgcatgacactacagactcccgtaacaaccggaccccagccataaagacctcgctaaacatagagcggttccatatagacatactcggccgaaaacgccgagtagtccgacgcgccaaaaacggactagcagacgatcgagacaaatga

SEQ ID NO: 6233 - RNA, 3309 nt, synthetic construct
  misc_feature 1..3309: note = Cas9 variant
  source 1..3309: mol_type = other RNA
atgggataccgaatcggactggacattggaatcaccagcgtaggctacgccatcctcaagacagacgagaaaggctcaccctacaagatcgaacaccttacctcagtaatatttccgatagcagaaaacccaaaagacggcaaaagcctcgccatgccaagacgcgaacaacgcggagcacgacgaagaaaccgacgaaccaaattccgcaaacaccgcacgaaaatgctgttcgtacgaagcgaactcctcacaatcaaacaaatcgaagctatctactcggaaaagcagaagttaagcagcatatacgagctccgaaccaaagccctaaatgaacgactcacaaatgaagaactcttcagaatactgtacttcttcagcggacaccgtggcttcaagagtaaccgcaaatcggaacttaccgaaaaagacatgggtcccgtgctgactgcgatcaaagacatagaggaaaaactagccgacgggacgtatcgaaccctaggagagtacatggaactcgacgaaaagtaccaggaacacaaaagaaacaaagatggaatcgaccgatacctgggcaccgccaaacgaagcctgatagaagatgagataaaacagatcataattgcccagcaacaattcggaaacacaaaattaacaagcgggttccaagtagccttcatcggcgacgaggaacaaacagggatcttcaacgaccaaagagagttcgaggacggacccggaaagcaaagcccctacgccggtaaccaaatcgagaaaatgataggagcatgcacatttgaagaaaacgaaaaacgcgcaccgaaggcttcatacaccttccaatactttgacttcttatgcaaactgaacaacctcaagtaccgagaaacaataggaggggagtatcgatttctatccctagaacagaaaaatgtcctcaaggaaaaagtcctcaccacccaaaagatcacattcagcggcgtcaagaaattactagacctccccgaacacgcacaatttaacttggtaaattacggaaccaaatccacagtgaaagagaccgaaaccaaatccgtcttctacgcgatgatatcgtaccacaaactcaagaaagccatcccagcccccatattcagcaacctctcaacagccgagctagacgaaataggccgcattctgaccctatactcgtcggacaaagggcgcaaaaacgaattttacagccgactcgccatcccagaagaagtcgtcgaagcacttctaccaatcaatttcagcaagttcggtaatctctcgcttaaagctatgcgaaaaatcataccctacctcgagatgggcctagtctacagcgaagcggcaacccaagccggatacgactttcgacacaagaaaatcgaccaagcctacatccatgaaaacgttaccaacccagtcgtcaaacgcgcggccagccaaaccataaaaatagtaaacaacatcatacgaaaatacggagaacccgacggaatcaacatcgaactagcacgcgaactgtccaaaaacttctccgaacgcaaaaagaccgtaaaatatcaagaggaaaaccgagcgcgaaacgaacgaatcgcagacaagctccgcgaatgcgaactcccagttaacggcgccaacataacccgtctcaaactcttcgaggaacaaggtgagttcgatccctacacaggactcaagatccccttcgaccgagcgttcagcgaagaatacgaagtcgaccacatcatcccttacagcaaaacactggacgactcctacgggaacaaaattctagtctccgctaaagcaaaccaagagaaaggaaaccggataccaatggaatacctccagggcaagccggaaagaataaagaaattggaaagcatcacggcaactatcaagaaccccaagaaacgcgaaaaactcctaaagcaacaactcacgaaggaagacgtcgacggctggaaaacccggaacctcaacgacacccgctacatctcctcactactccacgactactttaatcagaacatatcattcgcaaaactggagtccgagaaaaagaaacgcgtgatcgcagttaacggagccatcacgtcaaaactgagagcgcgatggggcttcaacaaaattagggaaaacggagacgaacaccacgcgctcgatgcactaatcgtagcgtgcgttactgacaaatacatcaaagaaattacgtctttctccaaacgaaaagaagtcaggtttaacgaaaacctatggaaacgagaaaagacgccccaagagatagaacaggaagtagtacacttcaagaaagactacgaccggatattcaaccaagcattccccctaccatggaccaactttcgcgaagaggtcagctgtagaatgagcgagaacccggcggagctgatgaaaaaccatacatgggagacctacactgacgacgaaatcgccgcccttcggccgattttcatcgtacggatgccaaacatgaagacatcgggacccgcacatcaagaaaccataagatcgggcaaactggaagaaaaaggacttaacatttcacgagtaagcatagagaagctaaaactcgacaaagaaggcacaatcaaatccgggaacgcgcaattctacaaagactccggcaacggttggcaactactacatgataaactaaaggtcgccctcgaaaaacacgacggagacggcagcaaagccttccccgacggcgtcttcaaataccaatatcttgataaggagcacacagtacgaaaggtccgactcgtcgccaaaagcacactacaaaccagcctcaacgagaagaagtcagtcgctgataacggctcaatgatacgcatcgacgtcttcaggaacgagcaaggcaaataccaattcgtcccaatctacgccaaagaccgagtagccaaaaagctgcccaaccaggcggtcgcagtcggaaagattgcaaaagaatggccactcatcgaagaatcggactttaaattcagcctctacagcaacgatctcatcagagtaaagcacaagaaaggagtcaaacacgtctccaaagacggcaataaagaagaaaagtcaaagacagacttcttcggctactacacaggagcagacatcgccaccgcatccatctcaggaataagccccaacaatttcttcgagttcagatccatgggcctggcgaccctaataagcatcgagaaatacaaagtcgactacttcggaaactaccaccaggtcaacgagaaggtccgacagaaattcccgaaaaaccgcatgtga

SEQ ID NO: 6234 - RNA, 3312 nt, synthetic construct
  misc_feature 1..3312: note = Cas9 variant
  source 1..3312: mol_type = other RNA
atgaagtacgacatcggcatagatattggagtcgcaagcgtaggcgaggcggtaatagaccaagagggaaacatactcgaggcctgctccaacctattcgacgaagcagacgcagccagcaacgtagacagacgaaactttcgggaaggtcgcaggaacaaacgccgtgagcgaacgagggttaacgacttcaagaagctatggaccaaattcggcttcgagatcccgaagaatgtaatgaacgacacgatactactccggaacaaaggcataaagtgcgaactagacctcaccgaactgtactccgtactactgtacatgctaaaacacagagggataagctacctcgaggacgcgatcgacgaagcaaagggatcaaactatgcgaagggaatagcactaaaccagaaggaactaaaagaaaaactcccctgcgaaatccaactagaacgactcaaaatctacggaagctaccgaggggactgtatcgttaagaaagaagacgaggacgaataccactcgaacgtgttcacgatcagcgcctacaagaaagaactggagatcctattccgcaaccaaaaactcccagaggagttcatacaaggctacatgaagattttcgaacgcaaaagagaatactacataggacctggaaacgagaaatcacgcacggactatggggtgtatacgaccaacaaggacgaagaagggcactacataacggacaaaaacatattcgaaaaactaataggcaagtgctcggtctacaaagacgagttccgggccgcaggggccagctacacagcacaagagttcaacgtgctcaacgacctcaacaacctcacggtgaacaaccgcaagctcacggaaaacgaaaagaagaaaatagtggagaaaatcaaatcaagcaatgcagtcaacatgagaagcatcatcaagaaagtgcttggtgaagatatcgaacaattcggcggcgcccggaaagacaaagcggacaaagaaatctaccacaccttcgaggtatacagaaaaatgaagaaagaatttgagaaaaacggaatagatatcgcagacttcagccgcgaaaaactagacgaaattggaaacatactaacgctaaacacagaaaccgaagggattaaaggtgccctccacgaagccaaaaacagcttcacgtactccgaaatcgagacactgatagacatcaggaaaaagaacagcagcctgttctcaaagtggcagagcttaagcctaaaaatcatgaacgaactaattccgcaaatgtacgcacaaccgaaggaacaaatgcaactgctaaccgaaatgggagtcttcaagttcaagagcgtgaagttcaagaacagcaagtacataccagtggaagaaatcatcaaagacatctacaaccctgtcgtagtacgcagcgtgcgcaccactatcaaaatgataaacgaaacgatacgaaagtacggctaccccgacaacataatcatagaaatgccacgggacaagaacagcacagaggaaaaagagagaatcaagaaagaacaatcgaaaaacgagaaagagtacgaaggtatcttaaagcgaatcaaggacgaatacgacatagagataaaccgagacgactaccgcaaacaggaaaagctcgcactaaaactgaaactctggaacgaacaggaaggcagatgtccatacagcggaaagatgatcagcatatacgggctgctggaggacccccaactcttcgagatcgaccacatcatccctaaatcgatcagcttcgacgactcacgcaacaacaaggtcctcgtataccgatcagaaaaccagaagaagggcaacaacacaccatacatgtacctcagcaaaggagataaaaactggaactacgaccaatacaagagttacgtcctcggcctgaagaacaaaggaaacataagcgacaaaaaggtcaacaacatgttattcatggaagacatcaacaagatcgacgtgctcaagggcttcattacccggaacctaaacgacacccgatacgcctcgcgggtcgtgctaaacatgctccagagctttttcaacgaaaaagacggctgtcccaccaaagtaaaagtaataagagggtcattcacgcaccaaatgcgcgtaaacctcagaataaacaaagacagagacgaaagttacagccaccacgccgtagacgccatgctaatagtttactcgcaacgcgggtacgaggcgtataggaagatacaagaagcatgcgtcgacttcgagacgggcgagataattgacgaagaaaggtggcagcaatgcatctggggcaaggactacgaccaagtaatgtacgaagctaaatggtcaaagatccgagagaaaataatcgaagccgaaaagaacgtcaagtaccaccaccgggtggacaagaaagtcaaccgcggattatgcaaccaaaccatctacggaacacgaataaaagacggcaaaatatacaaaataagttcttacaacatatacgacaacaaggaatgcgcatcgctcctaaaaatgataaaagggggtaaagaaagcaagatactcatgtacaactacgattcgaaaacatatagagacatgataaagatcatagacgaatacagcgacgagaaaaatcctttcgtcgcctacatgaaagaaacaggagactacttccgtaaatatgccaagaaacacaacggtccgaaaattgaaaaagtcaagtattacaaagaagaagccgggagctgtatcgacataagccacaagtacggctatgaaaaaggcagtaagaaggtaatcctgggaagcctcaacccctaccgcacggacgtcttcttcaacgaaagactcaagaaatactacctaattggcatcaaatacaaccacatcaaatgcgagggcaacaactacgtcatcgacgaggacgcgtacaacggcttactgagagacgccggagtaatctcgcacgaaaataccataaatgacctcgaaaaagtaggcgtaaaatacctattcagcctctacaagaacgacataataaagtacgagaagaacggcgaaatgttcgtagagcggtttctcagccgaacgatggagtacgccaacaactacattgagaccaaacccatccataaaccattcttccagaaaaaggataagaagggcaacataaagaactcgcaaaacctcgtaggcctctcgaaaactaaatatatcggcaaactggtcaccgacgcgcttggaaacacatacatggtagaaaaggagaagttctccctgatcgtagacatatga

SEQ ID NO: 6235 - RNA, 3315 nt, synthetic construct
  misc_feature 1..3315: note = Cas9 variant
  source 1..3315: mol_type = other RNA
atgaagctaatcctcgccctagacatcggaatagccagtgtcggctgggcggtccttgacaagaaaagcgagaccgtccttgaagcaggctccaacatcttcccggaagcgtccgcggctggcaaccaggtgcggcgtgaaatgcggcaagccagacggatcaagcgacggcagcgcacccggctagacgacttcaacaagctgtggcggaaaaacaacctctccatcccgcagtacaagagcacagagatcgtaaatctcaaggtgaaagcactacgagaagaaataagcctcgacgagctgtatctaattctctattcatatctgaagcaccggggaatctcctacctcgaagacgcccaagacgacagcctcagtagcagcaatgcttacacaaacgggcttcgagagaacgcgaaggcgctggagaaacactacccttgcgaaatccagcgagaccgcctccagaccatcgggaaataccgaggccaaacccaaatcaccgacgacaataacgagaaaatcgacctctctaacgtcttcacaataggggcctacaggaaagagatcaagaaagtactcgaaactcagaaactctaccacaatgaactgacggacgaactgtgcgatgactacatactgatcttcaacagaaagcgcaaatactacgaagggccaggaaacgagaagtcaagaaccgactacggtcgcttcacgacacgcctggaccaaaacggaaattacatagacgaggaaaatatcttcgaaaaactgatcggcaagtgctccgtttaccctgacgaattgcggggcgccgccgcaagctacacagcccaggagttcaacctgctaaacgacctaaataacctgaccatcaacggccgaaagctcgaagaaagcgaaaaacacgccattgtccagagaataaagacaagtaacaccgtgaacatgcgaaaaataatcgccgactgcatgggggaaaccatcgagaacttctccggagcccgtatcgacaagtcagggaaagagcaattccacaagttcgaaacctacaacaaaatgcgaaaatcgctgtcagaaataggcaccgacatcgacgaattttcacgcgacgagctagataaaatagggtatatcatgacaatcaacaccgacaaggaagcactaatggaggcctttaacgagagcggtctaaacttagacgacagcgtcaaagagtgtctcatatccttccgcaaggcgaactcaagctcattctccaagtggcaaagtttttcactgaaaataatgaacgaactgataccagaaatgtatatacaacccaaagagcagatgactctgcttacggaaatgggcgtcgccaaagggagctccggggacttcgccggactaaactacataccagtcgacgtaatctccgacgaaatatacaaccctgtggtgcgacgcagcgtacgcatcagcttcaaaatactgaacgctgtacttaagaaatacaaagtactggacaccatcgtcatcgaaatgccgcgggacagaaacagtgacgaagaacgaaaaagaataacggacagccaaaaactaaatgaaaaagaaatggagttcatagaagggaagctagcccaaatctacaacataaaactctcgtccagcgacttcagcagccaaaaacaactctcactcaagctcaaactgtggaacgaacaggacggcatctgtctatactcaggacgtacaatcgatccagaagatatcataaagaaccccgacttgttcgaaatcgaccacataatcccacgatccattagcttcgacgactcaagatccaacaaagttctagtatatcgaagcgaaaaccagaagaaagggaatcaaacaccctacttctacataacacatagcgacggggcctggacgtacgagcaatttaaagcaaacgtgatgaatctgagcaaaaagaaagagtacgcgatatcaaggaaaaaggtccaaaacctactgtactcggaggacattacaaaacgagacgtgctcaaggggtttataaaccggaacatcaacgacaccggctacgcctcgcgcgtcgtcctgaacaccgttcagaacttcttcaaagcaaaagaagccgatacaaaagtcaaagtaattaaaggctcctacacacaccagatgcgatccaacatgaagctcgacaagaatcgcgacgaaagctacagccaccacgccgtggacgcgatgctcatgggcttctcagaaatgggttacgaagcataccgccggctgcaaggagagttcatagacttcgaaacaggagaaatactcaaaaatgacatgtggaacgaaaagatgagcgacgacgtgtatgtggactacctttacggcagaaaatggagcgccatccgaaacgaaatagtcaaagccgaaaaagacgttaaattctggcacttcatagtaagaaaaagcaaccaaggcctatgtaaccaaactataaggggaacccgcgaatacgacgggaaaaagtacaaaattaacaaattcgacatcaggacgaaggaaggagtcaagctctttaagaaactcgcattcagcgaaaaagaatcggaccgcgaaaaactactcgtctacctcaacgaccgccaaacattcaacaacttagtcaagatcttcgaagactataaagacgccccaaaccccttcgtacagtacgaaaaagaaaccggagacgtcgttcgaaagtactccaagagacacaacggaccaagaatcgacaaacttaaatacaaagacggagaggtgggcgcgtgcatcgacatctcacacaagtacggcctggagaaagactccagaaaagtcatactagaatccctagtcccataccgcatggacgtctactataaagaatcagacaaaatgtactacctagtaggcgttaaacagtcagacatcaaatcccagaacggtgcaaacgtaatcgacgaagacctctacacccgcatcctcataaacgagaaaatgatagaacccggacaaagccgcgacgacctcgaacaactagggtacgagttccgcttctccttctacaaaaacgatataatcgaatacgaaaaagaaggaaaggtcttcgtcgaacggttcgtcagcaggaccatgcccaaggtccggaactacattgaaacgaagcccatcaacaaagcaaacttcgaaaagcagaaccccgtgggcctcggaaaaacaaagtcgataaagaaataccgtaccgacatactcggcaatcgctacctctgtgagaaagaaaaattcacaaagttttgctga

SEQ ID NO: 6236 - RNA, 3315 nt, synthetic construct
  misc_feature 1..3315: note = Cas9 variant
  source 1..3315: mol_type = other RNA
atgaaccattacgtcctcggactggacatcggaatcacctcggtggggtacggcgtcattgacttagacaactatcaattcgtcgactacggagtacggctctttaaggaaggcacggccgaggacaacgtcaaccgacgcaccaaacgaggatcaagacgactgaagcggcgacgtcaaacccgactagacgacatgaaagaactcctacaaaaagagaaaatcatgagcgaaacttaccactcctcctacgacccctatgacatgcgcattaaagggctgtcacaaaaactatccaacgacgaactcacatgcgcaatcctccatataaccaaatgccgaggcaccacactcgaagccctcgattccgccgacgaagactccgaaggcaccaaatccatactatctaaaaacgaccaagacctaaagaaataccactacgtgtgcctcgtccaaaaagagcgcctaaaacaatcagggaaaattcgcgggaccgaaaacaacttcaaaaccgacgactacatcaaagagctcgacgaaatcctcagccaccaagatctcagtgaggacctctgcgagaaaatacgtacaatagtttcgagacggcgccaatactacgaaggccccgggtccgaaaaatcccccaccccctacggacgatggatcgcccaaggggtggccccgatcgacctaatagagaaaatgcggggaaaatgttccgtcttccccgaccaactccgcgcagctaaaaacagctacacagccgaactattcaatctcctaaacgacttgaacaacttagaatgcgaaggggaaaaactcaccacctcccaaaaacaagacgtcatcgacttcgtaaacgagaaaggcggaatcaccccaaaacagctcgcgaaactcctaaacgtagacttaaaccagatcaagggcttccgaatcgacaaaaatgataaaccactactcactgagttcaaaggctataaagccttcaagaaaatcttcgacacgaacaactgcgatctatacaagaaagacctatccatcctcgacgggctagctgagatcgtaacaggaaagaaaggcatcgaggaacgaaaacaggcaatccaacaagcataccccgaaatcgacgaagcaatcgtagaacagtgcgcagtgatgaaaggaatgacccaatatcactcactatcgctcaaagcgatgcacctcataaatcaggaaatgctacagtctccccgaaaccagatgcaagtgctgcacgaatcccacgtattcgacaaaaaccgagtatcacacaaaggacaaaaatacattgaagcagacgacgaggccatccttagcccggtggtaaaacgggcacaacgcgaaaccttcaaagtggtcaacgccctccgcgaaaaatacggcgagtttgaatcaatcgtagtcgaaaccaccagagacagaaactcccaggagcagaagaaacgtcttaacgacagccaaaaatactacgagcaagaaaaccggaaagtcgacgaactcctctcccacgaaggatacgatccatcaaaaatcaacggcaaaactaaattaaaggttcggctatacctccaacaagagggcaaaacagcctacacaaacgcaccaatagacctcaacctactaatcaaggacgccacggcatatgaagtcgatcacatcatccccctgtcgatcagcctagatgactcaatcaacaacaaagccctgattaaccgcacggaaaaccaaaacaagtcaaacatgacacccatctacgccatcctacgcggcaaactgaacataagcctcgatacctacaaaaccgtcgtcaaaaacaaccgcaattacacgggaaagaagcgctcctacctactatacgacaaagacatcacaaaatttagcaacatgcaagagttcatcgcacgcaacctagtagatacttcatatgcctgccgagtcgtgatgagtacccttagcgactacttcaaagacaacgagatcagcacccacgtacacaccgtgagagggagagtaacgaacatgtttcgcaaccgcatcaacatgcagaaggaaagggagaaggactatctgcaccacgccgtagacgccctcatagtcgcgtccataaagaaactcaacctactcaacacatacctcctcaaatataacttcaacgacctatacaacgaggaaaccggagaggtcttcgccgtcggcgacgaccaacaggtgctagaccccaaatacatcagattcatcacccaactgaaaaccatttacgacgaatcgaacatgtactataacggactaatagaaagaaacgtaatgcagttcccaccaataaagatcagccacaaaatagacacaaagcccaaccgccaaatctcggacgagacaatatactcaacccgtaccgtcggaaacgaagaatacgttgttaagaaatattcagacatctacgaccctaaattcacccagctgaccgacgacataatcaacgaccgccccctagaccgatggttaatgtaccgaaacgataaccaaaccttcaaaataatccagtccatcatcctcgaccattttcatatcttcaaagacgatgaaaaacactactcctgcactaaaaagaaaggacaaatacagtacgcactcaaaggaaagaacccactatacctatacaaacaagagcacggcaaagtacgcaaatacgccaagaaaggcaacgggccagaaataacgatgatgaaatacttcgacggcaagctaggaaacaatatcgacatatccaatcactaccacgtccacaacaagaaagtcgttctcctacaaatatcaccctaccgaaccgatttctacgtaagcccagagggcaagtacaaaatgctcacagtccgatacgccaacgttttctacaaagagtccaaaaagaaatacgtcatcgacgaaaagtggtacgcctcagagaagaagcgtaagaacataaccgatgacgacatctttgtctgctcactccaccatgatgagctaatcgggatacagaaaaaggacggcgccaaatacgtctacgacctctccacagaagacggcggcaagccacgtctataccacggggaaatggagatcctcaaattcacggccacgaacaacgactccaaaaatataatcgaagtcaaaccgatatacacctactgcaagaaacaactaatgatctccattggccccataacgaaactcgcaaaatacgccaccgacgtcctcggaaacgtgtacgaagtcaaaaagaacatcatcgaccacctgagtcacctctga

SEQ ID NO: 6237 - RNA, 3318 nt, synthetic construct
  misc_feature 1..3318: note = Cas9 variant
  source 1..3318: mol_type = other RNA
atggggataagaatcggcctcgacataggcatcgccagcgtcggctgggccgtcgtagacgatgactacaacatcatcgaatctggagcgaacatattcaacgaagcgaaagccgcatccaacgtggaccgacgaacgttccgccaaacgaaaagactactccgccgccagaagacacgcctgcgcgacttcgacatactatggataaacgcgggactcgacatacccaaggagaaggtcaacaaacagctacagttcagagtacaggggatgaccatggagctaagcgaaaacgaactatatgcagcactcaaaaacatgctcaagcacagagggatcagctacctagaagacgcgctcgacgaggaacaatcgggaaaatcaacctacgaaaagggcctccaagtcaatcaaaaagccctgaagtgcgacaagatgccctgcgagatccagtacgaaagactgatgaagtacggaagctacaggggacacatcgaggtcaaagacgagtccggagaagagatgatcttgagcaacatatttacactagacgcatactgtaaagaagccaagaaaatcctcgaatgtcaaaaacaataccactccttcatcacggaagcattcgaggacgattatttagcgctactgcgcaggaaaaggaagtactacgaggggcccggtaacgaacaaagcagaaccgactacggcaaatacaccaccaagctcaaccccgaaacaggagagtacgtcaccgaagaaaacattttcgagaaactaatcggaaaatgctccgtataccccaaggaaatgagggcctcggcggcgtcatatacggctcaaatatacaatatgctaaatgacctaaacaaccttacgataaacgggcgaaagctcgagtacgaagagaaaaagagtatcgtagaagaagtccaaaaagccagcagcgttaacatgttaaagatcatcaagaaggtgatcaacgaggacatcaccactatcgagggagcacgaaaagacaaaaacgacaaagaaatcttccacaaaatggaaacctacaacaaaatgaggcactacttcgagaaaaatggcctagagttcaagaaaatatctacggacgacctcgacgaaatcggcaacatccttaccttaaacaccgaaaaggaggccatactcgaagccttcaacaagtcacagctagaactcagccaagaggaaaaggaagcgttcatagagataaggaagaaaaacggctcactcttcaacaagtggcattccttctccctgaagataatgaaagaactcatccccgaactatacctacagtcaaagaaccagatgcaactactcaccgacatgggggtcttcaagaaaaagacggaaatcttccaaaactacgacaaaatccccaccgatgtaatcatcgaggacatctacaacccggtcgtaaagagaagcatcagaataactgtaaagatcgtaaacgcattaatcaaaaagtacggctacccccgagaagtagtgatagagatgccccgggacaggaactcagacgaagagaaaaagcgaatccaggacgagcagaaaaagaacgacaccgaactgaagaaaatcatcgaaaaagtcgaatccgaatacggcataaaaatcacggacacacacttccgcaaccacaaaaatctccgaatgaagctgagactatggcacgagcaggacggtcgatgcctgtacagcggcaaagtcatagacatctcagaactcctcaacgactgctccaaattcgagatcgaccacgtcatacccaagagcatctcgtttgatgacagccgcagcaacaaagtattagtgtacagcaccgagaaccaaaagaagacaaaccaaacaccataccaatacctagagggcaatggaaaagaatggagtttcgacgaatacatgaaccaggtcatagaactcaaagaccgcaaactgatcagcaaagcgaagatgaacaaattgctattccgcgaagacatcacgaagatcgaagtacttaaaggcttcatagcaaggaacataaacgacacaaggtacgccagcagagtcgtacttaatagtttccagaaatacttcgagtccaaacaatccgacaccaaagtgaaagtaatccgcggctcattcactcaccaaatgaggaagaaactgcaactatccaaaaacagagacgaaagttacgcccaccacgcggtagacgccatgctaatctgctatagccaaatgggctacgaagcctacaggcaactccaagaagacctgatcgaccccgactcggagaaaataagggacttagggctctggaaagaaacaataaccgaagcaaagtacgacgaagtcctatacacggcgaagtggctcgaaaaccgcggcaagatacaggaagcagaaaagaaagtaaaattctggcacaaagtcgatagcaaagcaaaccgagccctctgtaaccaaaccattcgaggtacccgggtgatcgacggctcaatacagaaaatcaacaaaataaacatatacagcgtggacggatacaaaaccttcaaaaacatgatccaaaaggggaaggaaaaagacttcctaatgtatcgaaacgaccgcaggtcctgggacgacctcatgaaggtgtaccgcgaatacagcgacgccaaaaacgccttcgccgcctaccaagaggagacaggcgactacgtccgaaaatacgccaaaaagcacaacggatccaaaatcacaaacctaaaatactgcgcaaaagagctgggttcatgcatcgacatatcacacaaatacggcctagaaaaggacagccgcaaggtgatcctcgagagcctaagcccctatagaagcgacgtctactacaacgccgggctcaaacagtactatatcgtcggtataaagaatagcgacctatgcttcctcaagggagaatacttcatcgacagcaagcgttacctccaaatcctccgcgaagaaggcgtcctcacggaacaacacaccctgaatgacctggccgcgatcggaaccgagttccaattcagcctatacgaaaacgattacctcgaatacgagaaaaacggcgaaatcaaaacagaacgcttcctcagccgcaccaagccaaaacagaaaaactacatcgaaacaaaatcaatcgacgctcccaaaatcaaaaacaagaaacagaacctggtaggacttgcaaaaagcaaaagcatcaagaaaatacgcgtcgacatactaggcaaccgatactacgcaagcaaagaaaaattcagcctcatggtggacaaattctga

SEQ ID NO: 6238 - RNA, 3318 nt, synthetic construct
  misc_feature 1..3318: note = Cas9 variant
  source 1..3318: mol_type = other RNA
atggacatggcatggagactgggacttgatctaggaacaaacagcctagggtgggcagcactgagcttagacgccgcaggagcaccggacgccattctggccgccggctcgcgcatatttggagacggccgcgacccgcaatccggaacctcactggcagttgaccggagagccgcaagagcagcacggcgcagacgcgaccggttcaaacagagacaaagagcgctactgaaacacctcgaagccgacggactgttccccgcggatcccgaagtgcaacaagcgctcgcagcgctggacccctacgcactccgggcacgggccctcgacgaagcactgtcgttacatgaaatcggcagggcactattccacttaaatcagagaagaggattccaaagcaatcggaaagccgacaggggcaaagatgaagacgctggaaagattgcgatcggagtagaccgactgaaagacgccatcgcggcagccggagcaagaacattcggcgagttcctgagacaacgacgagcaggagcaacgggagaaaaccagatcccaagcgtccgaacacgcctacgcgccgaaacaggagaaggcgcaaaaggctcagggtacgatttctaccccagtcgagcactcctcaaagatgaatttgacgcaatatggcacgcacaagccgaacaccacccgaaagtccttaccgacgaagcataccacagactccacgaaatagtcttccgacagagaccactcagagcaccaaaagtcggagcgtgcacgctggtaccaggcgaagcacgactcccaaaagcccatccgctgttccagcgccgacgcctactcgaagaactaaacgcgcttatgatcgtccgcgcaggggccgttgcggaaaggctcacgccagagcaaagagacctcctcctacttaaactcaaagacaaaggcaaagtgacattcaaaagcctacgggaaaaagtgctaaaactagacggagacgccaggtttaacaaagaaagcgaacatagaacggagctaaaaggcgacgaagtagcagccgaaatgggaggaaaaacaagattcggctcactatggccccacctatcaacagaacaacaatggacggtcatcgaaagacaacaggcgttagaaagtgacgctgacgaagccgcctttcggacgtggctcgtagaaacgcacaagctaacagccgaacaggcaagggcggtcgcaggagcacggctaccagcgggacacggaagattcggactcacagcgaccgccgctctgcttgccgcactgagggacggcagaacccctgagggacgcggaccgaacgccccggcgaccgaagccggaagagtggtagtgtactcagaggctgcggccatagcgggctaccaccacagcgatcacagaagcggggaagtgttcacagacgcgaaaggacgcccagcactgccatattacggagtacccctagaccgccacatagtaccagggacagccgatccagatgaaccggatgaagcggcaaggattgggcgactaacaaatcctaccgtacacatcgccctcaaccaactaagaagggtagtaaaccgattgatccgcgtatacgggccgccagccgaagtagcattagaacttgcccgcgaacttaagctaagcgaggacgagaagaaagaacgaaaccgggaaaactccagaaaccgactagacgctgagaaaagatcatccaagctagccgaactaggacaaagagacaacggaggaaaccgcgcactcctaaaattgtgggaagaactcaacccagaaaatatcctcgacagaagatgcatttacagcggtcgacagatctcaataggcatgatattttcgggcgcagccgaggtcgaccacatactcccattcgatgccaccctagacgacagcaacgcgaacaagatactgtgcctaagagaagcgaatcgagataaacgaaaaagaagccccttcgaggcctggggaggaaccccacaatgggaagaaatagcagaacgagcttcacggctcccgaggaacaaaagatggcggttcgaaccggacgccatggaacgtttcgccgaagaagggggattcctcgcacgccatctcgtcgacacacaatacctaggacgcatagcacatgactacctgagatgcctctaccccgacaagggcgatgggagcagccacgtatgggtctccccaggacgcctaacagaaatggtacgtcggaaactagggttgaacgggctactaggcgatcataacctaggcgcagaacaaccgaaaaaccgcaaagaccacagacaccatgccatagacgccgtagtaacagcaatcctcgaccgctccatgctacaaaggatacaacgagcaagcggagaaggagcaagcgacgcagaacttctccgaatcatagtgccagaaccctggactggatttagggacgacctgcaaagggccgtcgatcgtatcgtggtagcccatagagcggatcacgggacagtagcaaaggctgccacgaggggcagggaccaaacagcagccagactgcacaacgacacagcgtacggattcacaggcgaggcagacgccaaaggaacccccatagtagtccaccgagcaccgctcggggccctcaaaaagccagaacacatagaccaagtaagagaccccctcttgcgcgcagcactgcacgacttcacagcgggactcagtggaaaaccattcgaagaccgcatcgcagccttcccgcgtctcggccccctggactatcgaggaataagacgagtcagagtagtcgaaccactccaagtgatcccgataagagacgccgcaggccgggcctacaaaggttataaaggcgactccaattacagatacgacgtctgggaactcccagacggaaaatgggagcaaagagtgctccaaatgtactacgcgcatcaaagtggagagccacccagaccccaccccgcagcccgcaaagtattaagcctacacagagacgacgtgctagccatagaaagaggcgagggcggtcgcgagctagttcgagtagtaaagttctcgacaaatgagtttacgctcgcacccctaaacgaagggggagcgctgaagtcaagacatgcggacaaaggggacccctttcgctatttataccccagccccagcacactaaaagcgtggagggcaagggaagtgagagtagacgagctgggccgcgtcctagacccaggattccccgccagaaagagaagacgggtcacacgaccaggcagagcggacgccgactga

SEQ ID NO: 6239 - RNA, 3321 nt, synthetic construct
  misc_feature 1..3321: note = Cas9 variant
  source 1..3321: mol_type = other RNA
atgcagtacatagtagcaatcgacataggcgtcgcctcggtcggctacgcagtgatcgacaagacctcggaaactgtcatagaagcaggcagcaacatattccccgaagcaagcgccacagacaaccaggaaagacgcgggatgcgccaggcgcgcagattaaaaagacgagagcggaccaggctcgacgacttcaccaagctatgggagtatcacggactagcaatcccgcaagtcaagaagaacgacatcgtgggactcaaggtaaaagccctctacgaaagtatctccctagacgaagtatacctgatactgtacagctacctgaagcaccgcggaatctcttatctagaagatgtcgaagacagctccgtaagcggatccacagcgtacgcgaatggactcaaactcaacgcgaaagagctcgagaaaaactttccgtgcgaaatccagaaataccggcttgaaaacataggcaaatacagaggacaaatacaaatagaagacgaccaaggagagaaactagacctaagcaatgtgttcactatcggagcgtacactaaggaaatacaacagattctagacacccagaagaagtaccacgcagagatagaggacgagttctgcgaaaagtatctcaagatattcacccgcaagcgcaagtactacgaaggaccggggaacgagaaaagccgaacagactacggaaagtacaccactaggctaaaggaaaatggagaatacatcacggagaaaaacatcttcgaaaaacttattggcaagtgcagcgtctacaaagacgaactgagagcggcctccgcctcgtacacagcacaagagttcaacctcctgaacgacctgaataacctcaccgtgaacggccggaaactcgaagaaaacgaaaaacacctaattgtcgacaaggtaaagacaagtaacaccataaacatgcgaaagataatagccgacgctatgggcgaaaagatagaagagttctacggtgccagaatagacaaatccgaaaaggaaatcttccacaagttcgaagtatacaacaagatgcggaaagcgctcgcggccatacacgtcaatatagaagagttctccagagacgacctggatgaaatcggctacatattaaccatcaacacagacaaagaagcgatgatggaagccttcgacaacagtaggctagaattaccaggggaaataaagaactgtctcatctccctgcgaaagacgaatggaacactatacagcaaatggcacagcttcagcttaaaaataatgaacgaacttatacccgaaatgtaccgacaacccaaagaacaaatgacgctactcacggaaatgggcgtcatgaaaggccagaccgatgagttcgaaaagaacaaatacatcccggtggacgtagcgagcgaagacatcttcaacccagtagtgcggaggagcgtacgcatcagcttcaaaatcttaaacgcactgatgaagaaatacggaaccctggacgaagtggtaatagaaatgccccgagacaggaactcagacgaacaaaagaaatgggagaaagaaacacaaaagaaaaacgagaaagagcaagaatacatagaaaacaaactggccacagtgtacgacatacgactaagcagcgcagacttcagcagccaaaaacaactgaacttaaaactaaaactgtggaacgaacaagacggaaaatgcctctacagcggaaagatcatagagcccgaagacctaataaaacacagcgaactgttcgaaatagaccacatcataccgcgatccatttcttttgacgactcacgcagtaacaaggtcctagtataccggacggaaaaccaaaacaaggggaaccaaaccccatactattacctaacgcacactaacagcaagtggtccttcgaacaatacaaggctctcgtaatggacctcagcaaaaagaaagagtacggcctgtcaaagaagaaagtgcgaaatctcctgtacagcgaagatataactaaagcagacgtgcttcgagggttcatcaacaggaacatcaacgacaccagctacgccgcgagagtagttctgaacaccgtgcagggatatttcagggcgaaagagatgggcaccaaagtgaaggtgatccgagggagctacacacaccagatgcgcgtcaacatgaagctcgacaaagaccgagagaagtcctacgcccaccacgcagtcgatgctatgctaatagcgttctcccaactaggctacgaagcataccgcaaactacaaggcgagttcatcgacttcgaaacaggcgaaatacttaactccgagaagtggaaagaccaaatgtcagacgaagtatacaaacaatacctataccgcaagaaatggagcaatatacgcaacgagatcacaagggccgagaaaaacgtaaaatactggtactacgttgaccacaaatcgaaccgaggcctatgcaaccagaaaatccgcggcacacgagtatacgacggcaaaatatacaagatcaacaagctcgatatacggaagaaagaaggggcagccctcttcaagaaactcgcgttcagcgaaaaagaaagcgaccgtgaaaaactcctagtctacaaaaacgacaagaaaacgtatgaggacctagtccgcatcatgcaagactacagcgactccaaaaacccgttcgtacagtacgagaaagagacaggggactacgtcagaaaatacgcaaagaaacacaacggacccagaatcgacaaactcaaatacatcgacggcgaagtgggcagctgcatagacataagccacaagtatggttacgaaaagggctcccggaaagtggtcctagaatccctcgtaccataccgcatggacgtatactacaagaaagaggaacaaacatactatctagttggcatcaaacagtctgacgtcaaatgtcaaaaaggggagtacgtcatagacgaggacgcgtacgccatcaacctggtaaaggagaaaatgatacaacaaggccaaaaacgcagcgacctggaatccctaggattcgagttccaactcagcttctacaaaaacgacatcatcgaatatgaaaaagacggcaagatcgtacgggaaagatttctctcgcgcaccatgcccaaagtaaagaattatatcgagacaaaaccaatcgaccgagcgaagtatgaatggcacgaccgaaaactcgtcggactgggcaaaaccaaaagaatccgaaaataccgaatggacatcctgggcaactattacctatgcaacaaagaagagttcagcaaatactgctga

SEQ ID NO: 6240 - RNA, 3324 nt, synthetic construct
  misc_feature 1..3324: note = Cas9 variant
  source 1..3324: mol_type = other RNA
atgggctacacagtcggcctcgacatcggcgtggcatccgtcggggtagcggtactagacgaaaacgacaacatcgtagaagcagtctccaacatattcgacgaggcagacaccagcaacaacaaagtacgacgtaccctacgagaaggacgccggacaaaacggcggcagaaaacccgcatcgaagactttaagcaactatgggagacttccggctacatcatcccacacaaactccacctgaacatcatcgaacttcggaacaagggccttaccgagctcctaagccttgacgagctgtactgcgtactactaagcatgctcaagcataggggaataagttacctggaagatgccgacgacggcgagaaagggaacgcctacaagaagggcctcgccttcaacgaaaagcaacttaaagagaaaatgccatgcgaaatccaattggaaagaatgaagaaatacggaaaataccacggcgagttcataatagaaataaacgatgaaaaagaataccaatccaacgtcttcacaaccaaagcgtacaagaaagaactcgagaaaatattcgaaacacaacgctgcaatggaaacaagatcaacaccaaattcatcaaaaagtacatggagatatatgaacggaagagggaatactatataggccccggcaacgaaaagagccgcacagattacgggatatacacgacccgcacagacgaagaaggaaacttcatcgacgagaaaaacatcttcggcaagctcatcggcaaatgctccgtctacccagaagaataccgagccagcagcgccagctacaccgcgcaggagttcaacctgctcaacgacttgaacaacctcaagatcaacaacgagaaactgacagagttccagaagaaggaaatagtcgaaatcataaaagacgcctccagcgtcaacatgcgaaagatcatcaagaaggtcatcgacgaagacatagaacaatactcgggagcccgaatagacaaaaagggcaaagaaatctatcacaccttcgagatatacagaaaactcaagaaagagctgaaaaccatcaacgtcgacatagacagctttactagagaggaactagataaaaccatggacatactaaccctgaataccgaacgcgaaagcatcgtcaaagccttcgacgaacaaaaattcgtctacgaggaaaacctaatcaagaaactaatcgagttcagaaagaacaaccagaggctattctccggctggcacagcttctcatacaaagccatgctccaactcatccccgtcatgtacaaggaacctaaggaacaaatgcaactgctcaccgaaatgaacgtattcaaaagcaagaaagaaaaatacgtaaactacaaatacatccccgaaaacgaagtggtaaaggaaatctacaacccagtagtggtcaagagcatccgcacgaccgtaaaaatactgaacgccctcatcaagaaatacgggtaccccgagagcgtcgtaatcgaaatgcccagagacaaaaactccgatgacgagaaagagaaaatcgatatgaatcagaaaaagaaccaagaagaatacgagaaaatcctgaataaaatctacgacgaaaaaggcatagaaattacaaataaggactacaaaaagcaaaagaaactcgtactcaaactgaaactctggaacgaacaagaaggactctgtctctactcgggtaagaaaatcgcaatcgaagacctacttaaccacccagagttcttcgaaatcgatcacatcataccaaaatcaatctccctagacgacagcaggtcaaacaaagtcctagtgtacaaaacagaaaactcgataaaagaaaatgacacaccgtaccactacctgactcgaatcaatgggaaatgggggttcgacgaatacaaagcaaacgtactcgaactccggaggcggggaaaaatcgatgacaagaaagtaaacaacctcctatgtatggaagacataaccaaaatagatgttgtaaaaggttttataaatcgaaatctcaacgacacgagatacgccagcagagtcgtccttaacgaaatgcaatcgttcttcgaaagcagaaaatactgcaacacaaaggtaaaagtcatacgcggcagccttacctaccaaatgcgccaggatctccacctgaagaaaaatagagaagaaagctacagccaccacgccgtcgacgccatgctcatagctttctcccagaaaggatacgaagcctaccgcaagatccaaaaggactgctacgacttcgagaccggcgaaatcctagacaaagaaaaatggaacaaatatatagacgacgatgagttcgacgacatcctgtacaaggaacgaatgaacgaaatacggaagaaaataatcgaagcggaagaaaaagtcaaatacaactacaaaatcgataagaaatgcaaccgagggctgtgcaaccaaaccatttacgggacacgcgagaaagacggcaaaatacataagatctcaagctacaacatatacgatgataaggaatgcaacagcctcaagaagatgatcaactcaggcaaaggcagtgacctcctgatgtacaacaacgaccctaaaacgtacagagacatgctcaagatcctagaaacctatagcagcgagaaaaaccccttcgtggcgtacaacaaggagaccggcgactacttccgcaaatactccaaaaaccacaacggacccaaggtggaaaaagtaaaatattattcaggccaaataaacagctgtatcgacataagccacaaatacggtcacgcgaaaaacagcaagaaagtggtactcgtctccttaaacccctatcgcacagacgtttactacgacaatgacaccggcaaatactacctcgtaggagtcaaatacaaccatataaagtgcgtgggaaacaaatacgtcatagactccgagacgtataacgagctcctacgcaaagagggcgtactgaacagcgacgaaaacctcgaagacctcaactcgaagaacatcacatacaaattcagcctatacaaaaacgacataatccaatacgaaaaaggaggtgaatactacacagagcggttcctctcccgaatcaaagaacaaaagaacctgatagaaacaaagccaatcaataagccaaacttccagagaaagaacaagaagggagaatgggagaacacacggaaccaaatcgcactcgcgaagaccaagtacgtggggaagctagtcactgacgtactaggcaactgttacatcgtaaacatggagaaattctcgcttgtcgtagacaaatga

SEQ ID NO: 6241 - RNA, 3324 nt, synthetic construct
  misc_feature 1..3324: note = Cas9 variant
  source 1..3324: mol_type = other RNA
atgggctacacgctaggtctcgatatcggcatagcaagcgtcggattcggcctcatagacaacgtggacggaaaaatactggaatccggcgtccgcctcttctcatccgctgacccggataacaaccagacacgccgaagcagtcgccaggcccggcggctgaaccgaaggaaagtccaccggctggagcgtgtcgcccacctactcgaggaagccggattcgaaaagggagaagtcctcgcccccacaccctaccatctgcgggttaagggactgaccgaaaaactgagcaaacccgaagtgtacgccgcactctacaacctcatgaaacacagaggaattagctacctcgaagacgttgaactcgacgaagcggatagctccagcgtctcccaaaacgttgaactactcaaggagtactacccctgcgaaatccaactcgaacgctatgaggaatacggccaaatcagaggcatcatagagacctacaacaaggacggggaaaaagaatccctggtaaacatcttccccaccggcgcgtacaagaaagaggcggaggcgataatactcaaacaaggccaattctaccccgagctagacaaagtgtttttagaaaagttcacagaaatactcactgtgaaacgcccctactacgtcggccctggaaacaagaaatcccgaaccgactacggcatataccgcgaaaacggagaaacgctcgagaacctgttcgacatactaatcggcaaatgcacaatctaccctcaagaagcacgcgcggcgaaattctcctacaccgctcagttgttcgacttcctaaacgacatgaacaatatctcgatagctggcgaaaaattaacggaggtacagaaacgcgaaatataccaccaaataatgagctcaaagactgtaaacatgatgaaaataatcaccaaagtaaccggctgccttaaagaagaagtaactggctaccgggtcgactccaaatataaagcagagttccactccttcgcttcctaccgccaattccgaaacaaaatgctcgactacggcttcgatgtgcaaaccctgaacgtcgaaatgttcgacaaactcgccgccaaactcaccctgaacacagaataccaccaaataatcacccaactcgaaagcctgaacctcggcctcagcaaggagctaattgagaaaatcgccgactttcggaagaaaaaccgaagcctcttctccaaatggcactcactctccctaaaagcaatgaacgaagttgtagacgagctctggtccacatcgaaaaaccagatgcagattttcagcgagttaggagggttcaaatcaaacatcgaagtgttcaaagggctcaagtatattcctctggacgccatggtcgacgagatatacaaccccgtagtccgctgctccatccgcgagagcatcaagataataaacgccctcttgaagaaatacggggccctagacaaagtggtgatcgagatgccgcgggactcaaacgaaaaagaagaaaaagaccgaataacaaagctcaacaaagaaaacgacaacaaaaagaaacaagcaatcgaaaaagcgagaaacgaatacggattcggcgaagaagcatacagacaacaaaacgaccttaataccaaactgcgcctctggtacgagcaaaaacaacgatgcctctactcaggggaaattatcaaaatcttcgacctaatcaaaaatccacacctcttcgacatagaccacataattcccaaatcaatatcgtacgacgacagccttagcaacaaggtcctctgctacgctacagaaaaccgcgagaagggaaacttaaccccctatcgctatttcaagcgaaaagcctcattaacttggaactacgaagcatacaagtcttacgtcatagagctctacaaagacggcaaaggagacctctcacggactaaacttgaactcctcctcttcgaggaagatatcaacaagtacgaagtacgacagcggtttataaaccgcaacctcgtcgacacacggtacgcctccaaagtcgtcttaaacacgctccaagatttcatgaaagagaactaccctaccacaaccgtagaggtagtcagaggtaagttcactgcccaactaagacgacactgggggattaggaaaaaccgcgacgagaatcacgcgcaccacgcaatcgatgcacttataatcgcgtgcgtgccccacctatcactgtggaaagaacaaaagaaagtcttctccaccgacgagttccgcgtagacgaaacaaccggtgaaatcattgagcaatcatacaaccaattaacgtaccaagagcccttctcccagttcttctaccaacttgaaaaagtatccatagattgcagatactcctacaaagtggacagaaaattcaaccgccaagtcgcggacgccactatctactcaacacgacagggaatcgtaaaacagacctcaggcgacaaatcattcacccttgactcgaactccaaagaacactacgtcatcgccaagatcaaaaacatatacgaagacgtagacgcaaagaggttcatggacagatacaagaaagacaaaacacaatttctgatgtaccaccacgacccccaaaccttttcaatattagaagacgtaatgaaaacttaccccgacaagaaaaaccccttccaagcctaccgcctcgaatacggccccatacgaaagtactcaaagaaaggaaacggcccacaaatacagagcatcaaatactacgactcgaagctcggccaacacatcgaactaaaacaagcaaaccaaagcaccaagaaagtagtactacagagcctaaacccctggcgatgcgacatctattacaacaagaaagacaaacgctacatcgccgcagggctaaagtacgccgacctcagctaccagaaaggcaccggcctgtacggcatctccctccagcgctaccaacagatcctcaacagcgaaaagatagaactaagcatcgaacaaatcgaactactcctagaagggcgtctcaacgaaagtaactttgagttctgcttcagcctctacaaaaacgatttcatccaatggaatgacgaaaacaaccagacgttccaataccgattcctagcaaggaacctctccagccccaaccgaatcgaagtcaagcccatcaacaagagcaagtacgacaaacaagccgaaggccttaagaccctcaagaaaggcctgaaccgcttctacaaaatctcggtcgacgtactagggtaccaacacttcataaagaaagaaaaacttaaactcacattcaaatga

SEQ ID NO: 6242 - RNA, 3330 nt, synthetic construct
  misc_feature 1..3330: note = Cas9 variant
  source 1..3330: mol_type = other RNA
atgagccactacgtcctcgggctcgacatcggaataacctcagtcggatacggtatcatcgacctcgacacgaacgacttcattgattacggcgtacgactcttcaaagaaggaaccgccgcgaacaacgaagaccggcgcaacagtaggtcccgccgcagactcctctcccgcaaacacacaagactcatggacatgcaaaaagttctaaaagaagccggcatcatgaccgaatcttacagcccgctctccaatgtctatgaaatacgcaaaaaggggctcacaaaggaattaaccaatgacgaactcaccgccgcaatcttacacatcaccaaacatagaggctccgtaatcgaaactgtggaagacgacgaggcagcagccaaggaaaccggcgaactcaaaagcaccctccacgagaacgcacttctcctggcaaacaacaagttcgtctgcgaaatccagctagagcggctcaacaccgagaacaaaatccgaaaccacaagaacaacttcaagactaaagactacgtcgccgaactcaaagaaatactcaaccaccagaaccttagcgaggaggtaaagaacaaaatcatacaaatagtagaacgacgacgagcctactacgagggacccggctcctttaactcccccaccccctacggtcgtttcatagaagtcaatggtcaggtacaggaaatcgaccttatcgaaaagatgcgcggcaaatgttccgtatacccggacgagttccgtgcaccgaagatgtcaatcagcgcagaccttttcaacatactcaacgactttaacaacctcctggtccagggcgaaaagctccaagaagaagacaagaagaacctgctaaaaataataaacgacaaaggctcaataacgctccgacagataagcaagaagctcgaagtcaacgaagacgagatcaaaggttaccgcatagataagaaaggcaaagccctcttcaccgagttcaaaggatataaaatactaaagaaactcttcctcaactgcggccaatcgataagccttgaagactacgaaatgcttgacgaaatcatcgaaatcgtaaccaaaaagaaaggaatagatgaaagaaaggacgcgctgaaagagctaaagtgggacctctcggacgacataataaactcactctccgaagtgaccggaatagtaggctaccacagcctgagtctaaaagcaatacgcgagctagacagcgaactctataagacgtcacttaaccaaatgcaacttctccacgagctaaaaatgttcgataaaaaccggccctcctataagggaaagaagaacatagtcgctgaccccgaagccatcctctcgccagtggccaagcgcgcccaaaatgagacgttcaaagttatcaacgcccttcgaaagaagtacggcgagttcgacagcattgtcgtagaaatgacgcgcgacaaaaacagccaggaacaaaagaaacgtatcaacgacagccaaaaagccctcgagagccttaacaaagaggtagaccaattactacagcaaaaaggctacgatccacaaaaggttaaaggcaagacaaaacagaaagtccgcctctacatgatgcaagaaggcaaatccgcctatacactccaggagctcgacctacaccgcgtaattaaagacgacaaatacaccgaaatcgaccacatcatccccatctccatctcacttgacgactcacaaagcaacaaagtcctcgcgctccactccgaaaaccaacagaagggcaacctcacccccttcatggcgttccacaccggcagattcgccgacatgggatgcacgtggaacaaatttaaggaaaacgtcctctccaacaaaaactacaaacataaaaagaaaaacaacctactcgacgagagggacatcaataaatttagcgtaatccaagagttcattaacagaaacctcgtagacactagctacgcaaaccgcgtcgtcctaaacaccctaaccgactacttcaaagacaacgaaattgacacgaaagtgcatacagtgaatggcaagctgaccgacctcttccgtaaaaggatcaacctaaagaaagacagaaacgaggattacctccaccacgccattgacgcactaatagtagccagcatcaaaaagctgcgcctgctagatggctacctcgcgaaatacggattcgagaccctatacgacgagatgaccggagagataaaagagatcccggaagacaaagcgttcttcgacgacaaatatatccgctacatactcaacctcaaaacaatctacgaaagctccaacatgtactatcgagggatactcgagcgcgaggaactgatctaccaaccgataaaaatcagccataagatcgacaccaagccaaaccgcaaagtttctgacgaaactatctactccacacggattatcgacaatgaagatcacctaattgagaaatactcagatatctacgacccaaaattcaaaaacctcacagaggacatcctaaacggcgagaaaaacaaataccttatggagaaaaacgacccccaaaccttcaacatactcaaacaaataatcttcaaccactacaacacatacaaagacagcaaggagtactataaaatagaaaagaagaaagaaaaagagatcatcaaactcgtcggcatcaaccctctcagcttgtacaaagaggagaacggccctataaagaaatactcgaaaaagggaaacggccccgtcatcatgtctatgaagtacgattccgaaaaactcggcaatcacatagacatcacgccggatagcgccaagaacaaaaaggtgatcctgaaacaaatatccccatacagaaccgacttctacaagtgcagcgatgagaaattccgattcgtcactgtccgctacaaagacgtacactaccaaaagtcaatagacaaatactgcatagataaagaatggtatcaaaacgagaagaaaaacaagaaaatagacgaaaaagcggagttcctattctcgatgcaccacgacgagctcataggcatcaccagaaaagaaagcgagcagttcatctacgatgaaagcaaagaaaatcacggtgacccgcgctatcacgacggggtaaagcccgaaatcctaaagttcaccgcaaccaacaacgatacaaaagggatcatcgaagtcaagccgctatacacctactcagcttacagactcaaacccaccgtactaaacgttaaaaacatcaagaaatacgccacggacgtcctaggaaacttatatgaggttaagcagaacgaactaaagctcgagttctga

SEQ ID NO: 6243 - RNA, 3333 nt, synthetic construct
  misc_feature 1..3333: note = Cas9 variant
  source 1..3333: mol_type = other RNA
atggcagaaggcaagaaaagaatatggcgactgggagccgacctcggagcaaatagtctaggctgggccgcaatcgaactaagcgccccagtaaacggcaaacccatagcaatcctcgcggccggcagtagaatattcagcgacggacgagaccccaaatcaggcgcatcgttggccgtggaccgaagggacgcacgtgccatgcgccgcaggcgcgatcgcttcaaacagcgacaaaaagcactaattaaatacctcatagcagacggactcttcccggcagacgaagccgccaggaacgccatggcggcaatcgacccctacgccgtccgagcccgagccctagacgaggcactcagcttacccgaactagggcgcgcactgttccatctcaaccagagaaggggattcaaaagcaacagaaaagcagatagaaaagctgatgatgacgcaggaaaaatagccataggaatcgaccgcacccgtgacgcaatcgcggaagatgaggccgatgccggcgcggaaccaggtagttggaccttcggaaaatggttacacgaacgaagactaaaagggcaaagcgtcagaacccggctaagacccgagagcggagaggatgccaaaggagacggctacgacttctacccagacagagccctcatggaggaagagttcgacgccatctgggcggcacaggcaccccaccacccagacgtgctcacaaacgacgtgcacgaccgactgcacgaaataatcttctaccagcgacccctaaaagcaccccaagtaggaatgtgtagcctaatcccgggggaccgaagactgccaaaagcccacccacttttccaacgacgaagacttctggaggagctgaacgccctaatgatagtccgtccaggagaagtagcacaaagactaacaagagaggaaagagacatactactactgaaactgaaagacaaaaacaaagtaagtttcgctaccctacgcaaagcactaaaactagacccggacgcacgattcaacaaagagtccgaggacagaacagacctaaaaggagacgaagtcgccgccgtgatgggatccaaaacgcgattcgggaacctgtgggtccacctatccatagaagcccagtgggacgtgctagcccggctagacgcggtagaatcagatgcggaagatgccgcattctgcgcatggctagtggagacgtacgcattaacacccgagcaagcacgagcagtcgcaaacgcaccgctccctcccggatacggcagattcggcgagacagccacacgaaaactaatcgaggccttaagagacggcaaaaaggatgaccgagtgctagtatattcagaggcagtaactgaagcaggcctcggccaccactccgacagaaggacaggagaggtcttcgaagatgccaaaggcagaccacaactaccatactatggggtcgcactagagagacacatcatgccaggaaccggagacccctcagacccagaagaaatgagagtaggccgactcacgaatccgactgtacacataggcctaaatcaactcagaagaatcctaaacgtactgatcagagcatacggaccaccagcagaaatagcaatagaactagccagagagcttaaactaacagacgaagacaagaaacgaataaaccgagaaaacaatgacaaccgaatcgcagccgagaggagaagcgagaaactactcgcaataggccaagcagacagcggagccaatcgagccttactgaaactgtgggaggaactcaacccagccaacgtactggacagaagatgcatctacagtggccgccaaatcagcattgacatgctgttctccgccgctgtagaagtcgaccacatactcccgttcgccgccacgctagacgactcgaatggaaacaaaatcgtatgcctgagagaagcaaatagagaaaaacgaaaacggagcccccacgatgcctggggacattcagcaaggtgggacgaaatcgcagcacgagcagctcaactcccgcgaaacaaacgatggcgattcgaaccagacgccatggacaaattccgagacgaaggcgggtttcaagcacgacacctagttgacacacaatacctagcccgactttcacgtgaatacctagcgacactgtacccagagaaaggggaggggtccggacacatctgggtctccccagggcgcctaacagagatggtcagaagaaaactgggactaaacgacctactcccagaccataacttcggaggcggagctgaccaggcgaaaaatagactcgatcaccgccaccacgccatcgacgctgtcgtagtcgcaatagtagacagagggatgcttaacgcaatagcaagggccagcggtcaagaaggagcagaaggccgagaacgcatcataatcccagaaccgtgggacggatttcgggacgccctcagagaaaccgttaatcgaataaccgtgagccaccgaacagaccatggaacggcatccaaagcaggccttccgaaaggtaaggacgccacagctgggcgcttgcacaatgacacagcatacggctttacgggagacaccgacgcgaaaggcaacagcatcgtagtcagacgcgtcccactgagctcatttaagaaacttgcagatctggaccgtatacgcgacgcagacctcaaagccgccttataccaacacttaaacgggctcgaggggaaagcattcgaaaaagcactagccgaatttcacaaactggagtggcacaacttcggaggcgtcagacgggtcagggtcacagaaccgctcacagtaataccaataaaagaccgaaacggacgcatctacaaaggctacaaaggcgacagcaactaccgatacgatgtatgggaactccctgacggcaaatgggtaacaaattggaaaaacgaagctggtgaggcgatgtcgtccgtgatctcgatgttcgacgcacaccaaagctccgaaccgcctagaccacaccccgcagcacgaaaaattctgtccctgcaccagaacgacctactcgctatagaaagagagggcgaggatcgcaaactaatgagagtagtaaaattcggccagagcggccaaatcacactggcagaacaccaacaagcaggagacttaaagaaaagagacgcagtcagcaacgacgacgacccattcaaatatttcgcaccaacaagcggcggattgaagaaagtcaaagcacgacaggtaagaatagacgaaatcggcagagtgctagaccctgggttcccggccagaaccgcaagacggaaaacaaggggatga

SEQ ID NO: 6244 - RNA, 3333 nt, synthetic construct
  misc_feature 1..3333: note = Cas9 variant
  source 1..3333: mol_type = other RNA
atgacagcaagaacccacaagatctggcgactgggagccgacttaggagccaactccctaggatgggcagctatagaattaagcgcaccagtagacggaaaaccgatagcaatcctgcacgcaggatcaaggatattcagcgacgggcgagaccccaaatccggtgccagtctggcggtcgaccgacgcgacgcaagggcaatgcggcgacgaagggatagactgcaacagagacaacgagcactgataaaatacctaatcgccgacggcctattcccagccgacgaaaacgaaaggaaggcaatggcgaccatagacccatacgcggtccgggctcgagcactggacgaagccttaaccctccccgaggtagggagagccctattccacctgaaccagagaaggggattcaagtcgaacaggaaggccgacagaaaggccgacgaagacgcaggtaagatagcaatcggaatcgacagaaccagagacgcaatccgacaggccgaggaagaagccggagcagagccagggagttggacttacggcaagtggttgtacgaacggagagcctcagcaacggacgcgaacgcaatccccagcgtgaggacacggctaagaccagaaacagacgaacacgccaagggcgatgggtacgacttctacccaggccgagcgctaatggaggcagagttcgcagcaatatgggaagcgcaagcggcacaccacccggatgccctaaccaacgaggtgcacgaccggctgcacgagataatcttctaccagcgaccgctcaaggcgccacaaataggcgtatgcacactaatacgcggcgaccagagactgcctaaagcgcaccccctgtttcagaaacgaaggctgctagaggaactcaacgcactcacaatagtccgcccgggcgaaatggcgcaacgtcttacgcgcgaagaacgggacacgctgtttttaaagctaaaagataaagcgaaagtctcttttgtgagcctaagaaagacattaaagctagatccagacgcaagattcaacaaggaaagtgaaaacagatcagatttgaaaggggacgaggtcgcagccgccatgggggcgaagacccggttcggaaaccgatgggtacacctcagtattgaagaacaatgggacgtaatagcgcggctagaggaagtagaatcagacgccgaagacgcagcatgtagagcatggctagccgccacattcgacctaacaccagaacagataagagccgtaacaaacgcgccgctgccgccaggctacagtagattcgggaaggtagcaacccagcgactgatcgacgcattacgagacggagagaaggacggccgggtcctagtatacagcgaagccgtggcagccgccggactcggccaccactcggacttgcgcacaggcgaaatatttgaagacgcccaaggaagaccccaactcccttactacggggtagccctcgaacgacacataatgcccggaaccggaaaccctgaccactcagacgaaatgagaataggaagactcaccaaccctacagtgcacatcggcctcaaccagttacggagaatagtaaacacattaatccgtgcatacggcccgccagcggaaatcgccatagaactagctcgagaactaaaactgacagacgacgacaagaaaagaataaacaaagagaacaacgagaataggctcgccgccgagaaaagaagcgaaaaactactgacgatcggtagaccagacacaggagccaacagagctctactcaaactctgggaggaactcaacccagcaaacgtactggacagaagatgtatatacacgggcacccaaatatcagtagacatgctctttagtgcggctgtcgaagtagaccacatcctaccgttcacagcaacactagacgactcaaacggcaataaaatagtatgcatgagggaagcgaacaggaccaaacgcaaacaaagtccctacgaagcatggggccacacagaccggtgggaggaaatagccgcgagagcagcacaactcccccgcaacaaaagatggcgattcgagccagacgccatggaaaaatttaaggacgagagcggattccaagcccgacacctagtcgacacacaatacctagcgcggctcagcagagaatacctggaaacgctatatccaggaagcggcgaagggagctcacacatctgggtatcccccggacgactaactgaaatggtacgacgcaagctcggcctaaacgacctactgccggaccacaactttggaggaggagcggatcaagcgaaaaacaggctcgaccacaggcaccacgcaatcgacgccgtcgttgtggcgatcgtagacaggagtatgctaaccgagatcagccgcgtctcggggctggaaggagcggaaggacgagaacgaatcatcatacccccaccatgggacgagttcagaaacgacctgcgtacagccgtcaacgcaatcaccgtgtcccatagaactgatcacggaaccatatccaaagccggactgcccaaggggaaagatgcaacagcagggcgacttcacaacgataccgcgtacggtttcacaggggaaaccgacgctaaaggaaactcgatagtagtcaggcgagtacccctcgcttcattcaagaaactggcagacctcgaccgtatccgagacaccgatctaaaagccgcgctctaccagcacctagagggcttggaaggcaaggcattcgaaaaagcagtcatggacttccccaacctagaatggcacccgttcggaaacgtcagacgagtccgcgttaccgaagtcctatcagtaatcccgatatcggaccagaacggccgcatctacaaaggatataaaggggactcaaactaccggtacgacgtatgggaattacccggcggaaaatgggaggcagaagtagtatcaacattcgacgcacaccagccagactgggtgagcaagatccggagcagaagcccgaccgcacgaaaggtcttaagcctccagcaaaacgacttaatcgccgtagaacgagcgcacgaaacacgagaactgatgagagtggtcaaattccgacagaacggagaaataacgttcgcgcccccacaagaagcagggagcctaaaacgcagggacgcaacgcctaacgaggacgacccgttcaaatacttcgccgtagccgccagctcgctccagaaagcgaaagcgcgtcaggttcgaatagacgaactaggacgagtactagacccgggattccccgcacgaacggcccggcgaaaaaccaggaagtccacctga

SEQ ID NO: 6245 - RNA, 3333 nt, synthetic construct
  misc_feature 1..3333: note = Cas9 variant
  source 1..3333: mol_type = other RNA
atgcgcatactgggcttcgacatcggaataacgtctatcggctgggcgtacgtagaaggcgaggagctgaaagactgcggcgtccgaatcttcaccaaggcagagaacccccaaaacggggactcactggccgctccaaggagagaagcgcggggcgtacgacgccggctggcccgtcgaaaagtccgcctaaacgtaataaagaggctcctatgcaaagagttcggcctcaacctgagtgactacttcgccaacgacggagaattaccaaaggcatatgaaacaacaaaagacaccaaatcaccctacgagctccgcagcctggctctggaacagaagctcgaaccaaaggagctagcgcgggtaatactacacatagcaaagcaccgaggctacggcaacaagcacgcgaagcgcgacttagaagcagaggagaaggcgaagaaagcagcagaaaaggcgccacaggagaaagaaagtaccacgaccaacggggacagtaagaaagaacaagaaaaagtcctgaaagcactctaccaaaacgaaaccctacttaagaaataccagaccaactatcaaactaacaacaagaccaacgacgaaacaaacaacaagacgatattcctggtcggcaaatacttatacaaagagttccaagacaaggggcaaagaatccggaacacaacaaataactaccaacacacaatgcggcaagaatggttaaaagacgaactagagttcatattcaagaaacaaaaagactttggcgcgacgttctcggagaacttcgaaagccaaatcctcgagacggcgttctaccaacgggatctgaaatcgttcgaagacaaggtcggcaaatgcgtattctacgaaaacgaaaaccgcgcgccaaaggacagcctaagcgcgatggaatttgtagcactcaccagaatcataaacacgttgaagaacctagagaaaaagagcaagaacctaggaataggcgaaacatacggaaaagacaagatccaagaaatactaaaaatcgtcctagacaagggcgaaatgagctacaaggaactgcggaaaatactaaagctgaacgagagtatcctattcgccaaagacagcaaactcgactacaccaaaggcatgcaagaggctgagaaggcaaaattcatagagctaaagaacctaaaggctttcaagaaagctatgggaggcgacttctcaaaattccccagggaagaactagacaagatcgccacagatatcgtgctcatcaaaagcaaagaaaacctagcaaagaaactgcaaaactacagcgcgctgagcaaggaacaagtagaagcactatccaacctcaacttcgctaagcacatagacctgagcctcaaggcgctcgacaaaatcctcccgttcatgcgcgaaggactcagctacgacgaagtcgtcaagaaagtcgggctccaagaacaccggaaatacaagcaaaaaggggagttcctcatacccctaaaggaatacgagccctacctcgcgaaccccgtcgtcgcgagagccctgtccgaatataggaaagtactgaacgcactcctcaggaagtacggcaacgtgcacaaaatccacctagagttcacgagggaagccgggaagaactacgacgaaaggaaaaagatagaaaaggagcagcgagaacacttcgaagcaaaccaaaaagccatcaagcaacgggaaatactgggactgcccataaacggagcgaatatcctcaaaatgaaactttggatcgaacaaggcgaatgctgcgtctactccggggaaaagataacgagcaagcacttcttcgatagcaacgcactccaggtcgaccacatctacccatacagtcggagcttcgacgattcctacatgaacaaggtgctggtcttcgcgaaagagaaccaaaacaaactgaacaaaacccccttcgaagccttcggctccgacaaggaaaaatgggatcgaatcctatcattgtcggcaaagctacccaagcagaaacagagacgaatcagcaacaaagacttcaaagacaaagaactaggcttcatcgcaagaaacatcaacgacaccggatacatcgctcgactagctagccaatggacgaacaactgcctaaaattcgaagacctgagagaaaacgaagtcacgatagccggagaaaaaggatccaaaaaccatctagaggtgataagcggacaactaaccagcatgctgcgccactactgggggctcggcgacaaagaccgcaacaaccacctccaccacgccgtggatgcggtgataatagcctacacaaatgccaaaacaattaaagcgttcgcggacttcaagaaaaaccaagagcagaacagggccaaattctacgccaaacaaatcagcgaacaggaatacaaaagacaacgaaacccattcgaaccctgcgcgaacttccgccaacgagtcgaagagaagattaacaaaatattcgtatcgaaaccaccacggaaacgagcccgcggcgccctgcacaaggagacgttcggctctatatgcctcgacggaaacaacaactgggtcgccaggtttaaaatcaaaagcaagaaagaacaagaggacataacaaaagaaaaagccacaaaagcgaaatacaaggacgagttcaagggcgaagaaaacataaggaaagccctgaaacttggcaaaatacgcaggataaacaatactcagaaagatatagctatcggagacaaaatcgtgaaaaatgagaccatggtacgggtcgacatattcaaggacaagaaaggcaaattctacgccgtccccatatatacaatggacttcgccctaggcatccttcccaacaaagccgtagcgacaggggaggacgaggacggggtaataaaagactggattgaaatggataaaacaaaatacgagttctgcttcagcctgttcaaagacgacctcataaaagtaagaaagaagaaaatgaaagaagccgaactatgctacttcgtcggcttcgacaccgacggatcgcgcataatcgtggccaaacacaataacgactatcaaaccatgaccgagaacgaatgcaaactcttcacgctaaaggagaagaaaaagaaacagaaaacgctaaacgacgaagaggacaaccaagagcggatcgagaccgaatacaaaatcatcggtggaaggacgggcatccaaaacctggagaccttcgagaaacaccaggtaagcccactgggcgaagtacagaaagctgaatttgaagaccgccaagaaataaaactgaagtcatcaccgaaaggcaaagactga

SEQ ID NO: 6246 - RNA, 3333 nt, synthetic construct
  misc_feature 1..3333: note = Cas9 variant
  source 1..3333: mol_type = other RNA
atgagcgaaaaatacagactggggctagacgtcggaacaaactccctaggatgggcggtcatcggcctaaaggaagacgtaccctcaagcgtactagccacgggcgtccgaatattcagtgaaggccgggacgccaagacaaaatcaaccctcaaggcatcccggacagagaaacgttcggcacgcaggcgaagggacagattcctccaaagacagacattcctaatctcagagatggtcaagagcggactcttcccaaaagacatcgtcgaacagaaaaacctggaactactcgacccgtatgaaatacgcttcaaagccctgaccgagcaagtccccctacaccacctaggacgagccctcttccacatcaaccaacgaagaggattcaaatcgtcccgcaaagacaaatcagaagaaactacctccggcgtcgtatcaaagtcggtccgcgccctatacgaagaaatgcaattaataaatccggcccccgtaatcgacgaccccaaagcactatcaaaagaagaaagacgagaaatccgcgtacaggaagcatcgtcccgagaagaagcgctagtaaccttggcagaacaaaaaggagtaactttcggggcatttctctaccggcgactacaatcaggcaagagcgtccgagcccgaaaggacgcagactcgcagctatacgacgtttaccccacgcgggaactactaaaagacgaatattcgaaactcatgcaacaccaagcacaatactatccgaacgtgataaacgaagcactgatttcccgactccacgacgtaatcttctttcaacgaaaactcaaagaacaagagcgcggattttgcacctactacccgagcgaacggcggacattcaggtgcatgccctcgttccagcaataccgaatggtccaggaactgaacgcgctcgagtgggtagacgccgccggcaagcactgcctccgagactaccccgaaagccgcgacctcatactatcagagctcgagaacatatccaccaaagcaggagagttcacattcggcaacatgaagaaaatactgaaaaagatgggggtaatcgacggagaagtatcatttaacttcgaaggcccgaagcgcaaaggcttccagggcaacgtaacctcacgagaaatgcgacacgaagactgctttggcacccggtgggacgagctaagtctggacgagaaagacgacattatcgataagataaacgacgatcatttagacgacgaagacatggagcgatacctcatagacacctacggcctgagcagcttttcagtaggcaacgccataaacgcacgactcctagaaggaacagccaacgtgagtagaaaggccgcccgcaccctatacgaaacgatgctatccgcaaattgcctacaatcagacgcagtaatcgccgtgtcagaacaggacgacacattcgtaaacccctacagtcggacggggcgcggggaactgctctccgaactgccatactatggcgaagcattccaagacggacgccacataatacccggaaagcgcgagcccaaagtaagccacgaccaattgaagttctatggcggcgtaagcaacccaacagtgcacatagccctgaaccaaattcgcctggttgtcaatgagataataaagcgctacggcctgccatcgtccatcagcatagaactcgctagaaatcttcccgaaggccaggacggacggcggaaaatagagaaaatgcagagcgaaaaccagaaaaacaacgaaagatacgaccaaatcctaacagaaaacgggcaatcgcccaaccgggacaatcgtctaagactagcactatgggaggaactaggcgaaggaccgaccgaccggctctgcgtatttaccggcaaactaatcgaactagcagacctgtttaacggctccgtagaaatcgagcacttgatcccgttctccgtcagcctggacgactccaaggccaacaaaacagtgtgctggaaagaagcgaaccgattcaaaggaaacaaaacaccatacgaggcatttgcaaataactcgggagactatagctgggaggagatcatggagcgagtacgagctctccccaatagcaagcaatggcggttccaagaagacgccctcaaaatctggaactcagaccacagcgacttcagtggcagacatctaaacgatacaaggtatataagccggctagcccgagagtacctggagaacatctgccccttcaacaagatagacgtggtcacggggcgcctaacggccctcctaagaggacactggggcctaaacaacatcctgagaggacacaatgagccagaaaccgcaaccccaaagaagatgcgagacgaccaccgccaccacgcaatcgacgccgtggtaatcgccatgacgagcctaacgatactgcagaaagtatcatcagcggccggaaaggcggaagaactagacgtgggcaaactcttcgcaaaagacgaaagcggtcgcagcgtcatagacccctgggacggcttccgcgacgaggtcgccgaaaaagtccgcaacattatagtttcccacaagacaaaacgcaaaaccatcggcaactcaggcaaatcaacggaccgcgcattacacaacgagacggcgtacggactcatcgacggtccagacgagaaaggtctctactccgtcgtcaccacaaaaccaatatcctacttcgacaaccgtgacaagattgagaaaatacgagacgagaagctacgggacgacttcctcactgcctgggacggcgaaggagacaacaaagcctcacaactggcagtactagacaaagcctccgggctaaacgtgaagaaatgccgttacgtggaaagaaagaaagtcataccaataaacggaccggacggacaaccttacaaagcctacgacggaaattccaattgggggatggaaatatacgagttcccaaacggacacccaaaagaaaagaaatggaacggagtagtaatctccacctacgacgccaacaaatcagagttcaaaccaggcgaaaccttccggccacatccagcagccaaactcgtcatgcggctacacataaacgacatagtagaagtccaaaacgacggagaaccaatcctctatcgagtccaactaatatccgcgggtacacttacggtaagcccactccacgaagcaaacgtcgactcacgcaatagagacaaacacgatgaatttaaatacaaatcgctaagcgtgacaccgatgcagaaaatgggcgccaaaaaggtaaacatatcacccaccggactgaaaaactacagccgctga

SEQ ID NO: 6247 - RNA, 3345 nt, synthetic construct
  misc_feature 1..3345: note = Cas9 variant
  source 1..3345: mol_type = other RNA
atgggaatcatcatcggactagacataggcatcgcctcggtcggcatcgccgtcgtagacaaggacaccctagacatcaagtgcgtcgttagtgacctcttcgacagcgccgacgccagtaaaaacatcgaaagaagaaacaacagacaggcacgccgactcaatcgccgacgaaaaacaaggatcggtgacttcaacaccctctgggtatcaatgttcggcgagctccccgaagaagtagacagcaacgtactactcctgcgaaacgcaggacttgacgaacaactaaccctcgacgaaatatactgtgtcctcaaatacatgctaaagcaccgcggcatatcctacctcgaggacgccctaaacgaagaaaacgtcaccggatcctaccagaagggaatcgcaataaaccaaagagagagcgaatacatgctaccctgtgagatccaactggagcgctttcggaaatacggacaataccgaggagaatgcgaagccgagaacgagaacggcgagaaaataactttatcaaacgtattcatgaccaatagttaccgcaaagaaatcgacaaattcctcaacacgcagggcaaatacggcattctaaaccaaaaattcatcgacgagtacctgaaaatcttcaaccgaaagcgcaaatactacgagggtcctgggaacgaaaaatcccgtaccgactacgggaagtacaccacaggaaaagacctcgacggcaagtacatcaccgagaaaaacatcttcgaaaagctaatagggaaatgctccgtatacaaagaggaattgcgagcggccggcgcatcatacactgcacaggagttcaacatcctcaacgacctcaacaacataacggtaaacaacaagaagctgaccacacaacaaaagaaggacgtcatagaaatcgtccaaaatagcgacagaatcaacatggaaaagattatttcatcgtgtatcggggagaaaatcgaaaagatcgaaggcgcacggatcgacaagaacgagaaaaatatataccacaccttcgaacaatacaacaaaatgaggaagatatttgccgagaaaaactacgacatcaaggagctaacaattgaacaactcgacgagataggccgtatactcaccatcaacaccgagcgcgaggggatcaaagacgccataatggaatcggaactcctgcaccttaacaacgaacagataaacttactaatcgagctaaggtacaagaacagctcattgttcaccaagtggcaatccttaagcatcaaggcaatgcgagaaatcatccccgacttatatgaccgcaacgtcaaccaaatgaacatactcgccgaaagaggcgtcttcaaagataaaatcaacctattcgaaaattctgtgtacctaccgaaagagcccgtactcgaagagatctacaaccccgtagtccgacgctccatctcaatgacgatcgacgcgctaaacgcgctcataaagaaatacggataccccgaggacatagtcatcgaaatgccacgagaccgcaacgacgcggagcaaaaagatcgcatcaagaaattccagaaaacgcgagagaacgaattgaaaaacataaagaagaaaatcaaagaagaatacgggatcgagataacagatgaatacttccgcaaacacaaaggcctggagcttgaattgaaactctgggtcgagcaaaacgaaaaatgcccatactccggaaagtacattaacgtacaagacatactctaccaccacgaactcttcgagatagaccacatcatacccctatcaatctcgtacgacgacagccgaaacaacaaagtgcttgtttacaaagaagagaatcaagacaagggcaaccgaacgcccctaatgtacctctcgaccgtcaacagacaatacgatcaacacgaatttatgaactacgtcctcagcaccaaaacactaccgcgaaagaaacgagaactcctgctcaactatgaagacatcaccaaaatagacgtcctaaaaggctttatcaaccgtaacctaaatgatacgcgctacgcaagcagaagcgtccttaacgcgatccaactatttttcggcggcaaggagtgcgacacgaaagtacgcgtgatccgaggagcagtcacgaaccaactacggatcaaacttaacctcccaaaggaccgagaaaaatcttacagtcaccacgcaattgacgccgcaatcatgtgctatagtcaaatgggtctaatgaacttccggaacatacaaaacaaattcatagacttcgagaatgaaacgtacctcagtgacgagcgcgactcctgctttgacaacaaatactatgacgaggcactgttcggccaagtcctcaaaatgcggaaaaatctcctaaaagcggagggaaaaccccagaggtccgtacaaagcaaaggtgtattcgacgaggaagagaaaaacaacggaatagtccgataccaccacaaggtcgacaagaaacccaaccgcggcctatcgaacgcgtctatctacgggacccgcaaaatagacgacaaaatctacaaaatcgtcggctacgacatcagaaataataaggacgccgaagccatcattaacatcattaagaaaggcaaatctgataacttcctaatggccaaacacgatcccgaaaccttcaaaaacctcatggaaatatacgagcaatacaaagaggagaaaaaccccttcctcgcctatgaacaggaaacgggggactacatccgtaaatacgccaaaaaccacaacggaccgatcatcaagaaaatcaaatacgtagacagcgaagtcgggtcctgcatagacatcagcgcaaactacggatacaaaaatggagacaaaagggtcatcatggacacgctcacaccgtacagggcagacgtctattataactataaggacggaacataccggataatcggtgtcaaatatgcagacttcaagtatagcaacgcaaaatacgtactggacgaagaagcgtacgcactaatcctaataaaggaaggactactaaaaataggcgactccctcgagaacatctcgagcagcggctatgagtaccgcctcagcttctacaaaaacgacatcatcgaatatacgaagaacgacatcgtatacaaagaacgcttcctatcccgcaccatgccgaaagtgaagaactacatcgaaaccaagcccatatcagccgcgctctacgagaaaagaaacccgatcggactcaccaacgctacaaacatctgtaaaatttataccgacgtcctgggaaacgaaaccaaaatctacaaggaaaaattcaagctgagtgtagactga

SEQ ID NO: 6248 - RNA, 3345 nt, synthetic construct
  misc_feature 1..3345: note = Cas9 variant
  source 1..3345: mol_type = other RNA
atgaactacacagagaaggagaaactattcatgaaatacatcctcgcgctagacattggcatagcatccgtgggatgggcaatactagacaaggagtcggaaacagtcatagaagccgggagcaacatattcccggaagccagtgccgcagacaaccaactccgacgcgatatgcgaggcgcgaagcggaacaacaggcgactcaaaacaagaatcaacgacttcatcaaactctgggaaaacaataacctgtccatccctcaattcaaatccacggaaatagtcggacttaaagtccgcgccataacagaggaaataacgctggacgaactgtacctgatactatactcgtacctaaagcacagagggatctcctacctggaggacgccctggatgacacggtaagcggatcgagcgcctatgcaaacggcctaaaacttaacgcgaaggaactcgagacacactacccgtgcgagatccaacaggagagactgaacacgatcggcaagtaccgaggtcaaagtcaaatcatcaacgaaaacggagaagtcctagaccttagcaacgtcttcacgatcggagcataccggaaagaaatccagcgggtcttcgaaatacaaaagaaataccacccagagctaacggacgagttctgcgatggatacatgctgatcttcaaccgcaagagaaaatactatgaaggcccaggaaacgagaagtcccgcacagattacggacgattcacgacaaagctcgacgccaacggcaactacatcacagaagacaacatcttcgaaaaactcatcgggaaatgctccgtatatccggacgaactgcgcgcggccgcggccagctacacagcgcaggagtacaacgtcctcaacgacctaaacaacctaacaataaacggtcgaaaactagaagagaacgagaagcatgaaatcgtcgaacgcatcaaaagctccaacaccatcaacatgcgcaaaataatcagcgactgcatgggagaaaacatagacgatttcgcgggcgcccggatagacaaaagcggaaaggaaatatttcacaagttcgaagtttacaataaaatgagaaaagccctcttagaaataggcatagacattagcaattattcccgcgaagaacttgacgagataggctacatcatgacaatcaacaccgacaaagaagcaatgatggaggccttccagaagtcctggatcgacctcagcgatgatgtaaaacaatgcctcataaacatgcggaaaacaaacggagcactgtttaacaagtggcagagcttttccctcaagatcatgaacgaactgatacccgaaatgtatgcccaaccaaaagagcaaatgaccctactaacagaaatgggagtcacaaagggaacccaagaagagttcgccggattaaaatacatcccagtggacgtcgtctccgaagatatattcaaccccgttgtacgcagaagcgtacgaatatcattcaagatcctaaacgccgttctcaagaaatacaaagctctcgacacgatagtgatcgaaatgccccgagaccgcaactcggaggaacaaaagaaacgtatcaacgacagccagaaactcaacgaaaaagaaatggaatacatcgaaaagaaactagccgtaacctacggaatcaaactaagcccgtctgatttctccagccaaaaacagctgtcactaaaactcaagttgtggaacgagcaggacggaatctgcctctacagcggcaagacgatagaccccaacgacattataaacaacccccagctattcgaaatcgaccacatcatccctcggagcatctccttcgacgacgcgagatccaacaaagtgctggtataccgaagcgagaaccaaaagaaagggaaccaaacaccatactactacctaacccactcgcacagcgagtggagcttcgagcagtacaaagcaaccgtcatgaacctatccaagaagaaagaatatgccatatcgcgcaagaaaatccaaaacctgctatactcagaagatatcacgaaaatggacgtgttaaaaggcttcataaaccggaacataaacgacacgagctatgcaagccggctagtcctaaacaccatacaaaacttcttcatggccaacgaagcagacacaaaagtcaaggtaataaaaggctcctacactcaccaaatgcggtgcaacctaaaactcgacaaaaaccgggacgaaagctatagccaccacgccgtagacgcgatgctcatcggctactcggagctaggctacgaagcatatcataaactgcaaggggagttcatcgacttcgaaaccggcgaaatcctaagaaaagacatgtgggatgaaaacatgtcagacgaagtctacgccgactatctctacggaaagaaatgggccaacatacgaaacgaggtcgtgaaagccgagaagaacgtcaaatactggcactacgtaatgcgaaaaagcaatcgagggctatgcaatcaaaccataaggggaacgcgcgagtacgacggaaaacaatacaagatcaacaaactagacatacgaaccaaagaaggaatcaaagttttcgctaaactcgcgttctccaaaaaggactcggaccgggaacgcctccttgtatacctcaacgaccgccgaaccttcgacgacctatgcaaaatctatgaagactatagtgacgcggcaaacccattcgtccaatacgaaaaagagacaggcgacataatccgcaagtacagcaaaaagcacaatgggcccaggatagacaagctgaagtacaaagacggcgaagtcggcgcctgcatagacatctcacacaaatatggcttcgagaaaggatcgaagaaggtgatccttgaatcccttgtaccgtaccgtatggatgtgtactacaaagaggaaaaccacagctactacctggtcggagtcaaacagagcgacataaaattcgaaaagggacgcaacgtcatcgacgaagaagcgtacgcacgcatactggtcaacgagaaaatgatccaaccaggtcaaagccgcgcagacctcgaaaacctcggattcaaattcaagctcagcttctacaaaaatgacataatagagtacgaaaaagacgggaaaatatacaccgaacggctagtaagtcgcacgatgcccaaacaaagaaactacatcgagaccaaaccgatcgacaaagcgaaattcgaaaaacaaaacctcgtaggcctcggaaagaccaaattcatcaagaaatacaggtacgacatactgggcaacaaatactcctgttccgaggaaaaattcacgtccttctgttga

SEQ ID NO: 6249 - RNA, 3348 nt, synthetic construct
  misc_feature 1..3348: note = Cas9 variant
  source 1..3348: mol_type = other RNA
atgtcggcaacgtatacaatcgggctggacatcggaatcgcctcagtgggatggtgcgcattcggagaaacacacatactcgacctcggagtgcgagcattcgacaaggccgaaacagcaaaagagggagaatccttaaacctcgccaggaggaacgcacgcctaatgcggaggcgcctcttccgacgaacatggcgactcaaaaagctggcaaggcaacttaagtcagaaggcctaatagcagacacaaaactttttaaacctgagctacctttcagcaaaagcctttggcagctcagagtagacggattagacagacgcctaaacgacgaagagtgggcacgcgtcatctaccacctttgcaaacaccgcgggttccactggatatcacgcgcggaagccaaacaagcagaaggggatagcaaaagcgaaggaggaaaggtgaaacaaggcttagccgggacagcgaaattaatggacgagaaagggtatcgaagtgccgcagaaatggttctagcagagttcccgcaagcacaacggaacaagcaaggagaataccaaaaggccctgagccgagaactgcttgcaaaggagctcgcactgctattcgcacagcaacgagagtacgggaacctgcacacgcccggggcactagaaacagccatcctgggcaacggagacaagaaatcgggtctcttctggcagcaaaaaccagcattagccgggacagacctactgaagatgctcgggacatgcacattcgaaaaaggcgaatacagagcccccaaagcgagtttcacggccgagagacatgtgtggctaacacgactaaacaacctacgcatagttacagatggcgtgacccgacagctcacggaacaagaacgccaactatgcttaccactcccatatcgacaagccggagacctgacatacaaacagctaggctccgccctggcaaaggcaggactactcgaagcaggcggattcaaattcaccggattagcatacccgacggaggcacaaaaagcagaaggtaaggcgaaggaccccgaaagcgcaacgctagtcaaaatcccagcatggcacgaactgaggcaaacactaacaaaagggggactaaacgacgaatgggaaaagctggcaggcgacgcgctttgcgggcagcccgagatattcgacaagatcgcatgggtattgagcgtatacaaagacgacgacgaggtaagggccgaactggcgaaactagcgctacccaacccacaagccctcacagaagcgctgctaaacatcaggttcgataaattccacagcttgtcgctcaaagcgctccgagcaatagtcccacacatggaacaaggcctcagatatgatgaggcctgcgtacaggcaggataccatcacagccaactcctgaaggtaggagaaggagaacacaaatacctacccccactctacgacgggcgggacggcgacggcaggatgatattcgccgaagacgccgacataccgagaaacccagtcgtactccgatctctaaaccaggcaaggaaggtcgtaaacgcaataatacgcagatacggaagcccctccgcagtccacatcgagatggcacgagacctatcgcgcccattcgatgagagaaacaaaataaagaaagaccaagacgaataccaagcaagaaaccagagagatagggaacagtttagtgaactgtttggacacccgccgaaagggttagagttcgaaaaatggagactctacagagaacaaaacggtcaatgcgcctactcccaacggccccttactgcgagcggcaatgtagcagaaatcttcctagacggcagcacagaaatcgaccacgcactcccctactcaagatcgttcgacgacagcaagaacaacaaggtcctcgtgctaacacgagaaaacagagacaaggggaaccgcacaccctacgaatacttaggaggcgccgagaacagcgagtcctggcagcgattcgtgtcattcgtagagagcaacaaagcgtaccggctcgccaagaggacgcgactcctaaggaaggacttcggagccaaggagagcgaagagttcagagaacgaaacctaaatgataccaggtacgtatgcaggttctttaaaaattacgtagaacaacacctgaaactcgccgaaggatcggaaacaaaaaggtgcgtagtcgtcagcggacaattgaccaacttcctgagagcccgctgggggctactaaaagtccgaagtgactcggatagacaccacgccctcgacgcggcggttgtggcggcctgctcgcactcaatggtccaaaggctctcaaactacagccgaaccagggaactagaacaggtaagagacggattcgtggacatagaaacaggcgaaatcgtcaacccagcaatgcaccaacaactacgagaacatttcccggacccatggccgtatttccggcacgaactcgaagcacgactcaagatcgacagtcccgaactcctcagagaagaaatggccagactaggaagctactcagaagaggaactaaaagtactaaaaccgctctttgtgtcccgagcaccccagaggcgtaacgggggtgcggcccataaagacactatttacggccaacctgagaagttaaagaaaaatggaagcgtcacccagaaagtcgccctgacatcactcaccctcaaagacatagatctcctcgccgacccccatcggaacgcaaaactatacggcgccataagagagcgcctagaagcacacggtggaaaaggagacaaagcattcccggcaactaatccgctaagaaaaccagacaaagaaggaaacccaaccggccccatcgtaagaaccgtcacaaaagtcattgacaaactgtcaggaatacccgtacgcgggggcatagcaaagaatgacaccatgctgcgggtagacgtctttacaaagggaggaaaattccatctggtgccggtgtacgtacaccaccgagtcaccgggctacccaacagggcgataatagcattcaaggacgaagatgaatggacgcttatcgacgactcattcgactggtgcttcagcctctaccccaacgacctactaaggattaagctcaagaaagaaagccacagcggatactactcaagctgcaaccgcagcacaggggcagtaaacctatgggcgcacgacagaaacgttaacgtcgggaaagacggcttcatagaaagcatcggagtaaaaatggcagtcagcatcgagaaactgcacgtagacacactaggcaacatatacccagcacccccagagaaaagacgggggctagcctga

SEQ ID NO: 6250 - RNA, 3351 nt, synthetic construct
  misc_feature 1..3351: note = Cas9 variant
  source 1..3351: mol_type = other RNA
atgtctcaaaaccaaaaccccaacacgcaatcacacctgaacccaacaacccaatcgagcacccaatcaaacccgcaaccaaccacgcaagaaagcctgaaaatattagggttcgacatcggggtcgccagcataggctgggccttcgtcgaaggaggggaactcaaggactgcggcgtcaggatcttcacaaaggccgagaacccgaaagacggcagcagcctagcactaccgaggagagaagccaggggagtacgcaggagactggcaagacggaaaggacgactcaacgcactcaaggtattaatctgcaaggagttcggcctcaacagaagcgactacctggccacagccggcgaattacccaaagcgtacgccacgtccaaagaaacgaaatcgccctaccaactaagggccgaatcactagaacgaaagctcagtgccgacgagttcgcccgagttatcctacacatcgcgaaacacaggggatacggcaacaaacacgccaaagaaagctccgacgacgacagcggcaaggtcaagaaagcgatttcagaaaaccaaaaagtaatgagcgaaaaagggtacaccacggcgggacaatacctctacggggagttctaccagaaagcacgaaacttctccgaagcagaacccaaatcaccgaaaaacgcgcgcgggacccaggagttcaaaaacgtcaggaacaagagcgaaaactacgcaaggtgcctggcacagtcggaactacaaaaagaactagaaatcatctttgcaaagcaacgggagttcggcttccaattttcggataagaaacacaaaacgattaatgccaacggaaagctcaaagaactagacttcgcggacgcagtcctagaaatagccttcctacaaaggccactcaaatccttcgcagacaaggtcgggaagtgcacattctacgaggacaagccacgcgcgccgaaagactctctcagcgctatagagttcgtcgccctaacacgaataattaacacactcgccaacataacgaaacgctccggagaggtctacagcgcggacaaagtaagagaaatactatcgatagtacttgacaagggggaaatcacctacaaaaacctcagaaaagtaatcgccctcgacgaaagactccaattccctaaagacagcaaactcgactacgcgaaagaagacgccgaaaaagccaaggcgatagaatttagcaaactcaaagcgttccgaaaggccttaggcgggtccttcgaaggattcattcgcgcagaactggactcaatcgccaccgacatcgcgttgatcaagtcaaaagacgaactgaaggccaaactagccaactaccaaagcctgaacgacgagcaacgcgagaaactaagcgaactttcgttcgacaaatttatcgacctctcattcaaggcactggaagccatactacccctcatgcgaggcgacaaggacgataaaatataccgatacgacgaagcgtggcgtgaggccggattggtcgaagtagcaaagaagacacagaaaggggatagcctacccccactcatcgagtacgaaaaggacttagccaacccggtcgtcgccagagccctagcagaatatcgtaaagtcttaaacgccctcctcaagaaacacgggaaagttcacaaaatacacttagagttcaccagacaagccggcgtaagctcaaaagagagaggcgaaataatcgccgagcagaacaaaaggctgaaagccaacgaagaagccaggaaacgatgcgaagaatacgggttaatcccgagcggaaagaacatcctaaaactcaaactatggcaagaacagggcgagttctgcgtgtacagcggcaagaaaataacacaaagcgaccttagggacgaatccactctccaaatcgaccatatctacccatactcccggtcctatgacgactcccaaaacaacaaagtactggtattcaccgacgccaatcagaacaaactaaatcaaacaccctacgaagccttcgggaaagacatttcgaaatggaaccaaatcctaggaagaatcgagaaactaccgaaggcaaagaagaaccgaataaccaacaaaaacttcgcaaacaaagaagcgggtttcatagcgaggaacatagtagataccagctacatcgcccgcctatcggcaagctacacagacgcattcatagagttctgtcccctagcggaaaacgaagacacaaccctaggcagaggagaaaaaggaagcaagaaacacatctcagtcgtgaacggctcactcaccgccaccatgaggcattactgggggttgaacacactgctcgacggcgagaacagcgaaagcaaggacagaagcaaccacctccaccatgccctagacgcgatcattatagcatatgtgaacgacagcgtgataaaagccttcagcgacttcaagaaaacgcaagagcaaaacaaggcccgactaatagcaaaagagatagaaagtgccgaatacaaaatatcccggcgattcttcagcccatccggcttcgaaaacaacgaagcgttccggcaagccatcaaacggaaaatattagggcaaagcctagaaagtagagaaaacgacatgacaataaacagcgaggccctcggcgaaaaagtcgggggaattttcgtaagtaaaccgccccgcaaacgcgcccgcggggcactacacaaagaaactttctcatcaatagacgacaaagacctgctcaaaacgtacggagggaaagagggagttaacagagcaatcaaactcggtaaagtacgacaaataggaagcaaaattgcggacaacggaacaatggttcgcgtcgacatattcagacacaaagtatcgggaaaattctacggagtccccatctacacgatggatttcgcactgggcatacttccaaacaaagcggtggtcgggggaaaggacaaaagcggcgtgatcaaggactggctaccaatggactcgaactacgagttctgcttctcacttttcaaagacgacctaatcctagtccagaagaaagaaatgtccaaagcagaactctgttacttcgccgggttcgatacttcgggcggacagattaaagtcgaaaagcacgacaaccacttcgcaacactaaccgataaccaacgattactcttcaacattgccactcccaaggaagtagcaggcaaatcaataggaatccaaaacctcaaagtatttgaaaaatggcaagtaagcccactaggagaagtctccaaagcggagttcaaagaacgagaaccgatcgcactaaaatcaacgccaaaacgcttcctccaaggctga

SEQ ID NO: 6251 - RNA, 3354 nt, synthetic construct
  misc_feature 1..3354: note = Cas9 variant
  source 1..3354: mol_type = other RNA
atgaaacacatcctgggcctagatttaggctctaacagcattggctgggcattcgtacaacaagacttcgagaacaaacaaggcaaaattatagcaaccggctcaagaatcattcccatggaccaaggaatactcggagacttcgaacgaggcaacacagtctcccaaacggccgaaagaacaacataccgctccatgagaagactacgggagcgccacttgctcagacgagaaagactccaccgtgtcctccatctgctaggatttctaccaccccactacgacgctcaaatcgactttaccaaacgatacggcaaatttatcgataatgccgaaccaaaaatcgcctacaacaacggcaacttcatcttcatgaactccttcaacgagatggtcgaagacttcaagaaacaccagccacaactattctacaaaaagtccaacggtgaagagagcagaatcccgtacgactggacaatatattacttgcgcaaaaaggcgctctcgcagaaaataacacagcaggaactggcctggctcatactccacttcaatcaaaagagaggctactaccaactccggggcgaagaggaaaccgaaaaccccaacaaggaagtagcctttcacagcctgaaagtcgtagatgtcgaagcagaagcccccaacaagaagggggagatttggtacaccatacgcctagaaaacggatggatctaccgccgcacgagcaagaaccccctcgacgactggaaaggcaaaacccgagatttcatcgtcacaaccgacttaaacgacgatggaactatcaaactcgacaaggagggcaaagagaagaggagctttcgcgccccagacgaaaacgactggaacctactcaaaaagaaaaccgaacacgacatagacttctccggcaaacccgtggggacatacatatacgaccacctactacaaaaccccaaccagaaaattaaagggaagctcgtccggaccatagaaaggaaatactacaaagacgaactaaaagcaatcctcgcgaagcaaatcgctctacaacctgagctctttacagaaactctcctggccgattgcattcgcgagctctatcgaaagaacgaaacccaacaacaaaacctactctcgaaagacttcctacacctattcgtagaagacatcatattttaccaaagacccctctgcagcaagaaatccactatcgcgaactgcaccctggagaaaaggagctacatagacaaagaaaccaacgaaagaaaagatgcccccatcaaagtatgcgccaaatcgaacccttactaccaggagttccgcgtcctccagtggctacaaaacctgcgaatctacgaaatagaaaccgacagagaagtcaccgcagagttcatcgaaaccccacaagactacgaggcactattcaacttcttaatgagccaaaaggaaatcgacaacgaggggcttctcaagtacttcctgttcgctaaaaacccacaaattaaagacaaagcggcgaagtcagaactcaagaaatggctcacaacgtatcggtggaactacgtgtacgacgccgccgataacagctcgaagaaatacccgatgaacgaaacggggtacgaactacaaagatacctacaaaaagtcgagggactaccagctaacttcttaacgtttgacatcacctaccaactctggcacctactgtactccgtaaaagacaaagtagagttcgaaaaagcactaaagaaattcgccaaaaagaaacaactcgacaaaacttccttcgtcgacagctttaaaaacttcaaaccctatcctaacgaatacggatcgttcagcgaaaaagccataaagaaactactcccactcatgcgattcggaaaccactgggatttcaaccgtatagatgtcagcacacaaaaacgaatcgacgatctcatcaacggcgtcgccaacgaagacatcaggaccataatacgcgaaaaagccgagaaataccaactcaactctgaaacctgcttccaagacctacccctatggctagcccaatatgtagtctacaaccgccacgccgaggcaacggatatagaaaaatggacatctgtttcagacctcgaggcgtatctagaagatttcaaacaacactccctacgcaacccgatagtcgagcaagtggtcacagagacactccgggttgtacgggacatatggcaacagtacagcggaggacaagcaaacttcttcgacgaaatacacatcgaactcggccgcgagctaaagaagacggccgaagaacgaaaacaactgagcgacaaaaaccaggaaaacgagaacacaaacctcagaatcaagaaactactcgcagaactcaaagaagacgcctccatccagaacgtacgaccctactcactcgtccagcaagagctactcaaaatctacgaagagggcgtcttctcctccacagacgagatcgaagaggacattcagaaaatccggaagaaagtcgaaccaaccccacccgaaatccaaagatacaaactgtggctcgaacaaaagtacaaatcgccctataccggcgaagtgatatcgctcacaaaactctttaccgaggaatacgaaattgaacacatcatcccccaatcccgctactatgacgacagcctaagcaacaaggtaatctgcgaaagcgcagtgaacaaactcaaaaccaaccagctcggtttagagttcatacaaaatcaccacggcgaaaaagtccggatcaccgcgaacaaagaagtaactatattcaccgaagaacaatacaaagagttcgtcaaaaagcattacgccaacaactccgccaaacaacagaaattgctactcaacgaaatacccgagaaaatggtggcgcgacagctaaacgacaccaggtatatctccaaatgcatctccgaaatcctctccaaaatagttcgctcagacgaaaaagacgaaggagtcaactccaaaaacattatcccatgcacggggaagatcacgacggcactcaagcaggactggggactcaatgacgtctggaacgaactcatactcccacgcttcgaacgcatgaaccaactaacgcagacccaactattcacatcctacaacgaccgcctccaaaagaacctcccaactgtccctattgagtactcacagggcttccaaaagaaacgtatcgaccaccgccatcacgccatggacgccctagtaatcgcatgcgcaacaagagaacacatcaactacatgaacaaccaacacgccctcgacaaatcgaaagacaagaaagaaaaacaacaaagccgcatcgacctccaccccctatga

SEQ ID NO: 6252 - RNA, 3354 nt, synthetic construct
  misc_feature 1..3354: note = Cas9 variant
  source 1..3354: mol_type = other RNA
atgcagaccaaaaacctactctacacactcggattagacataggaatagcgagcgtcggttggtgcgtcttaggggaaaatagaatcatcgacctcggtgtccgctgcttcgacaaagccgaaacacccgacagaggagagagcctcaacaaagtgaggcgagacgcacgactcatgcggcgccgcctccgccgacgagcatggagactgacaaaactggcacgattactcaagcacgcggggctaatagacagcacacgcatagtaagagacagacacgacggagcagtcagcccctggcaactgcgagtagaaggcctggacaggaaactagccccggaagagtgggcccgcgtcatctaccacatcgttaaacacagaggattccactggatatcacgtgcagaagaaagaaaagcagaaagcgacaaaggagagggaggaaaagtcaagcaaggcttaagcgcaaccaagcagctgatggtcgaaaagaactaccgcagcgcagcagaaatggtgctcacagagttccccggcgcgcagcgaaataaacgaggagaatacacaaaagcactctctcgaatcctgctcgctgcagaactgaccacactgttcgaacgccagcaggaactgggaaacccccacgcagggcccgatcttcaaacaaaaattctgggcaatggtgaccgcaaaagcgggcttctgtggatgcaaaaaccacccctctccggcagcgctctgttgaaaatgctagggaagtgcactttcgaacgggaagagtacagggcccccaaagcatcgttcaccgcggaacgccacgtatggctaacaaaactgaacaacctaagagtgctggtcgacggcgtcactaggcccctcagcgacccagaaagacgactggccctcagcctcccgtaccagcaagcatccgacttcacatacaaacaactgcgggccgcactctgtaaaaacggactattaccagactccttccaattctctggcctagcctacccgaccggcgcccagcagccagacggcaaagccaaaaaccccgaaaacgacaggctagtaaagctcccagcatggcaagagttccggaaaaccctaagagacgcaggcctagaaacagaatgggaatcaatagcgggaatggccgccgggggccaaccagacttgctcgatcaaataggctgggttctttcagtattcaaggatggcgacgaagtgctcagagaactacgcaaaatcccacttcccggcggagagaaaatggtacaagccctatccggagtcagcttcgatacattccacaacctctcactaaaagcccttagaaaaatcgtacctcacatggaagcaggactacgctacgacgaagcatgcctggccgctggataccaccactcagacctccgaaaagacactgacgaacgaagtctatacctccctcccctctacagcgggagaacaaccgatggcagaatggtattccgcgacgacatcgacgtaccccgaaacccagtagtactacgcgcaatcaaccaagcccgaacagtagtaaacagcgtagtccgtcggtacggaagcccaagctccatgcacatcgaaatggcccgcgacctttcgagaccatgggacgagcgaaacaaggtcaaacgcgcacaggaggaatacagagacagaaacgagaaactcaagatagacttcgcggcggagtatggtatagaacccaaatcgagagaatttgagaaattcctactatatcgcgaacaaggcggaaagtgcgcgtactccctaaaacccctggatctagaccgtgtcctaagggacctaggctacgcagaagtcgaccacgcgttaccatactcaagatcctttgatgacagcaagaacaacaaggtactcgtactagcggaagaaaatcgaaacaaagggaaccgcacaccctacgaatacctggacggcacaagcgagagccccagatggcgcgagttcaaagcgttcgtagagaccaacaaagcatatcgacttgccaaacgagctaggctcctaagaaaagactttagcggcaaaggaagcgaagaatttcgagaccgaaacctgaacgacacccgctatatctcgcgcttcttcaagaactacgtcgagcgtttcctgaaattagccgaagagagcgaggaacggacctgcgtagtattaagcggccagctgacggcgttcttacgggcgcggtggggcctggcaaaagtccgcggagactccgaccgccaccatgccctcgatgctgcagtcatagcagcctgctcacgcagtatggtcaaacggctaagcgactatgcccgaaggcacgaactagaaaaagtacgcacaggctttgtggatttcgaaaccggcgaaatagtcgacgcaggcaagtaccgccaaatcgaacgcgacttcccaagcccctggccctacttccgcgacgaactactcacccgacttaacaccgacgacccagccgaactaagagagcgcatgcaatcactaggaagctacccgcccgaagcactagagacgctaagacccatgttcgtgagcagagccccacaacggcggaacggcggagccgcccacaaggacaccatctaccggcaaacggaacgtctcaagaaagtagggtccgttacgcaaaaagtaccgctcgcagcactgaacttacgagacctcgaaaacctagtcgatccccatcgaaacgagaaactatatgcggcaatacgagcaagactagaggcgcacggtggaaaaggagagaaagcctttcccccaaataatcccctccgcaaacccgacagggacgggaatccaacaggtccaatagtgcgcaccgtcacgctagtgatagacaaaatgagtggcatccccgtacgtggaggagtcgctaaaaacgacacaatgctaagagtagacatcttcagatccaagaaagacggcaaattccacctcgtcccgctgtacgtgcaccacgcagttgcgaaacaactaccaacgcgcgcggtaatagcgtacaaggacgaaggcgaatggaccccgatcaacaaccacgacttcgacttcctattcgccctatacccaaacgacctcgtgcgcataacactaaagaaagaacgacacttcggatactacgcgggatgcaaccgggccaccggcgcagtaagcatctgggcccacgaccggaaccaacgaatcggcaaagatggattcatagacggaataggagtgaagacggcactatcagtcgaaaaattccacgtagacacactgggcaacgtctaccccgcaccgcccgaaacgcgccgaggtctcgcgtga

SEQ ID NO: 6253 - RNA, 3357 nt, synthetic construct
  misc_feature 1..3357: note = Cas9 variant
  source 1..3357: mol_type = other RNA
atgggaacaagatacagcttcgacataggcacaaactccataggatgggcagtgtggcgaacaggcagagaccccaaaggaatcttcggcgagaaagacgcaccactcgagttattaggcgcgggagtcagactcttcaaagacggtcgcaaccccaaagacggacaaagcctagccacaatgagacgaataccaagacaagcgcgcaaaaggagagacagattcgtcctacggcgcgaagcgttggtagccgccctcatagaagcgggcctcatgcctgcgtcagagaaggagaggaaggccctagcggatctcgatccctatcagctccgggcagcgggactcgataaggccctagccccgcacgagctaggccgcgcaatattccacctacaccaacgacgcggattcaaaagcaacagaaaaactgaccgaaaaagcgacgaccgggacaagggcaagatagcaacagccagtgcagcactagcgaaaaagttcgaagacgaaaacgcacggacgttcggagagttcctatggcggaggcacagagatccggacatgaaaagacaagcggtcctaaaggcccatgacccagcgaagggcaaaccagacctccgggcagcgaagttgcgccagccaacacgtatacgcctcgaaggacagggggcaacagcgttgtacgagttctaccccacaagagaaatgctctgccacgagttcgatgcactctgggaagcacaggccagacaccatcccatgttactaacaagagaagcaggcgacaaaataaggagcatcctattccgacaacgagaactaaaacccccactaatagggctctgcacattcgaatacgccgcaggagaaaaagagagccgcctaccaaaagctctgccaagtgtccaagcacgcgagatttacgaacgactcggccacatacgcctaagcacgggatcaggcacagacaggccacttaaatccagtgagcgcgatgaccttgcaacagcactgctacactgcgggctgacaaaaataaaagttagcaaaaccaagggactcgcattcaaaacagagttcagaaaagccctcagactagggggcgaagtgcgcatcaacttcgaagaaatgggagaagaaggcttagtcgacctccggacgaacagactgctcgttcaagacgatcactacggacctcgatggcgtgccctcagctggtccggaaaagacgccttcgtgaagaaattgctagaagcgacagacgacgacaagctagtagcaaggctaatgacagaagacggattgtctgccgtgcaggcaagaaacgcagccagcataccactgccggatggctactcaagactcggacctaccgcaaacgcagcgatactacaagccctaatcgactccagagacgaaaacgggttcgtggttacctacgacaaggcagtaaggcgagcaggagaaagactcggaaaggactggcaccacagcgatgaaagagatggagagatcttagacgccctcccctactacggaaaagtactgcaaagacatattcttccaggcatgatggaccccgcagacagaaaggacgaagcaaaattctacggccgcataatgaacccgagcgtacatatcggactgaaccaactacgcagactggtgaatgccctaatcgaacggttcggacctccagaccaaatcgtggtcgagctagcccgagatctcaagatgagcgcacgcgaaaaagagcaagagcaaagaaggaaccgggacaatcgagaggctaatgagaaaagaacgaaaaagctcgtagaactaggccaggacaacaacggtgaaaaccgggcacgactaaaactctacgacgagcaacaaagggcaggaaatggggtagcgcactgccccttcaccctggacccaatcggaatcacgcaattgttcagcccagaaatagaaatagaacacgtcctaccgcgcagcaggacgctcgacgactcggcagcaaacaaagtactctgctttagaacaataaacagaatcaaaagaggcaaaacaccatgggaagccttccacgcggacccaaaatggccagacatagcagcaaatgcagaaaagctcccgccgaacaagaggtggcgattccgggaggacgcgatggacgtatttgaagcgagaacatcgggaaaaatggacaaaacaaccttagaacaaatgggactcacaaccggatttcaggctcgacacctcaatgagacaaaacacatgagcaggttagcaaaagcctacctaggcaaaatctgcgaccctgacgcggtgtatgtgaccccaggagccctaacgagcctactaagaggcaaatggggactaaacagtatattgtcagacgacaacctgaaggacagaacggatcatagacaccacgcaatagacgcgataaccataggagcgatgacgcggagtctactactggaactcaacacgttagcagggaaagcagaacagtccgactatgacgacgtagtgggaaaggtcccctggccgtttgataacttccgagatgcagtaagatcggtagtcgatcgagtcgtggttagcaacaaaccagagcacggcaaacagggagcactgcacgaggacacagcctatggaatagtcggcgacgaagccgaagcagaagaaatcggaaacctcgtcagaagaaaactgctagtggacctcaccccaggagaggtagaccgcataagagacgcaggactcagaaaagcaatgcaagcagccgtagcgccaagtagagacgcaagaggaaaggttagcgacgcaaaaggttttgcagccgccctcgacacattcgccaaggcacaaggaatgcggagaatccgagtgggaaaagaagacatgtcagcagtaacgatacacgaccgacaaaccgataaagcgtataaggcagtagcgcccggagaaaaccaccacgtggacgtcgtacaaatgcgagacggtgcctggaaaggattcgcagtcacagtcttcgaagccaatcaaaaggatttcaggccccaatgggaaagagaaaaactcggaggtaaactggtcatgagactccataaaggggacgcggtagagctagaatcgagcggggtgcgcctggtcaaattcgttcaacagatatggatgaaaagcaacctagttctactcaccgagcacaatgaaggaggagacctacaaaagcggcatcaagacgcggacgatccgttccggtgggacttcgccaacataggcaaactcaaagaacggggctgtgtggcggtcaaagtggacgaactcggcagagtgacaaaaagaatatcaaacacctga

SEQ ID NO: 6254 - RNA, 3360 nt, synthetic construct
  misc_feature 1..3360: note = Cas9 variant
  source 1..3360: mol_type = other RNA
atgggctaccgcatagggctcgacgtcggaataacatccacaggctacgccgtactaaaaaccgacaaaaacggcctcccgtacaaaatcctcaccctagattccgtcatctatccaagagctgaaaaccctcaaacaggcgcgtcactagccgagcctcggcgaattaaacgcggccttcgcagacgaactcgccgcacgaaattcagaaagcaacgcacccaacaactctttatccacagtgggctactctcaaaacccgagatagagcaaattcttgcaacaccacaagcaaaatacagcgtatacgaactacgagtggcgggcctagacagacggctgaccaactcagaactcttccgcgtcctgtacttcttcataggacatagaggattcaagtccaacagaaaggccgaactaaacccagaaaacgaagcagacaagaaacagatgggccagctgctcaacagtatcgaggaaatccggaaggcaatcgcagaaaaaggctatagaacagtaggggagctatacctcaaggaccccaagtacaacgaccacaagcgcaacaaaggctacatcgacggctacttatcaaccccaaaccgacagatgctagtggatgaaatcaaacagatcctggacaaacaacgcgagctaggcaacgagaaactaacagacgagttctatgcaacttacttactaggagacgaaaacagagcaggcatcttccaggcccagcgggacttcgacgaaggaccgggagcgggaccgtacgccggtgaccaaatcaaaaagatggtaggaaaggatatcttcgagccaacggaagaccgcgccgccaaagcaacctacacattccaatatttcaacctcctacaaaagatgacctccctgaactaccaaaatacaaccggcgatacgtggcacacgctcaacggcctagaccgccaggctatcatcgacgctgtatttgccaaagcagaaaaaccaacaaaaacgtacaaaccaaccgactttggggagctccgcaaactgctaaaacttccagacgatgcccgatttaacctcgtaaactatggctccctccaaacccaaaaggaaatcgaaacagtagaaaagaaaacaagattcgtcgacttcaaagcgtaccatgatctggtcaaagtattacccgaggaaatgtggcagagccgacagctactcgaccacatcggtactgcactcaccttatattcatcagacaaacgccgccgccggtacttcgccgaggaactgaacctccccgccgaactcatagagaagctcctccccctgaacttcagcaaattcggccacctttccatcaagtccatgcaaaacataatcccctacctcgaaatggggcaagtttactcagaagccactaccaacacaggctacgacttccgaaagaaacaaatcagcaaggacaccatcagggaagagataaccaaccccgtcgtacgcagagcagtcacaaaaaccatcaagatagtcgagcaaataatacgccgatacggcaaaccagacggcatcaatatagaattggctcgcgaactcggacgaaacttcaaagaacgtggcgacatacaaaaacgacaagacaaaaaccggcaaaccaatgacaaaatcgccgcggagctgaccgaacttggaatcccggtgaacggccaaaacataatacgctacaaacttcataaagagcaaaatggggtcgacccctacacgggggaccaaataccattcgaacgggcattcagcgaaggttacgaagtagaccacatcatcccctactctatcagctgggacgactcgtacacaaataaagtactgacaagcgcaaaatgcaatagggaaaagggcaacagaatacccatggtatacctcgcgaacaacgagcaacgactaaacgcgctcacaaacatagcggacaatataatcagaaactcaagaaaaagacagaaacttctgaagcaaaaactctcggacgaagagttaaaagactggaagcaaagaaacatcaacgacacccgatttatcacccgcgtcctctacaactactttcgccaggccatcgaatttaacccggaactagaaaagaaacagcgcgtcctcccactaaacggagaggtaacctcaaaaattcgctcccggtgggggttcctaaaagtaagggaggacggcgacctgcatcacgcaatcgacgctactgtcattgccgcaataactcccaagttcatccaacaggtaaccaaatacagccagcaccaagaagtaaagaacaaccaagcgctatggcacgatgccgagatcaaggacgccgagtacgcagccgaagcccagagaatggacgcagacctcttcaacaaaatattcaacggcttcccactcccatggccggagttcctcgacgaactcctagcaagaattagcgacaatcccgtcgaaatgatgaaatccagatcctggaacacctacacacccatagaaatcgcgaaactgaaaccggtgttcgtcgtccgcctggcaaaccacaaaatcagcggcccggcccaccttgacacaatccgctccgccaaactcttcgacgaaaaaggaatcgtactctctcgggtcagcatcaccaaacttaagataaacaagaaagggcaagtcgccaccggggacggcatatacgaccccgaaaattctaacaatggggacaaggtagtatatagtgctatacgacaagctctcgaagcgcacaacggctccggagaactggccttcccggacggctacctcgagtacgtcgatcacggaaccaagaaattagtacgaaaagtgagggttgccaagaaagtcagcctaccggtacgcctcaagaacaaggccgcagcggataatggcagcatggtcaggatagacgtcttcaacaccgggaagaaattcgtcttcgttccgatctacatcaaagacaccgtagaacaagtcttacctaacaaagcaatcgcccgcggcaaaagcctctggtaccaaatcaccgaatcagatcagttctgcttctccctctatcccggcgacatggtccacatagagtcgaaaaccggcattaaacccaaatactccaacaaagaaaacaacacgagcgtcgtgccaatcaaaaacttctacggttacttcgacggcgccgacatagccaccgccagtatcctagtacgggcacacgacagctcatacaccgcccgctcaatagggatagcaggactactgaaattcgaaaaataccaagtagactacttcggccggtaccacaaagtacacgaaaagaagcgacagctattcgtcaaacgggacgaatga

SEQ ID NO: 6255 - RNA, 3360 nt, synthetic construct
  misc_feature 1..3360: note = Cas9 variant
  source 1..3360: mol_type = other RNA
atgaacgacaagaaaaacctagggcccctgacattcggtttcgacatagggattgcatccgtcggctgggcagtcctaagccccacaaggatcgtggacctaggcgtacgctgcttcgacaaggcagaaacagctaaggaaggggaaagcctgaatctcgcacgccgaagtgctcgcttaatgcggcgacgccttcggcgcagggcgtggcgactaataaaactcgcccgcctattaaaacacgaaggactcatcgcggacacaaaaacattcatacaaccctcagcaagccacgcctcaccctggcaactaaggaaagacggattagaccgtgccctctcccccgaggaatgggcgcgcgtactatatcacctatgcaaacatcgcggattccactgggtatcccgggcagaagcgcgcaaagcagatggtgacacaaagggggaagggggaaaagtaaaacaaggactggcatccaccaccaaacttatgaacgacaaaagttaccgaaccgcagccgaaatggtactagcagaatttccctcagcccaaagaaacaagagaggcgaatacaccaaagcactatcccgcgaattactcgacaacgagcttaagcaactcttcgaacgacagagagaatacggaaacccgcacgcggacacaaacctagaggcaaaaataaggggtagcggagaccacaaatcaggattattctgggaacaaaaaccggcactaagtgggaacgacttactaaaaatgctaggaaaatgcaccttcgaaaaacaagaataccgcgcaccgaaagcatcgttcacagccgaacgccacgtatggctaacgcgactcaacaatctccgtatcatagtcgacggaagaaccaggccgctagctgacgccgaaagaaccatggcactctccctaccctacgaacaagtcggagactttacctacaagcagctcagagctgcgctcgtaaaggcagggctcatgcccgactccttcaaattcgccagcctcgcctacccatcagagttccagaaagcagaaggcaaggcaaaagacccagagagcgcggcactcacaaaactcgccgcatggcaagagctaagagccacactaaagaaagccgacctagaatcagaatggcaacaaatatcatgcgcagcactcgagggccaaccggagacactcgacgaaatcgcaggcgtcctcagcgtattcaaagacgacgacgaagtcctcaacgagctacaaaaactaggactaccgggaggcgccaaaacggaaaacgcactactggacataagattcgacaaattccacgcgctatcactcaaagcgctgcgcaaaatagtcccgtatatggagcgcggtctccgttacgatgaggcttgcgaacgcgcggaatatcatcatagccaactacacaaggtaggcgaaggcaaccggaaatacctacccccactatacaaatctagagacaaagacggaagaatggtctttaacgacgaactaggagacatacccagaaacccggtcgtactcaggagcctgaaccaggcaagaaaggtgctaaacgcactaatagcgcgatacggctcgcccagctccgtacacatcgaaatggcacgcgaactttcgaagcccttcgacgaacgaatgaaagtaggaaaagaacaggaggcttaccgcgaacgaaacgaaaaggataagcagaccttcgtcgcggaatttggcattgtaggcgccgcaaaaggtggggagttcgaaaaatggaaactataccgggaacaacagggaaagtgcgcatatagtatccagggcatcgacctaaaccgcctgttagaacccggctatgttgaaatcgaccatgccctaccctacagcagatccttcgacgacagcaagtccaacaaggtactcgtcctagcggcagaaaacagaaacaaaggcaaccgcacaccttacgaatacctggacggtgaacacaactccgaaagatggagacaattcgtcgggttcgtcgagagtaataaactctaccgccaagccaagagaagccggctgctaaggaaagacttcggaaaagaacaagccgacgaatttcgcgaacgaaatctgaatgacacccgatacgtctgccgcttcttcaagaaccaagtagaacaattcctaaaactagcggagggatcggaaagcaaaagatgcgtagtattgtccggacagctaacagccttcctaagagcaagatggggactaattaaggtccgagacgagagcgaccgacaccacgcattagatgcggtcgtagtggcagcctgcactcacggaatggtcaaacgcatgtccgactacgcccgcagaaaggagctcgaccaagtcgccgaaggcttcgtagatgtcgagacaggggaaataataaacgccgccatgttccaacaactccatgaacacttccccgacccgtggccacacttccgagatgaggtacaaatgcgcctaaaaatcgacgaccccgcccaactccgatcggacctactcagactaggcaactacgccgaagaagacgtgcacgcagtccgacccctcttcgtctcgcgcgcaccgcagagaagaaatagtggcgcagcccacaaagagaccatctacggccaacccgaacgcctaaaagcacaaggaggggttacagagaaggttgcactcactgcactaacaatgaaagatctggaccgcctaatcgacccacatcgtaacgaaaagctgtacgccgcaatccgaaaacgcctcgaagagttcggaggaaaagcagacaaggcattcgcagcaagcaacccgctgcacaagcccgacaaagaagggaacccaacaggtcccatcgtaagaacagtcaccctagaaatagacaagctgtcaggagtgcctgtacgcggcgggatcgcgaaaaacgacacaatgttacgcgtcgatgtattcaccaaagcaggaaagttccacctcgtacccgtatacgtccaccacaaagtcacaggcctaccgaatcgcgcaatcgtggcgagcaaagacgaagacgaatggacagctatagacgactctttcgagttcctcttcagcctctaccccaacgacctggtcacgatcacccaaaaaggaaaggcgcccgtccgaggatactacgcctcatgccaccgaggaaccggggccttcagcctatgggcacacgaccgggcctcgtccgtaggtaaaggagggcaaatagaaggcataggcataaagacagcacttgccgtccaaaaatacaacgtagacgtgctgggcacaacgtatgccgcgcccctggaacagagacggggcctagcctga

SEQ ID NO: 6256 - RNA, 3363 nt, synthetic construct
  misc_feature 1..3363: note = Cas9 variant
  source 1..3363: mol_type = other RNA
atgaggaaagtgacgatcgggttcgacattggcgtatcatctgtgggatggagcgtagtagacatgaacaatggagcaatcgtcgaaaccggagtccgactcttctccgcgtcgagcgccgagaacaacgtcgaacgccgcaacaaccgacaaacacgccgcctcaaccgaaggcgcaaaaaccgactaaaggacgtaaaataccttctcgaaacgaatcacttcaccttcgaccaggaacagggtacgaacccctacgaactccgcgtagccggcttgcaccgcaaactgacccgctccgaactagcgagagccctctaccacctggtcaaacgacggggcatctcctacgacctgaccgatatcgaagaagaggaaatcgtaaccacgtcggcctacaagactgccttgggcaaaaaccagagccaattagcagaaaagaccccaggagaaatacaattcgcgcgactcgaaaactacggaaaagtgcggggcagcatcgaaatcaacgaacaggacatactcctcaacatatttcccaccagtgcatacctgaacgaggccaagcgcattcttgccacccaacgcaagttctaccccgaaattaccgaggcgtttatagagaaatactgcacgatcctaacacgcaaacgagaatactatgtagggcctgggacggaaaagaaccgcacagactacggcatctaccgaaccaacggagagaccctagacaacctcttcgagatattaatcggcaaagacaaattctacccgaacgaggaacgagccgcaggaaacagctacacagcacagctgttcaactttgttaatgacctcaacaacttgaagatacaaacaatagaagaccaaaagctaaccccaaaacaaaaggaagaaatcatcgaacaggtgaaaactgctgaaaagaaggtgagcctaatccagctcatatccaaaatcactaaaaccccgaaggaccaaataacaggctaccgcactgacaaaaacggaaaaccagaccttcactcaatggccgtattccgaaaagttcgcaagcagttcctcacaatggagatcgacatcttacattggcctgacgaactcctgaacgacttaggccgattactaactctcaacacggagaaaggggagatccgaaaacagcttaccaaggacttcatgaaacgctatcccatactcaacgaacaactcgtcgaccaaataatagagaaccgccacatcttcgcggtgtccggaaaccacaagtggcaccggttctcgctgcgcaccatgaacgaactactaccggaaatgctagccacaagtaaggaacaaatgacactcctctccgaacgcggtatgataaagcaacacaaaagagactacctgaaaatgaacgaactcgacgcccgcctcatcagcgaagaaatatacaaccccgtcgtcggtaaatcggtccgcgaggcgataaaactcttcaacgaactaatgaagaaataccaggaagtgcgctacgtggtactcgaaatgccgcgggacgacaacgaagaaaaagctaaaaaggaactgcaaaaatatcaaaaggaaaacgagaacgagaaagaaatcgcgctcagcgagttccaacgaaagggcttctttagcgacgcacagctcgaacgcgcgctcataaaagaccgaaaactcaagaccaaaatccggttttggcaccagcaagaaggcaaatgcctctattcagggcagattatcacccccgttgaacttctaactaacagtttctccttcgacatagaccacatcatcccccaatccgtatctttcgacgactcactaaacaataaagtattatgcacaaaagaaatgaacgaccaaaaaggcaagcaaaccccctacggattcctcctaaacggcaacggtcaaggcttcgatcgctttaaagcaatggtgaatgccaacagattaatgagcaagggcaagaagaaaaacctattgttcatggaagacctaaacaacatagaaacgcgaaaaaggttcatagctcgcaacctcgtagacacacggtacgcaagccgcgtagtgctcaacgaaatccaacaatacctaagagcgaaaaacaaggacacccaagtggcagtcgttcgcggaaaattcacagcaacccttcgtaagcactggaacatcaacaaatcccgagaaacccatcaccaccacgcactcgatgcaagcataatagcgatcacaccactcctctcagtatggaaaaagaaacagacactcatcccgaagacactctccgaagaaaaactggagttcgaatacgacgacatcgtcgaagataccatcttcgagaaagccctctaccaacttccgaaggagaacttcaaggaacaactcaacaattcacagccaaacataaaattcagctatcaggtcgacaagaaaatgaatcgtaaagtaagcgacgctaccatttactccgtgaaacaggcaaaactctccagcgataaacagtcagaagagtacgtactggcgaaaatcaaagacatctactccgtggaaggatacaaaaccttcgccaaaatctatgaaaaagacaaatcaaaattcctcatggcccaaaacgatcccaaaaccttcgagaagctagaggaaatcatacagagctacccaagcacacgcgaaataatcgtgggagaaaaagtgaaagtcgtcgacgtcagccccttcgagctatacagaaaagaatacggctacatcaccaaatacgccaagaaaaacaacggccctatcatacggcaactcaaatactacgaccacaagatcggaatgcacctcgatatcaccaaccaaaagaacaatggcaagggcaagaaggtaatcctgcagcagctcaaatcctggcgcacagacgtgtactataaccacgaaaaacaagaatacgaaatcatgggactaaagtactccgatctacgcttcaagaaagaccaatacggcatccccaaagaacgataccaggaagtcaaacaaatggagaaaatcgcaccccaatcggaattttgcttctccctgtaccgaaacgaccgcatcaaagtactcaacaaggaaacagacgaagaagtcgaactcctattcggagcacgcaactacacatcggcaggatacgtggacctcaagcctatagaccgcgtagagttcgggaagaaagaatggatccccgtgtaccaatacgcgaccagcgacgggaaatgcaagaagaaattcgccaaaaagggatacgaaatttataaggtcaacactactatactcggcgaaagctattacatcaaaaaggaacgcatgctccccaaaaacatcctggactga

SEQ ID NO: 6257 - RNA, 3363 nt, synthetic construct
  misc_feature 1..3363: note = Cas9 variant
  source 1..3363: mol_type = other RNA
atgagtgatctagtactcggcctggacatagggatcggctcggtcggagtcgggatccttaacaaggtcacgggagaaataatacacaaaaactctcgaatattcccagccgcgcaagccgagaacaacctcgttagacgtacgaatagacagggccgtcgcctgacccgtcgcaagaaacaccgacgagtgaggttaaaccgactcttcgaggaaatcggcctcatcacagacttcaccaaaataagcataaacttgaacccctaccaactccgcgtcaaaggactcacagacgaattgagcaacgaagaactattcatcgcactcaaaaacatggtcaagcataggggcataagctacctcgacgacgcctccgacgacggaaacagcagcgtcggggactacgcccaaatagtgaaggaaaactcaaaacagctcgagacgaagactcctggacaaatccaactggaacggtatcaaacctacggtcaactccgaggagattttacagtcgaaaaggacggaaagaaacaccgactaataaacgtcttccccacttccgcataccggagcgaagcgctacgaatccttcaaactcagcaagaatttaacccccaaatcacagacgagttcatcaaccgttatctggaaatactaacgggcaaacgcaagtactaccacggccccggaaacgaaaagagccgaaccgactacggcagataccgcacttccggcgaaacccttgacaacatattcgggatcctcataggtaaatgcaccttctacccagacgagttcagagccgccaaagcctcctacaccgcgcaagagttcaacctactaaacgacctcaacaacctaactgtccccacggaaactaaaaagctatcaaaagaacagaaaaaccaaatcatcaactacgtcaagaacgagaaagccatgggccccgccaaactattcaaatatatcgcaaagctactctcgtgcgacgtcgcagacatcaaaggatacagaatagacaaaagcggcaaggcagagatccacaccttcgaggcttaccgcaagatgaagaccctggaaacccttgacatcgaacagatggaccgcgaaactctcgataaactagcctacgtactcaccctgaacacagaacgtgaaggcatacaagaagccctggaacacgagttcgcagacggatcgttctcacaaaaacaggtggacgagctagtccaattcaggaaagcaaacagctcaatcttcggcaagggctggcacaacttctctgtcaagctaatgatggaactcatcccagaactgtacgagacctccgaggaacaaatgaccatccttacacgactcggaaagcaaaagaccaccagcagttccaacaagacaaagtacatcgacgaaaaactgctaacggaggaaatctacaaccccgtggtggccaaatcggtaagacaagccatcaaaatagtcaacgcagcaattaaagagtacggcgacttcgacaacatcgtaatcgagatggctcgtgaaactaatgaggacgacgaaaagaaagccatacagaaaatccaaaaagccaacaaagacgaaaaggacgccgcaatgttaaaagccgccaaccaatacaacggaaaagcagagcttccccacagcgtgttccacggccacaaacaactagctaccaaaatacggctttggcaccaacagggagaacgctgcctgtatactggcaaaaccatatcgatacacgacctgatcaataacccaaaccaattcgaggtggaccacattctccccctttccataacattcgacgacagtctcgcaaacaaggtcctcgtatacgccacagctaaccaagaaaaagggcaacggacaccataccaagccctcgactccatggacgacgcctggtcgttccgagaactcaaagcattcgtacgggagtccaagacactcagcaacaaaaagaaagagtacttgctaaccgaggaagacatatcaaaattcgacgtgcgcaaaaagttcatagagagaaatctcgtagacacccgctacgcaagccgggtagttctcaacgctctacaggaacacttcagagcccacaagatcgacacaaaagtcagcgtagtgagaggacaattcacctcccaactccgtcggcattggggcatagagaaaacccgagacacctaccaccaccacgcagtcgacgcacttatcattgccgctagcagccaactaaacctctggaagaaacagaaaaacaccctggtctcctactccgaggatcaactgctcgacatcgaaaccggagagctgatcagcgacgacgaatacaaagaatcagtcttcaaagccccctaccaacacttcgtcgacaccctcaaatcaaaagagttcgaagactccattctattcagctaccaagtagactcgaaattcaaccgcaaaatatctgacgccacgatatacgcaacacgacaagcaaaggtcggcaaagacaaagccgacgagacctacgtactaggaaagatcaaggacatctatacacaggacggttacgacgcattcatgaaaatctacaaaaaggacaagagcaagttcttaatgtaccgacacgacccacagacgttcgaaaaggtcatagaacctatcctcgaaaattaccccaacaaacagatgaacgaaaaaggcaaagaagtaccctgcaacccattcctcaaatacaaagaagaacacggatacatacgcaaatactcaaagaaagggaacggaccagaaatcaaatccctcaaatactatgactccaaactaggaaaccacatagacatcacacccaaggactcgaacaacaaagtcgtcctacaaagcctcaaaccatggcgaactgacgtatacttcaacaagaacaccggcaaatacgagatactcggcctcaaatacagcgacatgcaattcgagaagggaaccgggaagtacagcatcagcaaagagcaatacgagaacatcaaagtaagagaaggcgtcgacgaaaactccgagttcaaattcaccctgtacaaaaacgacctcctcctcctaaaggatagcgaaaacggcgaacaaatattactacgattcaccagcagaaacgacacgtccaagcactacgtagaactcaaaccctacaaccgccaaaagttcgaaggctcagagtacctcatcaagagcctagggacagtcgtcaaagggggccgctgcataaaaggactcggaaagtccaacatctcaatatacaaagtcaggacggatgttctaggcaaccagcatatcatcaagaacgaaggagacaagccaaaactcgacttctga

SEQ ID NO: 6258 - RNA, 3363 nt, synthetic construct
  misc_feature 1..3363: note = Cas9 variant
  source 1..3363: mol_type = other RNA
atggggctcgacataggcgtagcctccgtgggcttctcagtcttagatatcgacaaagggaaagtcatcgaactcggggccagactattctcagctaccgtcgcagccggcaatcaagacaggcgcgacatgcgaggagcccgccgcctcctcaacaggaacaaacagcgccgccaagacacaggcaaactattcaaaaagttcgggctcattgacgacttcgacaagggctcgttctatgacaacttcaaccaaaacctaaacccgtatgaactccgggtcaaagggctcaccgaacagcttacaaaggaagagttggccgaatcgctctaccagattgtgaagcatcgaggcatcagttacgccctaaaagacgccgacgtcgacgagggcggtacagactactccgtaagcctaaaaataaacagccaagaactcgcagagaaaacaccggcacaaatccaactacagcgcttgaatgactacggcaaagtccgcggccaagtcgttatcggcgacgaccccgataaccagaaggtactccttaacgtgttcccgacaagcgcttacgaaaaggaggcaaaacaaatcatagccacacaacagcagttctaccccgaaagcctaacagataaattcacagaagagtactgccaaatactgacgaggaaacgggactactttgtaggtcctggaaacgaaaagtcgcgaaccgattacggaatctacaaaacagacggaaggaccctagacaaccttttcgaggaactaatcggccatgataagatctacccagaggagctgagagcctcagccgccagctacacagcccaactatttaacgtactcaacgacctgaataacctcagaatcctaaactacgaagacggtaagctcacgaaagaggacaaggaaaagataatagcagaaataaagaacaacaccaccaccatcaacatgctaaatgtaatcaagaaagtcgccgggtgttccaaagacgacatcaaaggcttccgagtcaacgagaaagacaaaccagaaatctcaagcatgccagtatacaggaaaatccacaaagacctactcaaagccggtgtcgacatctccgactggccagtcgagttcatagacgaattatcattcatactgacgctcaacacggaaaacggagaaatacgcaaacaactcaacaacagactggcaccaaagttcgactttctcaacgccgacctaatccagctgatcatagacaacaaagacagcttcgaaatcaaaacaaacaacaagtggcataggttcagcgtaaaaaccatgaataaactaataccggaaatgatggaacgcccggtcgagcagatgacgctgctcaacgaaatgggcctggtcaaaaaggacaagaaacgattcgaaaacaacaaatacctcccatacaaagagatagcaaaggacatcttcaatcccgtagcaagcaagtccgtccgagaagcgctaaaaatcgtcaacgctgtcctaaagaaatacggccacatcgactacctagtggtggaaatgccgcgagacaaaaatctaaaagaggaacaggacaacataaaagagttccaaaacaaaaacaaaaaggcaaaggacgcagcattcgaagcctttgtcaaatctgtcgggtcggaacaacgcgtcaaagaagcgctaagtaaaaaccgcaaactccaaatgaaaatgcggctttggtaccaacaacaagagatagacccatataacggaaaaacaatagacgccaccgacctgatcaacaacccagacaaattcgaaatagaccacatcataccgcaaagcatatcgttctatgactcaatcaacaacaagacactatgctttgccagtatgaaccaagtaaaaggccagaagaccccatacgagttcatgctcgaaggacacggccaatcatacgacaaattcaaggcgaccgtcatggctaacaagaattttggcaaagccaaacgcgccaactacctcttcgaagaaaacgtatccgacatagaaacgcgaaaacgattcctgagcagaaacctggtggacaccaggtacagcagcagagtcgtgctgaacagcttacaagacttcttcagagaaaaatccgccgacaccaaagtaacagtaataagaggtaaattcaccagcaatatgcgcaagcattggcatatcgacaaaacacgagaaaccttccaccaccacgccatagacgcaagcatcatagccgccaccccattcctacgaatgtggaagaaaggcggtaccatattccccgtgaaagtaggcgaagagtcaatcgacatagaaaccggggaaatccttgacgacaaaaacttcgacaaggcgatgtacgaggaaccctacagtggattcgtctccgagatcatgaacgccgacgacaggatcaaattctcgcaccaagtcgacaagaaaatgaaccgaaaagtatcagacgcaaccatctactcgacgcgcaccggcaaactagcaaaggacaaaaaggacgccgaatacatcgtagccaaggttaaagacatatactcggtagacggcttcaaaaagttcaagaaagtatatgacaaagacaaaaccaaattcctgctctataagtacgacccacggaccttcagcaaactagaaagaatcatcagcgactgccccgacaaggtagaaaaagtccaaacaaacggaaaagtcaaggcagttgatatcagccctttcgaaatgtaccgacgcgaccatggaatgatcaagaaatatagcaagaaaggcaacggcccagcaatcaaacagcttaaataccttgacaagaaactcggaagtcacatcgacatcacaccggccaatgccaacggaaaacacgtcatcctacagagcctaaaaccatggcgcaccgatgtgtatctgaaccacgaaacaggcgaatatgaaatcatgggaatcaaatattcagacctcaagttcaacaagaacgaggggtacgggatcaagaaagataaatacctagaaataaagaaagtagaggaagtaagcgaaaaatccgagttcatgttcagcctataccgcaaggaccgcgttaaagtacaggacatgaaaaccggggaaagcgtcgaactcttgttctggtcccgcaacttctccaacaaaaagtacgcagagctgaaacccatatcccaggccgaaaatgacaaaaagctcccggtatacgggaaaggacgcctcataaagagactaatccctaaaaactgcaaaatctggaaagtgaacaccaccatactgggtgacccatactatctcgaaaaagaatcagactcccccaaagacatactcgactga

SEQ ID NO: 6259 - RNA, 3366 nt, synthetic construct
  misc_feature 1..3366: note = Cas9 variant
  source 1..3366: mol_type = other RNA
atgtcggaccttgtgctcggactcgacataggcatagggagcgtgggggttggcatcctgaacaaggtcaccggtgaaataatccacaaaaactcccgcattttccccgcggcacaggcggaaaataacctagtgcggcgaactaaccgacaaggccgccgtctcaccaggaggaaaaagcacaggcgagtgcgcttaaaccgtctgttcgaggaaagtggactcatcacagacttcacaaaaataagtatcaacctcaacccctaccaactacgcgtcaaaggcctaacagatgaactcagcaacgaggaactattcatagccctcaaaaacatggtcaagcaccggggcatctcctacctggacgacgcaagcgacgacggcaattcctccattggcgactatgcgcaaatcgtaaaagagaactcaaagcaactagaaaccaagacgccagggcagatacagctcgagcgctaccagacctacggccaactcagaggggacttcactgtagagaaagacggcaagaaacaccgcctgatcaacgtcttcccaacgtccgcataccgatcagaggcgctacgaatcctacaaacacagcaagagttcaacccccagataaccgacgagttcgtcaaccgctacctcgaaatcctcacaggaaaacgcaagtactaccacgggccaggaaacgagaaaagccgcaccgactacggccgttaccgtaccaacggagagacgctggataacatattcggtatacttataggcaaatgcaccttctaccccgacgaatttcgcgccgcaaaggcatcctacacggcccaggagttcaacctactcaacgacctaaacaacctcacagtacccaccgaaaccaagaagctatcaaaggaacagaaaaaccagataataaactacgtcaaaaacgaaaaagcaatgggcccagcaaaactatttaaatacatcgcgaaactactgtcgtgcgacgtagccgacataaaaggctatcgaatagacaaaagcggcaaagccgagatccacaccttcgaggcataccgaaaaatgaaaacactcgaaaccctcgacatagaacaaatggaccgcgagacactggacaagctcgcctacgtgctaaccctaaacaccgaacgcgagggcatccaagaagcattagaacacgagttcgcagacggctccttctctcagaagcaagtcgacgaactcgtccaattcagaaaagcaaacagcagcattttcggcaaggggtggcacaacttctccgtgaaactgatgatggaactcatccctgaactctacgaaacctcagaagaacaaatgaccatcctgaccagactcggcaaacagaaaacaaccagcagttcaaacaaaaccaaatatatcgacgaaaaacttctgaccgaagagatatacaacccggtagtcgcaaaaagcgtcagacaagcaatcaaaatagtcaacgccgcaatcaaagaatacggcgacttcgacaacatagtcatcgaaatggccagggagaccaacgaagacgacgaaaagaaagcgatccagaaaatacaaaaagcaaacaaagacgaaaaagacgcagccatgctaaaagcagccaaccaatacaacggaaaggcagagcttccccactcagtgttccacggtcacaagcaactcgcaaccaagatccgactctggcaccaacaaggcgaacgctgcctctacacaggaaaaaccatcagcatccacgacctaatcaacaacagcaaccaattcgaagtcgaccacatactgccactgtccataacctttgatgattcactagccaataaagttcttgtctacgcaaccgccaaccaagagaaagggcagagaacaccataccaggccctagatagcatggacgacgcatggagcttccgcgagctcaaggccttcgtccgagaatcaaagacgttaagcaacaaaaagaaagaatacctactgacagaagaggacatcagcaaattcgacgtgcgcaagaaattcatcgaacgcaacctagtagacacaaggtacgccagccgcgtcgtgctcaacgccctgcaggaacattttcgcgcacacaaaatcgacactaaagtttccgtagtacgcgggcagttcacaagccagctccgtcgtcactggggcatcgagaaaacccgcgacacctaccaccaccatgccgtagacgctctaataatagcagcctcatcacaactaaacttatggaagaaacagaaaaacaccctagtcagctacagtgaagaccaactactagacatcgaaaccggagaactcatctcagacgacgagtacaaagagttcgtattcaaagcaccataccaacacttcgttgacactttaaaaagcaaggagttcgaagacagcatacttttctcataccaggtagacagcaagttcaacagaaagataagcgacgcaacaatatacgccacgcgacaagcaaaggtggggaaggacaaagcggacgaaacctacgtacttggaaaaatcaaggacatctacacacaagacggctacgacgccttcatgaaaatctacaagaaagacaaaagcaaattcctaatgtaccggcacgaccctcaaaccttcgaaaaagtaatcgagccaatcttggaaaactaccccaacaaacagatgaacgaaaaaggcaaagaagtcccatgtaacccatttctaaaatataaagaggagcacggctacatccgaaagtacagcaagaaagggaacggccccgaaataaaatcgctgaagtattacgactcaaagctaggaaaccacatagatataacgcccaaagactcgaataacaaggtcgtcctacaatccgtgagcccttggcgcgcagacgtgtacttcaacaacacaactggtaaatacgagatacttggcctaaaatacgcggacctccaattcgaaaagggcaccgggacatacaaaatcagccaggaaaaatacaacgatataaagaagaaagaaggtgtcgactcagacagcgagttcaaattcacactctacaaaaacgacctcctccttgtcaaagaaactgaaacgaaagaacagcaactctttcggttcctcagcagaaccatgccgaaacaaaaacactacgtcgaattaaaaccatatgacaagcaaaaattcgaaggaggcgaggcactcatcaaagtcctcgggaacgtcgcaaacggcgggcagtgcatcaaaggactaggcaaatcaaacatcagcatatataaagtccggacagatgtattaggaaaccaacacattatcaaaaacgaaggcgacaaacctaaactagacttctga

SEQ ID NO: 6260 - RNA, 3366 nt, synthetic construct
  misc_feature 1..3366: note = Cas9 variant
  source 1..3366: mol_type = other RNA
atgaacgggctagtactaggactggacataggcatcgcatctgtaggggtcggcatactcgagaaaaactcaggcaaaataatacacgccaacagtaggctctttcccgccgcaacggccgataacaacgtcgaacgcaggaagaaccgacaagcccgcagactgaaccgacggaagaaacaccggggagtacggttccaagacctctttgaagactacggactccttacggacttctcgaaagtgagcataaacctaaacccataccgactaagagtcgatggcctcaacaaacagctgaccaacgaagaactcttcatcgcccttaaaaacatagtgaagcgcagaggcatttcgtacctcgacgacgctagcgaagacggcgggaccgtctcgtcagactacggcaaagccgtagaagagaataggaaacttctcgccgaacaaacccccggccagatccaactcgagagattcgagaagtacggccaactacgcggagacttcactgtcgtcgaaaacggtgaaaaatgtcgacttatcaacgtcttttcgacaagcgcatataagaaagaagcggaacgaatcctccgcaaacagcaagagttcaacagcaaaataacagatgagttcatcgaagactaccttaagatactaacaggaaagcgcaaatactaccacggaccaggaaacgaaaagtcacgcaccgattacggccggttccgcaaagacggcacgaccttagacaatatattcgggatcctaatcgggaaatgcacgttctacccaaatgaataccgcgccagcaaagcgtcctatacagcccaagagttcaatctgctaaacgacctcaataacctctccgtccccacagaaacgaagaaattatccgaagaacagaagaaaacgatcatcgaatacgcaaaatcagccaaaacgctgggagcaagcacgctactcaaatacatagccaaaatgatagacacctccgtggaccaaatccgcggataccgcgtagacgtgaacaacaaacccgaaatgcacactttcgaagtgtaccgcaaaatgcaatcactagaaaccatatccgtgggagaactctcccgcaacgtcctagatgagctcgcccacatactaacattaaacactgagcgcgaaggcatcgaggaagccatcaacactaagctaaaagacagcttcagccaggaccaggtactcgaacttgtccaattccgcaaaaacaacagctcgctgttctcaaaaggctggcacaacttctctctgaagctcatgatggaactcatccccgaactatacgagacaagtgaggaacaaatgacaattctgacgcgcctcggaaagcagaaaagcaaggagacgtcaaagcggagcaagtacatcgacgaaaaggaactcacggaggagatctacaatccggtagtcgcgaaatcagtgcggcaagcgatcaaaataatcaatgaagccactaaaaagtacggaatcttcgacaacatagtgatcgaaatggcacgagagaacgacgaagaagatgcaaagaaggactacatcaaacgccaaaaagccaaccaagacgagaaaaatgccgctatggaaaaagctgccttccaatacaacgggaagaaagaactgcccgacaacatattccacggacacaaagagctcgccaccaaaatccggctgtggcaccaacaaggcgaaaaatgcctatataccggtaagactatcccaataagcgatctgatacacaaccagtacaagtacgaaatagaccacgtcctccctctctccctctcattcgacgactcactctccaacaaagtactcgtacttgcaaccgcgaaccaagagaaaggccaacgcacccccttccaagccctcgactccatggacgacggctggagctaccgcgagttcaagagctatgtaaaagagagcaaactactcggcaacaagaagaaagagtacctcctaacggaagaagacatctcgaaaatagaggtcaaacaaaaatttatagagcgcaacctggtcgacaacagatacagctcccgcgtcgtcctgaacgccctccaggatttctacaaagcacacaagtttgacaccaccataagcgtagtaagaggccaattcaccagccaattgcgccgtaaatgggggctcgagaaaagccgagaaacataccaccaccacgccgttgacgcactcataatagccgcatcgagccagctccgcttgtggaaaaagcataacaatcccctaatatcatacaaggaaggccgcttcatcgacagcgaaactggggaaataatatcactctcagacgatgaatataaagagctggttttcaaggcaccctacgaccacttcgtcgacaccctacgctccaagacattcgaagacagcattctgttcagctaccaagtagatagcaaatataaccggaaaatcagcgacgctacaatatacgcaaccagaaaggcaaaactcgacaaagacaaaagcgaggaaacatacgtactggggaaaataaaagatatctatagccaagccggctacgacgccttcattaaaatctacaacaaggacaaaagcaagttcctgatgtaccacaaagacccccaaacattcgaaaaagtcatcgaggagatcctccgtacataccccagcaaggaactaaacgacaaaaacaaagagatcccttgcaacccattcgaaaaataccgccaggaaaacggccccatccgcaaatacagcaaaaagggaaacggaccagaaataaaatccatgaaatactacgacaaaaacatcccagagagcttcataaatataacccctagtaacagcaacaacaaggtattgttacggcaactctacccatggcggacggacgtgtacttcaacccccagacagacaaatacgaactgctcgggctcaagtacgcagacctccaattcgaaaaagccactggcaaatattcaataacaatcgacaaatacaacgaaataaaagaaaaagaaggcgtctcgaaagaatccgagttcaagttcacactatacaagaacgacttactcctgataaaggacaccaaaaacaacgaagaacagattttccgtttcttgtctcgcacgatgccgaaccaaaatcactacgtagaacttaaaccctacgacaaagggaacttcgagggaaaggagaaaattaaagtcttcaagatgacctcaaacgggcgctgtataaaaggcctaggcaagaaatacctatccatctacaaagtcaaaaccgacatactcggcaacaaacacttcattaagaaagaaggcgacgaacccaaattaaaattctga

SEQ ID NO: 6261 - RNA, 3366 nt, synthetic construct
  misc_feature 1..3366: note = Cas9 variant
  source 1..3366: mol_type = other RNA
atgaacggcctagtcctgggactcgacatagggattgcaagcgtcggagtcggcatcctagagaaaaactcgggaaaaattatacatgccaactcccgactcttcccagctgccacggcggacaacaacgtcgaacggcgcaaaaacagacaagcacgcagactcaaccgtcgcaagaaacaccgaggagttcgcttccaagaccttttcgaagactacggcctactaaccgacttctcaaaagtaagcatcaacctcaacccctaccgcctccgggttgacggactaaaccagcaactaaccaacgaagaactattcatagcactcaagaatatcgtcaagcgacgaggaatctcctacctcgacgacgcaagcgaagacggaggagccgtctcctcagactacggaaaagcagtggaggaaaatcgaaaactcttggccgagcaaacccccggccagatccaactcgaaagattcgagaaatacggacaagtccgaggagactttacagtcgtagagaacggggagaaacgacgactaatcaacgtattcagcacctccgcctaccgcaaagaagccgagaaaattctccgcaaacagcaggagttcaacaaccaaatcaccgacgagttcatcgaagattaccttaagatacttacgggcaaacgcaaatactaccacgggccgggaaacgaaaaatcccgcacggattacggccgcttccgcaccgacggaaccaccctcgacaatatattcggagtactcatcggaaaatgtaccttctaccccaacgaataccgcgcatccaaaagcagctacactgcacaagagttcaaccttctcaacgacctaaacaacctcactgtgcccactgaaaccaagaaactaagcgaagaacaaaagaaagttatcgtggaatacgcaaaagaagccaaaaccctcggggcaagcacgctcctaaaatacatcgtaaaaatgatcgacgcctctgttgatcaaatctccggatacagggtcgacgtaaacaacaaaccagaaatgcacaccttcgaagtctacagaaagatgcaatcacttgagaccatatcagtcggggagctaagccggaacgtcctggacgaactggcccacatactcacgctaaacactgaacgagaaggaatcgaagaagccataaactccaaacttatgggcgtattcagccaagaccaagtcttagaactcgtccaattccgaaagaacaacagcagcctattctccaaaggctggcacaacttcagcctcaaactcatgatggaactcatacccgagttatacgagactagcgaagaacagatgaccatacttacacggctaggcaagcagaagtccaaagagacatcgaaacgaactaaatacatagacgaaaaagaactcacagaagaaatatacaacccagtagtcgcaaaatcggtccgccaggcaattaaaataataaacgaagccaccaagaaacacgggatattcgacaacatcgtaatcgagatggcacgcgaaaacaacgaagaagatgcgaagaaagactacatcaaaagacaaaaagcaaaccaggatgagaaaaacgccgcaatggaaaaagcagcattccaatacaacggaaagaaagaattacccggcaacatattcaacggccataaagaactggccacaaaaatcagactctggcaccagcaaggagagaaatgcctgtacactggaaaaacaataccaataagcgacctcatacataaccaatacaaatacgagatcgatcacatcctacctctatcactctcgttcgacgacagcctaagcaataaagtcctcgtccacgcgacagcaaaccaagaaaaaggccagcgaacacccttccaagccctcgactctatggacgacgcctggtcgtaccgtgagttcaaaagctacgtaaaggatttaaaatccctgtcaaataagaaaaaggactacctcctcaccgaagaagacatctcaaaaatagaagtaaaacaaaaatttatagagagaaacctggtggacacgcgctacagcagtcgtgtcgtactcaatgccctacaagacttctataagtcccaccagttcgacactacgatctccgtagtcaggggccagttcaccagccaactacgccgtaaatggggcctcgaaaagagtcgagaaacctatcaccaccacgccgtggacgcactaataatcgcggcgagcagccagcttaggctatggaagaaacaaaacaatccactgataacctacaaagaaggacagtttatcgactcgcaaaccggagaaatcatcagcctaaccgacgacgaatacaaagagctagtattcaaagctccgtacgaccacttcgttgacaccctgcactcaaagacgttcgaagacggcatcttattcagctaccaggtcgacagcaagtacaaccggaaaatctcggacgcaacaatatacgcgaccagaaaagcaaagttagacaaagataaatcagaagaaacatacgtcctcggcaagattaaagacatttactctcaggccgggtacgacgccttcataaaaatttacaacaaagacaaacgcaaattcctaatgtaccacaaagaccctcaaacattcgaaaaagtcatcgaagagatactccgaacctacccaagcaaagagcgcaacgacaaaaacaaggaagtaccatgtaacccattcgaaaaataccgacaagaaaacgggccaatacggaaatactccaagaaaggaaacggcccagaaataaaatgcctgaaatactacgacaacaaactcggaaactacatcgacatcagcccagacggttccgacaaccaagttgtactacaatcactcaaaccctggcgcaccgacgtgtacttcaaccaccagaccaagaagtatgagctaatgggtcttaagtacagcgacctgtcattcgaaaaaggcagcggtaaatacagcatctcaaacgaaaagtacaactcaatcaaacgcatcgaaggagttaacgaacaatccgaatttaaattcaccctatacaagaatgacctcatcttaatcaaggactcagagaacaacgaacaaaaactgttccgattcaactccagaaacgacactgccaagcattacgtcgaacttaaaccatacgacaaggcccgcttcgacgggcagcaagagctgatcacaattcttggaaacgtcgcaaaaggtgggcagtgcctcaagggcctaaacaaatccaacatatcaatattcaaggtaaagaccgatgtcctcggaaagaaacatatcatcaagaaagaaggtgacgaacccaaacttaaattctga

SEQ ID NO: 6262 - RNA, 3366 nt, synthetic construct
  misc_feature 1..3366: note = Cas9 variant
  source 1..3366: mol_type = other RNA
atgtccgatctcgtactgggcttagacatcggcatcggatcggtaggagtcggaatcttaaataaagtaaccggcgagataatccacaaaaacagccggatcttccccgccgcacaagctgaaaacaacctcgtccgccgcaccaaccggcaaggacgccgcctcacccgccgcaagaaacaccgcatcgtacgactcaatcgcctcttcgaagagtcaggcctgatcacagacttcaccaagatttccataaatctcaacccctaccaattacgggtcaaaggccttacggacgaattatccaacgaagaactcttcatcgccctgaaaaacatggtcaagcaccgcggtatctcgtacctagatgacgccagtgacgacgggaatagtagcgtaggcgactacgcgcaaatcgtcaaagaaaacagcaagcaactagaaacgaaaacccccgggcaaatacagttagaacgctaccaaacgtacggccaacttcgcggggacttcaccgtagagaaagacgggaaaaagcaccgactaatcaacgtgttcccaacctccgcctaccgatcagaagccttacgaatcctcaaaacccaacaagagttcaacccccaaatcacagacgagttcatcaaccggtacctcgaaatactcaccggaaaacggaaatactaccacggcccaggcaatgagaaaagccggacggactacggacgataccgcacgaacggcgaaaccctcgacaacatatttggaatcctcataggcaagtgtacattctacccggaagaatttcgagctgcaaaagccagttacaccgcccaagagttcaaccttctcaacgacctcaacaacttaacagtaccgacagaaaccaagaaactgagcaaagaacagaaaaaccaaataataaattacgtcaagaacgaaaaagcaatgggccccgccaaacttttcaaatacatcgccaagctgctcagctgcgacgtagcggacataaaaggatacaggatcgataaaagcggcaaggccgaaatccacaccttcgaggcctaccgcaaaatgaagaccttggaaacactcgacatagagcaaatggaccgcgaaactctcgacaaacttgcatatgtgctaacactgaacacagaacgagagggcatccaagaagcgctagaacacgagttcgctgacggcagcttctctcagaaacaggtggacgaactggtccaattcagaaaggccaatagcagtatattcggaaaaggctggcacaacttcagcgtcaaactgatgatggaactgatcccagaactctacgaaacatcagaagaacaaatgacaatcctcacacggctaggaaaacagaaaacaacaagctccagcaacaaaactaaatacatcgacgaaaaactgctaaccgaagaaatatacaatccagtcgtcgccaaaagtgtgagacaagccataaagatcgtaaacgcagccatcaaggaatacggcgacttcgataacattgtaattgaaatggcccgagaaaccaacgaagacgacgaaaagaaagcaatccaaaagatccaaaaagcaaacaaagatgaaaaagacgcagcaatgctaaaggcagccaaccaatacaacggcaaagccgagttgccccactcagtcttccacggccacaagcaactcgccaccaaaatacgactgtggcaccaacaaggcgaacgctgtctatataccggtaagacgatcagcatccacgatctcatcaacaaccctaatcagttcgaggtcgaccacatccttccactaagcataaccttcgacgattcgctggccaacaaagtgctggtctacgcgacggccaatcaagagaagggacagcgtacgccataccaagcactcgactcaatggacgacgcctggtccttccgcgagctcaaagccttcgtcagagaaagcaaaaccctcagcaataaaaagaaggagtacctactcaccgaggaggatatctctaaattcgacgtgcaaaagaaattcatcgaacgcaacctagtcgatacccgctacgcaagcagagtggtcctaaatgccctacaggaacattttcgagcacacaaaatcgacacgaaagtaagcgtagtccgcggccaattcacatcacagctgagacgccactggggaatagagaaaacaagagacacataccaccaccacgcagtcgacgcactcatcatagcagccagctcccagcttaacctctggaagaaacagaaaaacaccctagtcagctactccgaagaccaactactcgatattgaaacaggcgaactcatctcagatgacgaatacaaagaaagcgtattcaaagctccctaccaacactttgtggacacactaaagtccaaagagttcgaggactcaatactcttcagctaccaagtcgacagcaagttcaaccggaagatatcagacgccaccatctacgcgaccagacaagcaaaagtcggtaaggacaagaaagacgaaacctacgtcctaggaaagatcaaagacatatacacgcaagacggatacgacgcatttatgaagatctacaagaaagacaaaagcaagttcctcatgtaccgccacgacccccaaacattcgaaaaagtaatagaaccaatcctagagaactaccccaataaagaaatgaacgagaaaggaaaagaagtaccatgtaaccctttcctaaaatacaaagaagaacacggctacatccgcaaatactccaagaaaggaaacggccccgaaataaaatccctaaaatattacgactcaaagctgggcaaccacatcgacatcacgcccaaaaattctaataacaaggtcgtcttgcaaagtgtctccccctggcgggcagacgtatacttcaacaaaaccacgggcaaatacgaaatacttggcctaaagtatgccgacttgcaattcgaaaagggcacaggaacctacaaaatctcccaagaaaagtacaacgacataaagaagaaagaaggcgtcgactcagacagcgaatttaagttcaccctctacaaaaacgacctacttctagtcaaagacaccgaaaccaaggaacaacaactattccggttccttagccgaacaatgccaaagaagaaacactacgtagaacttaagccatatgacaaacaaaaattcgaaggaggcgaggcgctcatcaaggtcctgggaaacgtcgcaaacagcggacaatgcatcaaaggcctcgcgaagtccaacatctccatatacaaagtaaggaccgacgtactcggcaaccagcacatcatcaagaacgaaggcgacaaacccaaactagacttttga

SEQ ID NO: 6263 - RNA, 3366 nt, synthetic construct
  misc_feature 1..3366: note = Cas9 variant
  source 1..3366: mol_type = other RNA
atgagcgacctggtacttggcctagacataggcatcggcagcgtcggcgtcggcatacttaataaagtcacgggagaaataatacacaaaaattcgcgaatattcccagcagcccaagcagaaaacaacctcgtgagacgaaccaaccgtcaggggcgacgcctgacaagacgcaaaaagcacagaagagtccgcctaaaccgcctatttgaagaatccggcctcataacagacttcaccaagatctccataaacctcaacccctatcaactaagagtaaaaggacttacagacgaactctccaacgaggagttgttcatcgctcttaaaaacatggtgaaacaccgaggcatctcatacctcgacgacgccagcgacgacgggaactcaagcataggagactacgcgcaaatcgtcaaagagaactccaaacaactcgaaaccaaaacacccggccagatccagctcgaacgctaccagacctacggtcaactacgcggagacttcacggtcgaaaaagacggcaagaaacaccgactaatcaacgtgttccccaccagcgcgtacaggtcagaagccctccgcatcctccaaacccagcaggaatttaacccccagatcacagacgagttcatcaaccgctacctagaaatccttacaggtaaaagaaaatactaccacggccccgggaacgaaaaatcgcgaaccgactacggccgataccggacctctggtgaaaccctggacaacatattcggcatactaatcggaaaatgcacattctaccccgacgagttccgcgccgcaaaagcatcctacacagcacaagagttcaaccttctgaacgacctcaacaacctgaccgtgcccacagaaacaaagaaattatcaaaagaacagaaaaaccagatcatcaactacgttaaaaacgaaaaagccatgggacccgcaaaacttttcaagtacatcgcgaaacttctgtcatgcgacgtcgcagacataaaagggtatagaatagataagagcggaaaagcggaaatccacaccttcgaagcctaccgcaaaatgaaaaccctagagacactcgacatagaacagatggatcgagaaaccctcgacaaacttgcctacgtactcacgctgaacacagagcgggaggggattcaggaagccctcgaacacgagttcgcagacggcagcttcagccaaaagcaggtcgatgaactcgtgcaattccgaaaagccaacagtagcatcttcgggaagggctggcacaacttcagcgtaaaactcatgatggaactaatccccgaactatacgagaccagcgaagaacaaatgacgatcctcactagactaggcaagcagaaaaccacttccagtagcaacaaaacaaaatacatcgacgaaaagctactcacagaggagatatacaacccggtcgtcgccaaaagtgtccgccaagcgataaaaatagtaaacgcggcaattaaagaatacggcgactttgacaacattgtcatcgaaatggcccgagagaccaacgaagatgacgaaaagaaggccatacagaaaatccaaaaagcgaacaaagacgagaaggacgcagccatgctcaaagccgccaaccaatacaacggcaaagcagaactgccgcattccgtcttccacgggcacaagcaattagcgaccaaaataaggctatggcaccaacaaggagaaagatgcctatacactggaaagaccataagtatacacgacctgatcaacaacagcaaccaattcgaagtcgaccatatcctccctctcagcataaccttcgacgatagtctagccaataaagtactcgtctacgccaccgctaaccaagaaaagggccaacgcactccctaccaggccctggacagtatggacgacgcctggagcttccgggagctaaaagcattcgtccgcgaatccaaaaccttatccaacaaaaagaaagagtacctgctcaccgaagaggacatatccaaatttgacgtacgcaagaaattcatcgaacgaaaccttgtcgacaccaggtatgcgagccgagtcgtcctgaacgcgctacaagaacacttccgcgcacacaaaatagacaccaaagtttcggtcgtccgaggccaattcacatcccaactacgccgacactggggaattgagaaaaccagagacacataccaccaccacgccgtcgatgccctgataatcgcagcctctagtcaactcaacctgtggaagaaacagaaaaacacgctcgtcagctactcagaagaccagctcctcgacattgaaacgggcgaactaatatcggacgatgaatacaaagaatccgtattcaaagccccataccagcacttcgtcgacacactgaaaagcaaggagttcgaagacagtatcctattttcctaccaggtggactccaaattcaacagaaaaatttccgacgccaccatctatgcgaccagacaagccaaggtcggcaaagacaaagccgatgaaacctacgtactaggcaaaataaaagacatatacacacaagatggatacgacgcgttcatgaaaatatacaagaaagacaaaagcaaattcctcatgtacagacacgacccccaaaccttcgaaaaggtgatcgaacccatcctcgaaaactacccaaacaaacagatcaatgaaaaaggaaaagaagtaccctgcaacccgttcctaaagtacaaggaagaacacgggtacatccgcaaatacagcaaaaagggcaacggaccagaaatcaaatccctaaagtactatgacagcaaactcggaaaccacatagacatcacacccaaagacagtaataacaaagtcgttctgcaatccgtatcgccatggcgagcagacgtttattttaacaagaccacaggtaagtacgagatactaggactaaagtacgccgacctacaattcgaaaagggcacagggacatacaaaatctcccaagaaaagtacaacgacatcaagaagaaagagggcgtcgactcagacagcgagttcaaattcaccctgtacaagaacgatcttctcctagtgaaggacacagaaaccaaagaacaacaactattccgatttctatcccggacaatgcctaaacaaaagcattacgtagaactaaaaccttacgacaagcagaaattcgaaggcggagaagccctaatcaaagtactcgggaacgtagcaaactccggacaatgcaagaaagggctcggcaaaagcaatataagtatctataaggtcagaaccgacgtcctaggaaaccaacacatcatcaaaaacgaaggggacaaacccaaacttgacttctga

SEQ ID NO: 6264 - RNA, 3366 nt, synthetic construct
  misc_feature 1..3366: note = Cas9 variant
  source 1..3366: mol_type = other RNA
atgtccgacctcgtactcggcctcgacataggaattgggtcggtaggagtgggcatcctcaacaaggtaacgggggaaataatccacaaaaacagcagaatattccccgccgcccaggcagaaaacaatctggtacgccgcacaaaccgccaaggccgcagacttaccagacgcaagaaacaccgcagagtccgcctcaacagactcttcgaagaaagcggcctcatcacagacttcaccaaaatctcaatcaacctgaatccataccagcttagagtcaaaggcctaactgacgaattgtccaacgaggaattatttatagccttaaagaacatggtcaaacaccggggcatatcctacctagacgacgcatccgacgacggaaactccagcgtcggagactacgcccaaattgtcaaagaaaacagcaagcagctcgagacaaagaccccagggcagatccaactggaacgttaccaaacctacggccagctccgaggagatttcacagtcgaaaaagacggaaagaaacacagactcattaacgtcttccccacaagcgcctaccgctcggaagccttgagaatcctacaaacacaacaggagttcaacccgcagatcaccgacgagttcgtgaaccgctacctagaaatactgacgggcaaaagaaaatactaccacggccccggaaacgaaaagagcagaacagattacggccgttaccgaacaaacggcgaaaccctagacaacattttcggaatcctcatcggaaaatgcaccttctaccccgaagagttccgcgccgccaaagcgtcatacaccgcacaagagttcaacctcctaaacgacctaaataacctaaccgtccccacagaaaccaaaaagctcagcaaagaacagaaaaatcaaatcatcaactacgtcaaaaatgaaaaggccatgggcccagccaagctattcaagtacatagcaaaactcctaagctgcgacgtagcagacatcaagggctatcgcatcgacaaatcaggcaaagccgaaatccacacattcgaagcctaccgcaagatgaaaacactagaaactttggacatcgaacaaatggaccgagaaaccctcgacaagctcgcctacgtcctgacgctaaacaccgagcgagaaggcatccaagaggcgctagagcacgagttcgcagacggatctttctctcaaaaacaggtagacgaacttgtacaattccgcaaggcgaacagctccatctttgggaaaggctggcacaacttttccgtcaaactgatgatggaactcatccccgagctgtacgaaacgtccgaagaacaaatgaccatactcaaacggctaggcaaacaaaagacaacatcatcctccaacaaaacgaagtacatagacgagaaactcctcaccgaggaaatctacaacccagtggtcgcgaaaagcatcagacaagcaatcaagatcgtcaacgcggctataaaggaatacggcgacttcgataatatcgtcatagagatggcccgcgaaaccaacgaagacgacgaaaagaaagcaatccagaaaatacagaaagcgaacaaagacgaaaaagacgccgcaatgctaaaggccgcaaatcaatacaacggaaaggcagaactcccgcacagcgttttccacggccataagcaactagccacaaaaattcgcctatggcaccaacaaggggaacgctgcttgtacaccggcaagaccatctccatacacgacctgataaacaaccctaaccagttcgaagtggaccacatcctccccctaagtataacattcgacgattccttggccaacaaggtcctagtatacgctacggccaaccaagagaaagggcaacgtacaccataccaggcactggactcaatggacgatgcgtggagcttccgcgagctaaaagcgttcgtccgtgagtcgaaaactctcagcaataagaagaaagaatacctgctaacagaagaggacatcagtaaattcgacgtcaggaagaaattcatcgaacgaaacctagtcgacacgcgctacgccagccgggtagtactgaacgcacttcaggaacatttccgcgcacacaaaatcgacacaaaagtgagcgtcgtgagaggacaattcacatcacaactacgccgacattggggcatcgagaagactagagatacataccatcaccacgccgtggacgcattaatcatagcagccagctcccagctaaacctctggaagaaacagaaaaacaccctagtaagctacagcgaagaccagctcctggatatagaaacgggcgagctcatttcagacgacgagtacaaagaatccgtcttcaaagccccataccaacactttgtcgacacgctaaaatcgaaggagttcgaagacagcatcctattttcctatcaggtcgactcgaaatttaaccgaaaaataagtgacgcaaccatatacgcaacacgacaagcaaaagtcggcaaagacaagaaagacgaaacgtacgtacttggcaaaatcaaagatatatacacgcaagacggctacgacgcgttcatgaagatctataaaaaggacaagtccaagttcctcatgtacaggcacgacccccaaaccttcgagaaagtaatagaacctatcctcgaaaactatcctaacaaggagatgaacgagaagggcaaagaggtcccctgcaaccccttcctaaaatacaaggaagaacacggatacatccgaaaatactctaagaaaggtaatgaccccgagatcaaatcactcaaatactacgactcaaagctggggaaccacatagacataacgcccaaagactccaataacaaagtagtcctacaatcagtcagcccatggagagccgacgtctacttcaacaaaaccaccggcaagtacgaaatattaggactaaaatacgcagacctccaattcgagaagggcacaggcacctacaagatcagtcaagaaaagtataacgatatcaaaaagaaagaaggggtcgattcagacagcgagttcaaattcaccctctacaaaaacgacctgctcctcgtcaaagacacagaaaccaaagaacagcaactcttccgcttcctcagcagaaccatgcccaaacaaaagcactacgtagaactaaagccctacgataaacaaaaattcgaaggcggcgaagccttgataaaagtactaggaaacgtcgccaacagcggccagtgcaagaaagggttaggaaaaagcaacattagcatatacaaagtacgcacagacgtcctaggaaaccagcacatcatcaaaaacgaaggagacaaacccaagttggacttctga

SEQ ID NO: 6265 - RNA, 3366 nt, synthetic construct
  misc_feature 1..3366: note = Cas9 variant
  source 1..3366: mol_type = other RNA
atgaacggcctagtcctgggcttagatataggaatagcctcagtcggagtcggcatcctagagaaaaacagcggcaaaataatacacgcaaactcacgactattcccagcggcaacagccgacaacaacgtcgaacgacggaagaaccgacaagcaaggagactacaccgccggaagaaacacaggggcgtccgcttccaagacctattcgaagactacggcctccttacagacttctcgaaagtcagcataaacctgaatccataccggctccgcgtagacgggctcaaccaacaactcacaaatgaggaactattcatagccctgaaaaacatagtcaaacggcgcgggatcagttacctggacgacgcaagcgaagacggcggaacagtaagcagtgactacgggaaagctgtcgaagagaaccgcaagctcctcgcggaacagacccccggccagatccaactcgagagattcgaaaagtatgggcaggttcgaggggatttcaccgtcgtcgagaacggagaaaagcggcggctaataaacgtattctcaacctcagcctacagaaaagaggccgaacgcatcctccgaaaacaacaggagttcaactccaaaatcacggacgagttcatagaagattgcctcaaaatcctaacaggcaaaagaaaatactaccacggaccaggcaacgagaaaagcagaactgactacggtcgattccgaacagacggaacgaccctagacaacatattcggcatcctcataggaaaatgcactttctatcccgacgaataccgggcatcaaaagccagctacaccgcccaagagttcaacctcctcaatgacctaaacaacctgacggtacccaccgaaacaaagaagctatccgaagaacagaagaaagtcatagtggaatacgccaaagaagccaaaaccctaggagcatccaccctactcaaatacatcgccaaaatgatcgatgcaagtgtcgaccaaatacgtggctaccgtgtcgacgtaaacaataaaccggaaatacacaccttcgaagcataccgcaaaatgcaatcactcgaaaccatttcagtaggggaactgtcacgcaacgtactggacgaactggcgcacattctaacattaaataccgaacgcgagggcatcgaggaagccataaacacaaaactcaaagactcattcagccaggaccaagtcctcgaactggtccagttccgcaaaaataactcttccctcttctccaagggttggcacaatttctcactgaaactcatgatggagctcatcccagagctatacgagacctctgaggaacagatgacgatcctaacccgtctcgggaagcaaaaatccaaagaaatcagtaaacggaccaaatacatagacgaaaaggagcttacagaagaaatctacaaccccgtcgtcgcaaaaagcgtccgacaagcaataaaaataatcaacgaggcaacgaagaagcatggaatttttgacaacattgtaatagagatggcccgagagaacaacgaagaagacgccaagaaggactacatcaagcgacaaaaggcgaaccaggacgagaaaaacgcggccatggaaaaagcagcgttccagtataacggcaaaaaggaactaccagactcaatcttccacgggcaaaaagaactcgcaacaaaaatcaggctctggcaccaacagggcgagaaatgcctctacacgggcaaaaacatacccatatccgacctaatccataaccaatacaagtacgaaatcgatcacatactcccgctcagcctttccttcgatgactccctctccaacaaagtcctggtcctagccacggcgaaccaggaaaagggacaacgaacccccttccaggccctagactctatggacgacgcgtggtcataccgagaatttaaatcctacgttaaagaatccaaactgctaggcaacaaaaagaaagaatacctcctaaccgaagaggacatctcgaaaatagaggtcaaacagaaattcatcgagcgcaacctcatcgacacacgctactcgagccgtgtcgtcctaaacgcccttcaggatttctacaaagcccacaaattcgacaccactatctcggtagtccgaggccaattcacgtcccaacttcgccgcaaatgggggctcgagaaaagccgcgaaacgtatcaccaccacgccgtcgacgcactcatcatcgcggccagctcgcaactgcggctgtggaagaaacaaaacaacccactcattgcctacaaagagggccaattcgtcgactcggaaacaggcgagatcataagcctgagcgacgacgagtacaaagaactggtcttcaaagcaccctacgatcacttcgtagacacactgagctctaaaaccttcgaggacagcatactattctcctaccaggtagacagcaaattcaatcgaaaaataagcgacgccacaatatacgcaacacgcaaagcaaaactagacaaagagaaatctgaagaaacctacgtcctaggcaaaatcaaagacatctactcccaggccgggtacgacgcattcatcaaaatatacaacaaagacaagtcaaaattcctaatgtaccacaaagacccccaaaccttcgagaaggtgatcgaggaaattctacgcacctacccgagtaaggaactaaatgacaaaaacaaagaaatcccatgcaatccattcgaaaaataccgccaagaaaacggacccattcggaaatactcaaagaaaagcaacggacctgaaatcaaatcactcaaatactacgataacaaactaggaaaccacattgacatcacgccagagtcttccgataaccaagtagtactccagtcgctcaaaccctggaggacagatgtatacttcaaccaccagacgaagaaatacgaacttatgggcctaaaatactccgacctatcatttgagaagggctccggcaaatactccatcagcaaccagaaatacaattcaatcaagagaatagaggggatcgatgagcagtccgagttcaaattcaccctctacaaaaatgacctcatactaatcaaggactccgaaaacaacgaacaaaaactcttcagattcaattccagaaacgacacagccaaacactacatagagttaaaaccatacgataaagccaaattcgacggagaacaagaactaataactatactcggcaacgtagcaaaaggaggacgttgcttgaaaggactcaacaagagcaatataagcatcttcaaggtcaaaaccgacgtactcggcaagaaacatatcatcaagaaagaaggcgacgaacccaaacttaaattctga

SEQ ID NO: 6266 - RNA, 3366 nt, synthetic construct
  misc_feature 1..3366: note = Cas9 variant
  source 1..3366: mol_type = other RNA
atgaacggtctcgtcctcggcctcgacatcggcattgcttccgtaggagtcggcatcttaaacaaagacaccggagagataatccacaccaacagccgcatcttccccgccgcaacggccgacaacaacgtcgaacgccggaactcacggcaagaccgaagactcaatcggcgcaagaaacaccgaggagtcagacttcacgacctgttcgaggactacgacctcctcacagatttttccaaagtcagcataaatctaaacccgtaccgactaagagtacaaggcctggacaacagcttaaccacagaggaactattcatcgccctcaaaaacatcgtcaaacgtcgcggaatttcttacctagacgacgcctccgaagacggaggtgtagtatcctccgactacggcaaagccgtcgaagaaaaccgcaaactcctagccgagcaaaccccaggccaaatccagctcgaacgcttcaagaaatacggccaagtccgaggcgacttcacagtcgtcgagaacggcgaaaaacgcagacttatcaacgtattctcgacatcggcataccgaaaagaggcagagcggatactacgcaaacagcaagagttcaataatcagatcacagacaaattcatagaagactacctcaaaatactcacggaaaaacgcaaatactatcatgggccaggcaacgagaaaagcaggaccgactacggacggttccgcaccgacggcaccacgctggacaacatcttcggcatcttaatcggcaagtgtaccttctatccaaacgaataccgagcctcaaaggcgtcatacacagcccaagagttcaacctgctcaacgacctgaataacctcaccgtccccacggaaacaaagaagctatccgaagaacagaagaaaaccatagtagaatacgccaagagcgccaaaacactcggagcgagcacactcctaaaatacatagccaaaatgatcgacgcatcggtggaccagatccgcgggtacagggtcgacgtaaacaacaaaccagagatgcacacgttcgaagtctaccggaagatgcaatcactagagaccatatccgtatgggaactatcaagaaacatcttggacgagctagcacacatcctcaccctaaataccgaacgcgagggcatcgaagaagccatcaacaccaaactcatggacgtcttttcccaggaccaggtcctcgagctagtccaattccgtaagaacaacagctccctcttctcaaaaggctggcacaacttctcccgaaagttaatgatggaactaatcccagaactctacgagacctccgaggaacaaatgaccatcctcacccgattgggcaaacagaaaagcaaagaaacctcaaaacgtaccaagtacatagacgaaaaagaagtgactgaggaaatctataacccagttgtagcaaagtcggtccgccaagccatcaaaatcatcaacgaagcaacaaagaaatacgggatcttcgacaatatcgtcatcgaaatggcgcgagaaaacaacgaagaagacgccaagaaagattacatcaaacggcaaaaagccaaccaagacgagaaaaacgtcgccatagaaaaagcagcattccaatataacgggaagaaagaactgcctgactcaatatttcacggacacaaagaactcgccaccaaaatacgactctggcaccaacagggcgaaaaatgcctctacacggggaaaaacatacccatctcagacctaatacacaaccaatacaaatatgaaatcgaccacatactcccactatcccttagcttcgacgacagcctatccaacaaagtcctagtcctcgcgacagcaaaccaggaaaaaggacaacgcacccccttccaagcgctcgactccatggacgacgcgtggtcatatcgcgagttcaaaagctacgtcaaagacagcaaattactcggaaacaaaaagaaagactacctcctcaccgaagaagacatatcgaaaatagaagttaaacaaaaattcatcgagcgcaacctagttgacactcgctactcaagccgcgtcgtcctaaacaccctacaagacttctacaaagcacacaagttcgacaccaccatttccgtcgtccgaggacaattcaccagccaactccggcgaaaatggggattggagaaatcacgagaaacataccaccaccacgcagtggatgcgctcatcatcgccgcctcctcccagctgcgactatggaagaaacaagccaaccccctaataagctacaaagaagatcaattcgtagacagcgaaactggagaaataatatcgctaacagacgacaaatacaaagaacttgtattcaaggccccatacgcccacttcgtggacacgctgtccagcaaaaagttcgaagattcaatcctcttcagctaccaagtcgactccaaatacaaccgaaaaatctcggacgccaccatatatgcaaccagaaaggtgaaactcgacaaggacaagtctgaagaaacgtacgtactcggcaaaatcaaagacatctacagccaagccggctacgacgcctttatcaaaatatacaacaaagacaaaagcaaattcctcatgtaccacaaagacccacaaacctttgagaaagtcatcgaggagatcctacgtatctaccctagtaaagagttcaacgaaaagaacaaagaagtcccgtgcaacccgttcgaaaagtatcgccaagaaaacggccccatatgcaaatattcaaagaaaggcaacggacccgaaatcaagtcactcaagtactacgacaagaacatcccagagtcattcatagatataaccccaagcaactccaagaacaaagtaatcctgaggcagctcaacccatggaggacagatgtatacttcaaccaccaaacagaaaaatacgagcttctaggcctaaagtacgcggacctccaattcgaaaagaaaacggagacttactccattacaatcgacaaatacaacgaaatcaaagagaaagagggagtcggcgaacactccgagttcaaattcaccctctataaaaacgaccttcttctcatcaaggacatggaaatcaaagaagaacagatcttccgattccttagccgcaccatgccaaacaagaaacactacgtcgaactgaaaccgtattacaaaggaaacttcgaaggcaaagaaagaatcaaagttttcaacacaacctccaacggaaggtgcctgaaaggcctcggaaagaaaggcctctccatctacaaaataaaaacagacgttctgggcaacaaacacttcatcaagaaagaaggagagaaacccaaactcaagttctga

SEQ ID NO: 6267 - RNA, 3366 nt, synthetic construct
  misc_feature 1..3366: note = Cas9 variant
  source 1..3366: mol_type = other RNA
atggaccggaccgaagtcaacataggcttcgacatcggaatcagctcggtaggctggtcagtcgtagcaacgaaatcagggcgcatcctcgaatcaggggtctcgctattctccggagcatccgctgccaaaaatgaggaaagaagaaacttcagacaaagccgccggctactgagacgccgcaaaaacaggatctccgacctcaagaagtacctaaaggaacaaagtttcacctacaacggagaactgcttaacgagaacccctacgagatacgggtaaaaggactaactgagaaactctcaaaagaagagatagccctagcactcctccacatcgtgaagagacgaggagtctcgtatgacttaggcgacatagaagaagaaggcacaacaggatcctacaaagaaggggtcaagaaaaatcaaaaactactaaaggagaaaacgccagcggaaatccaatttcaacggctaaagaagttccacaaggtccgtggccagatcgccatagatgagaacgacgtcctcctgaacgtctttcccaaccacgcatacgtcgacgaagcacagcagatactttatacccaacaagagttctaccctgaaatcaacgaaactttcatcaaccaagtcacagacttcatatcccgaaaacgagactacttcatcggcccggggtcggagaagtccagaacagactacggaatctaccgaacagacggaacgacactacaaaacctgttctcgatcctaataggcaaggacaaaatatttcccgatgagttccgcgcggcaggcaactcctacacagcgcaagtatacaacctcctcaacgacctcaacaacctggcaatcgacgacacagaaaccggcaaactgacaaagcagcaaaaagagaaaatcataatggaactgaaaacgaccgagaaaagcgtaaatatgatgaagctcatagccaaaacggcgggcgtcaccgtggaacaaatctcccgctaccgaataaatcgagacggcaaaagtgaaatacacaacatggccgtctaccgaaagatacgcaaagtcttcctcgaactaggctacgaaatcaacgaatggccctcacagctgcttgatgaactaggggacgccctatccctcaacacagaaaacggagaaattagaaggatcctcacagataacctcgcaaacaagtacaaaatcctcgaccagcagctcatcaacctgatcatcgaaaataagaacgcattcacactatcgaccaaccaaaaatggcaccgctttagctacaaaaccatgaaaatcctaatcccggaactcctcgaaaccaacaaagaacaaatgaccatcctaacggagatgggtctcatgaagaaagatcaacgcaactacgtaggcaaaaataaaatagacagcgaagccctcctagaaaacctatacaacccggtcgtccgcaagagcacacgccaaactatgaaactcttcaacacactactcaaaaagtaccccaacatagcatatgtagtcatagagatgcccagagaagacgacgaagacaaggcccgccgcgactacgtgaagttccaaaaagacaacgagaaggagaaagacgcagcactcaaaaacttcatcatggagtcaggaaaatccgaagccgaagtgatagccaaataccgacagagcaagaaattcagatcgaaagtacggctctggtaccaacagatgggacgatgcctgtattcaggtaaagccatgccagccgaacgcgtattccgggacgaccacttcacagacatagatcacgtaataccactcagtgtatcctttgacgacggtatgaacaacaaggtcctgtgcctcgccgaaatgaaccgacaaaaagacaaacaaacaccgtacgcgttcttcaacgcaggccatggacagggattccaagcgatgaacgccatgctcaaaaacaacaaccgaatatcctccgccaaaaagcgaaacctactattcaccgagaacctcaacgacctagaggtccgaaagcgattcatagaaagaaacctagttgacacccgctacgcaagccgcgtcgtacttaacgaactccaacaattcgtcaaagcaaaacagctagacacgaaagttaccgtaatccgggggaagttcacatccaaactaagggaaaaatggaacatcaataaatcccgcgatacacatcaccaccacgccgtcgacgccgcggtcatcgcggtgagccccatgctaaacctctgggaaaaaggcgcctcaatcatcccaaacaaggtcggagaaaacgtcattgacatcaaaaccggtgaaatcataaccgatcacgactacgaggccgacgtatatgaactgccctacgcaaaattcctagagcaaatccccaaagtcaagaaggacatcaagttccgacaccaagtcgataaaaagaagaaccgcaaagtaagcgacgcaaccatatacaccacgcgaaaggcgaaagtaggcaaagacaaagaagagacggactacgtgctaggcaccatcaaggacatctacagcctagaagggtacgtcagcttcaagaaaatctacaacaaagacaaagccaaattcctcatggccagaatagaccccaagaccttcgagaaactcgagaagattgtcgcagaataccccgaatctatcgaagtggtccaagacaacggcaaagtggatgtacaaaagatcagtccatttgagctctaccgaaaggacaacggattcgtaacaaaattcgccaagaaaaacaacggccccgccgtaaaaagtctaaaatactacgacagcaaactcggatcctcgatcgacgtcacgcccgacaacgctaaaaataagaaagtaatcctgcaaagcctcaaaccctggcgcaccgacgtgtacttcaacgaagaaaaccaagagtatgagatcatgggcctcaaatattccgacttaaaattcggcaagaacgggaaatacggcgtaccgaaggtacgctacgaggagattaagcaagaagaagaaataagcgaaggaagcaagttcctgttctccctctaccgcggagacaggattaaagtcacaaacgaactaggagaaaacctcgacctactgttctcctcccgaaccctaccagcacaaaaaggatacgtcgaactcaagcctatcgacaaaacaaaattcgacggcaaagagaaagtctccttctacgggacggtcacacccaacggtcaattcgtcaagaaattcgcgaagaaagggtacaaaattctcaaactcaataccgacgaactgggcaacacctacatcgagaacggcgagaaagaaccatccgacatactggacatgtga

SEQ ID NO: 6268 - RNA, 3366 nt, synthetic construct
  misc_feature 1..3366: note = Cas9 variant
  source 1..3366: mol_type = other RNA
atgaatggtctagtgctcggcctagacataggcataggctcagtcggtgtaggcatactcaacaaggacacgggcgaaataatccacgccaactccagaatcttcccagccgcaacagctgacaacaacgtcgtaagacgctcgagcaggcaaggacgacgcctaaaccaccgcaaaaagcacagaagtgtccgcctcaaagacctattcgaatattacgaccttctgacagacttcagtaaagttagcatcaacctaaatccgtaccgcctccgcgtgaacggcctaaaccaacaactgacgaacgaagaattattcatcgccctcaaaaacatcgtaaaacgccgaggcatatcctacctcgacgacgcatcggaagacggcggagccgtctccagcgactacggaaaagcggtcgaagaaaacaggaagctactagccgaacaaacgccaggtcagatacagctagagcggttcgagaagtacggtcaagtcaggggcgacttcacagtcgtagaaaacggtgaaaagcgtcggctaataaacgtatttagcacttccgcgtacaagaaagaagccgaaagaatcctccggaaacaacaggagtacaacaaccaaataatggacgagttcatagccgactaccttaccatactcaccggaaaacgaaaatactatcacggacccggaaacgagaaaagccgaaccgattacggccgcttccgaaccgacggcacaaccctagacaatatcttcggtatcctcattggaaagtgcactttctaccccgaaaaataccgggcaagcaaggcctcatacaccgcccaagagttcaacctcctcaacgatctaaacaatctgacagtccccaccgaaacaaagaaacttagcgaggaacaaaagaaaacaatagtcgaatacgccaagtcggccaagacgcttggggcgtccacgcttctaaagtacatcgcaaaaatgatagacgcctcggtcgaccaaatcagaggctaccgggtcgacgtcaagaacaaaccagaaatgcacaccttcgaagtctacaggaaaatgcaatcactagaaacaatatcagtaggcgagttctcacgggaggtcctcgacgaactagcacatgtcctaaccctcaatacggagcgcgagggaatcgaggaagccatcaacaccaaactccgcgacagcttcagccaagaccagatcctcgaactcgtacaattccgcaaaaacaatagctccctgttcagcaaaggctggcacaacttctcgctgaaactcatgatggaactgatcccggaactatacgagacgtccgaggaacagatggctatattaacgcgattgggcaagcagaagttcaaggaaaccagcaaacgaacgaaatacatagacgaacaggaagtcacggaggaaatctacaatccagtagtagcaaagtcagtaagacaagcgataaaaattatcaacgaggccacaaagaaatacggcatattcgataacatagtgatagaaatggcccgagaaaacaacgaagaagaggccaagaaagactacatcaaacgccaaaaagccaatcacgatgagaaaaacgcagccatggaaaaagctgcctttcagtacaacggagagaaagagctacccgactcaatattccacgggcacaaagaactcgctaccaaggtccgactgtggcaccaacaaggcgagaagtgcttatacacgggcaaaaacatccctatcagcgacctcatccataaccaatacaaatatgaaatcgaccacatactacccctgagcctttccttcgacgactcgctatcaaacaaagtactcgtactcgccaccgccaaccaagaaaagggccagcgcacccccttccaggccctcgactcaatggacgacgcgtggtcctatcgcgagttcaagtcatacgtcaaagactcgaagtccctaggcaacaaaaagaaagactacctcctgaccgaagaggacatatcgaaaatagaagtcaagcaaaaattcatcgaacgcaacctggtcgacacccggtactcctcccgagtcgtgctcaacaccttacaagacttctacaaagcacacaagttcgacacgacgatctcggtcgtccgaggacaattcaccagccaactacgccgcaaatgggggctcgaaaaatccagagagacctaccaccaccacgccgtcgacgcgctcataatcgcagctagctctcaactaagattatggaagaagcagaacaacccactaattagctacaaagaggggcaattcgtggactcagaaactggagaaatcatctcactcaccgacgacgagtacaaggaactcgtcttcaaagccccgtacgatcattttgtagacacactgcgctcaaagaagttcgaggatagcatcctgttcagctaccaagtcgactccaaattcaaccgaaagatcagcgacgccaccatctacgccaccagaaaaaccaaactcgacaaagacaagagcgaagagacatacgtgctcgggaaaatcaaagacatatactcacagtccgggtacgacgcattcattaaaatttacaacaaagacaaatcgaagttcctcatgtatcacaaagatcctcaaacgttcgagaaagtaatcgaggaaatcctaagaacctatccgagcaaagagttcaacgaaaagaacaaagaagtcagctgcaatccgttcgaaaagtacaagcaagaaaatggcccgatccggaagtactcaaagaaaggcaacgggcccgagatcaagtccctaaagtactacgacaaaaacattccagaatccttcatcaacataacccccagcaacagtaaaaataaagtcatactccggcaactaaacccctggcgcaccgacgtgtacttcaaccaccaaaccgaaaaatatgaactcctaggactcaaatatgcagacctacaatttgaaaagaaaaccggaacatacagcatcacaattgataagtacaacgaaataaaagaaaaagaaggcgtcagcgaacactcagagttcaaattcacgctgtacaaaaacgacctgctgctcatcaaagacacagaaatcaaggaggagcaaatcttccgctttttgtcgagaaccatgccaaaccaaaagcactacgtagaactcaaaccctactacaagggaaacttcgaaggcaaagaaagaataaaggtattcaacacgaccagcaacggccggtgcctcaagggactacgcaaaaagggcctgtcgatatacaaaatcaaaactgacgtcctggggaacaaacacttcataaagaaggagggagagaaaccaaaactcaaattctga

SEQ ID NO: 6269 - RNA, 3366 nt, synthetic construct
  misc_feature 1..3366: note = Cas9 variant
  source 1..3366: mol_type = other RNA
atgtccgacctagtcctcggcctcgacataggaatcggaagcgtaggcgtgggcatcctaaacaaagtcaccggggagataatacacaaaaactcccgcatattccccgcagcccaagccgaaaacaacctcgttagacgtacaaaccgccagggccggcgactaacccgccgaaagaaacacagaatagtacggctgaaccgcctgttcgaggaatccgggctaatcaccgacttcaccaaaatatcaatcaacctcaacccctaccaactccgtgtcaaaggattaacagacgagctctccaacgaggaactcttcatagctttgaaaaacatggtgaaacaccgcggcatctcttatctcgacgacgccagcgacgacggcaacagctccgttggcgactacgcccaaatagtcaaagaaaactcgaaacagctcgaaaccaaaactcccggacaaatacagcttgaacgctaccaaacgtacggacaactccgaggagactttacagtagaaaaagacggcaagaaacaccggctgatcaacgtcttcccaacgtccgcctaccgatcagaggccctcagaatactgcagacacaacaagagttcaatccccaaattaccgacgagttcatcaaccgctacctcgaaatactgaccggcaaacgcaaatactatcacggacccggaaacgagaaaagccgcaccgattacggcaggtacaggacgtccggcgaaacactcgacaacatcttcggaatcttaataggtaaatgcactttttaccccgacgagttccgcgccgcaaaagccagctacacggcacaagagttcaacctcctcaacgacctgaacaacctcaccgtacccacagaaacaaagaaactatctaaagaacagaagaaccagatcatcaactatgttaagaacgaaaaagctatgggccccgcgaaactattcaaatacattgcgaagctactctcatgcgatgtcgctgatatcaaggaataccgcatcgacaaatcaggcaaagcggaaatacacacgttcgaagcctaccgcaaaatgaagaccctagaaaccctcgacattgagcaaatggaccgggaaacactcgacaaactcgcgtacgtcctaacactaaacacagaacgcgaaggaatacaagaggccctcgaacacgagttcgcggatgggagcttcagccagaaacaggtcgacgaactcgtccaattccgcaaagccaactccagcatcttcgggaaaggctggcataactttagcgtaaagctcatgatggaactcataccggaactctacgaaacgtccgaggaacagatgacgatactaacccgactcggcaagcagaaaacgacatcatcctcaaacaaaacaaaatacatcgacgagaaactgctcacagaggaaatatacaacccagtagtcgcgaaatccgtgcggcaagccataaagatcgtaaacgcggccatcaaagaatacggcgacttcgacaacatcgtaatagaaatggctcgagagacaaacgaagacgacgagaaaaaggccatccaaaagatacaaaaagcaaacaaagacgaaaaggatgcggccatgttaaaagcagcgaatcaatacaacggaaaagccgaactccctcactcagtcttccacggacacaagcaactcgccaccaagatccgactgtggcaccagcagggagaaaggtgcctatacaccgggaaaacaataagcatccacgacctaattaacaactcgaaccaattcgaagtcgaccacatcctccccctgtccatcacgttcgacgactcactcgccaacaaagtcctcgtctacgccacagcaaatcaagaaaaaggccagcggacaccctaccaagcactcgacagcatggacgacgcctggtccttccgcgaactcaaggcgttcgtacgagaaagcaaaaccctaagcaacaagaagaaggaatacctcctaacagaagaagacatcagcaaatttgacgtacgcaagaaattcatagaacgaaatctggtagacacacggtacgcgtcacgcgtcgttcttaacgcactacaagagcactttagagcgcataaaatagacacaaaagtctccgtggtaaggggacaattcaccagccagctgcgccgacactggggaattgagaaaacccgggacacctaccaccatcacgcagtcgacgccttaataatagcagcgtcaattcagctgaacctgtggaagaaacagaaaaacaccctcgtctcatacagcgaggaccaactcctcgacattgaaaccggcgagctgatttctgacgacgagtacaaggaaagcgtcttcaaggctccctaccaacacttcgtagacactctcaaaagcaaagagttcgaagactccatactattcagctaccaagtagactcaaagttcaaccgaaaaatttcagacgccaccatctacgccaccagacaagccaaggtgggaaaagacaaagccgacgaaacctacgtcctcgggaagataaaagacatatatacacaggacggctacgacgcattcatgaagatctacaagaaggataaaagcaaatttctcatgtatagacacgacccccagacattcgaaaaagtcatagaacccatcctggaaaactaccccaacaaacaaataaacgaaaaaggaaaagaagtccccgtcaacccgttcctcaaatacaaagaggaacacggctacatccgcaagtatagcaagaaaggaaacggcccagagatcaagtcactgaagtactacgactcgaaactcgggaaccacatcgacataacacccaaggactccaacaacaaagtggtactacaaagcgtcagcccatggagagccgatgtctacttcaacaaaaccaccggcaagtacgagatcctgggactcaaatacgcagacctacaatttgagaaaggaacaggcacttacaaaatcagccaagaaaaatacaatgacataaagaagaaagaaggagtcgactcggactccgagttcaaattcaccctttacaaaaacgacctactcttagtaaaagacaccgaaacgaaagaacaacaattattccgctttctaagccggactatgccaaaacagaaacactacgtagagctgaagccatatgacaaacaaaaattcgaaggcggcgaagcactcatcaaagtcctagggaacgtagcgaatagcggacagtgcaagaaagggctgggcaaaagcaacatctccatctacaaagtacggaccgacgttctcggcaaccaacacataatcaaaaacgaaggcgacaaaccaaaactcgacttctga

SEQ ID NO: 6270 - RNA, 3366 nt, synthetic construct
  misc_feature 1..3366: note = Cas9 variant
  source 1..3366: mol_type = other RNA
atgaacggactggtcctgggccttgacattggcatagctagcgttggagtcgggatacttgagaagaactcagggaagatcatccacgcaaacagcagactcttccccgcagccaccgcggacaacaacgtagaacgacgcaagaacagacaagcccgcaggctgaaccgccgcaagaaacaccgaggggtgcgctttcaagacctcttcgaggactacggcctactaacagacttcagtaaagtttcaatcaacctcaacccctaccgactcagggtagacggcctcaaccagcagctaactaacgaggagctattcatcgcgctcaagaacattgtaaaaagaagagggatctcctacctcgacgacgcaagcgaagacgggggcgcggtctcaagcgactacggaaaagcagtagaagagaacagaaagctcctagccgagcaaacccccggacagatacaactggaacgattcgagaaatacggccaagtccgcggggacttcaccgtagtcgagaacggcgagaaatgtcgattaatcaacgtattcagcacaagcgcgtaccggaaggaagccgagaaaatcctcagaaaacaacaagagttcaacaaccaaatcaccgatgagttcatagaagactatctgaagattcttacgggtaagagaaagtactaccacggacccggaaacgaaaaatccaggacagactacggccggtttcgaaccgacggcacaacgctcgacaacatattcggcgtcctcatcggcaaatgcaccttctacccgaacgagtaccgagccagcaagagctcctacacggcccaagagttcaatctgctgaacgatctgaataacctgaccgtacccacagaaacgaagaaactaagtgaagaacaaaagaaagtcatagtagaatacgcgaaagaggccaaaacactcggcgcgagcacgctccttaagtacatcgtcaaaatgatcgatgctagcgtcgaccaaatatcgggctaccgggtcgacgtcaacaacaaaccagaaatgcacaccttcgaagtctaccggaaaatgcaaagcctcgagaccatctccgtcggagaactcagcaggaacgtcttggacgagctagcacacatactcacactgaacacggagagagaaggaattgaagaggcaatcaactccaaattaatgggagtgttttcccaggaccaggtcttagagctcgtccagttcagaaagaataactccagcctattcagtaaaggctggcacaacttcagcctaaaactcatgatggaactaataccagaactgtacgaaacttcggaagaacaaatgaccatactgacccgactaggcaaacaaaaatccaaagaaacctccaaacggactaaatacatcgacgaaaaagaactcaccgaggaaatctacaaccccgtcgtagcgaagtccgtaaggcaagccataaaaattattaacgaagccacgaagaaacacggcatatttgacaacatcgtaatagaaatggcacgagaaaacaatgaagaggacgccaagaaagactacataaaaagacagaaagcaaaccaggacgagaaaaacgccgccatggaaaaagccgcgttccaatacaacggcaagaaggagctaccagggaacatattcaacgggcacaaagagctggccaccaagataagactatggcaccagcagggcgagaaatgcctctacaccggcaaaaccatacccattagcgacctcattcacaaccaatacaagtacgagatcgatcacatcctgccgctatcgctgagcttcgacgacagcctaagcaacaaagtactcgtgcacgctactgccaaccaggaaaagggccaacgaacaccgttccaagcgctggactccatggacgacgcctggtcgtatcgtgagttcaaatcatacgtcaaggacctgaaaagtctatccaacaagaagaaagactacctcctcaccgaggaagatatcagcaaaatcgaagtgaaacagaaattcatcgaacgcaacctagttgatacccggtacagctcaagagtcgtactcaacgcactccaagacttctacaagtcccaccaattcgacacaaccatcagtgtcgtacggggccagtttacgtcccaactgagacgaaaatggggattggagaaaagcagagaaacttaccaccatcatgcggtcgacgcgctaatcatcgcggcctcgtcgcagctgcgcctgtggaagaaacaaaacaatcccctgataacctacaaagaaggccaattcgtagactcgcagaccggcgaaataataagcctaacagacgacgaatacaaagaactcgtcttcaaggcgccatacgaccacttcgtcgacaccctccactcaaagacgttcgaagacgggatcctcttcagctaccaagtggactccaagtacaacagaaagataagcgacgccaccatctacgccacgcgaaaagccaagctagacaaagacaaaagcgaagagacgtacgtactggggaagatcaaggacatctacagccaagcaggatacgacgccttcatcaaaatatacaacaaagataagcgaaaattcttaatgtaccacaaggacccccaaacattcgaaaaagtcatcgaggaaatcctacgtacgtacccaagtaaagaacgcaacgacaagaacaaggaagtaccatgcaacccgttcgaaaaataccgccaagagaacgggccaatcaggaaatacagcaagaaaggcaacgggccggagatcaaatgcctcaaatactacgacaacaaactgggaaactatatagacataagtccggacggctctgacaatcaggtagtcctccaaagcctaaaaccctggagaacagacgtctactttaaccaccaaacaaaggaatacgaactcatgggcctcaagtactccgacctttcttttgagaaagggagtggaaaatacagcatcagcaacgaaaaatacaacagcatcaaacggatcgaaggagtaaacgaacaaagcgagttcaagttcaccctatacaaaaacgacctgatcctcataaaagatagcgaaaacaacgaacagaaactgttccgcttcaatagccgtaatgacactgcgaagcactacgtcgaattaaaaccctacgacaaagcacgcttcgacggccaacaggaactcataacaatactcggcaacgtcgccaaaggtggccaatgcctgaagggactcaacaaatccaatataagcatcttcaaagttaaaaccgacgtcctaggaaagaaacatataatcaagaaagaaggagacgaaccaaaactcaaattctga

SEQ ID NO: 6271 - RNA, 3366 nt, synthetic construct
  misc_feature 1..3366: note = Cas9 variant
  source 1..3366: mol_type = other RNA
atggcagacaaaacactcggcgccctcacatttggtttcgatattggcatcgccagcgtaggatggtgcgtactaggcgagaaccgaatagtggacctaggggtcagagccttcgacaaggccgaaactgcaaaagagggggagtcactgaacctagcaagacgaaccgcgcgactcatgcgcaggcgattacgcagacgggcctggcgattgacaaaactagcacggctacttaaacgcgaaggactcatcgcagacgccttccaaatgcaccaaccttcggccacgtccccgtggaaactcagggtagaagcgctagatcgaagactcacagacgacgaatgggcccgggtcatataccatctctgcaaacaccgcggcttccactggataagccgagctgaagaaaagaaagcagaaggagacgccaaaggagaaagcggacgcgtaaagaaaggactaagcgacacccagcggcgaatgggagaaaaaggctaccgctcagcggccgaaatggtccttgcagagttcccggaagcacaaaggaacaaacaaggcgactacggaaaagcactctcaagagtcctactaagcgaggaactggccttactattcagacgtcaacgggaactgggacacacacacgccagcaaagaactcgaagcagcaatccttggcaacggggaccgcaaaggcggattgttttgggcccaaaaaccgccactagcaggggcggaccttctaaaaatgcttggaaagtgcaccttcgagaaagacgagtaccgcgccccgaaagcgagcttcacagccgaacgacacgtgtggctaaccagattaaacaacctacgagtagtagtcgacgggacaacgcgtcccctaacagaggacgagagacgcgtagccctaccactaccatacgggtacgccgacgcgaagctcacctacaaacaactacgagcagctctaagcaaagcaggcctatcgaacttctccttcgcaggcattgcagacgataaggaaaaggacacacttacaaaactacccgcctgggaaacactctccaaaacactaaaagggaagggcctggaaacagagtgggaaggtatggcgggggcagccactggtggggaccccaccctactcgacgagatatcaagagtgctgtcagtatacaaagacggcgacgaggtcgatgtagaactacggaaattaccactaccaggcggcgaaaagatggtagaaacgctcagtgaaatctctttcgacaaattccacgcactctcattgaaggctctccgaaaaatagttccacacatggaaacaggactacgttacgacgaagcgtgcgccgccgccggataccaccactcccaactacatgaagccggagctggagggcaaaagtacctcccaccgttctatacccggagagacaaagacggacgcatggtattcgatgaggagctcgacgtaccacgcaaccccgtagtattgcgtgcactcaaccaagctcggaaagttctcaacgccctagtaagagcatacggatcaccatcagccgtacatatcgaaatggcccgggatttaagcaaacccctagtaggccacccgacgcccaacggcgggtacatagaaggaagaagagacatagagaagctacaaaaagagtaccgcgaaaggaacgaaaaagacaaagcagcattcgcggcagaacatggcatagccgcgaagtcacgcgagttcgaaaaattccaactatatagagaacagcaaggcaagtgtgcatacagcctgaaaccattagacctacacagagtcctacacgatataggatacgcagaagttgaccacgctctcccctactcgcggtcatacgacgatggcaaaaacaacaaagtcctagtactgacagaagaaaaccgcaacaaaggaaatagaacagcgtacgagtatctatgcgccttcccgggtggggagaacggcgagcgatggcgaaactttgtcgcttacgtcgaaagcaacaaatcgtacaggctcgcaaaaagaactcggctcctgcgaaaggacttcggaggcaaagctgcagaggagttcagggaaaggaacctgaacgatacccgctacatatgcaagtttttcaagaacttcgtcgaacgattcctacaactaaaagtaggggccgacggcaccgcggccaaacgatgcgtagtcctatcagggcaaaccacagccttcctgagagccagatggggcctactcaaggtcaggggagccagcgaccgacaccacgccttagacgcggccgtcgtcgcagcctgcagtcacggaatggtgaaaagactggccgattactccagaactaaggaactggcaaaagtcagggatggattccccgatccggaaacgggagagatagtggacccagcaatgtttcaacagctacacgcacacttcccagacccgtggccccacttccggggcgagctagaagcacgactgcagctcgacgacagcgcagaactgcgagcccaactagagatgtttggaacataccctgcagaggcactagaaacactgcggcccctgttcgtaagcagagccccgcaaagacgcaatggaggagcagcccacaaggaaacaatatacgcacaaccggaacggctcaaagaacaaggaggcgtaacacaaaaagtcagcctggcatccctcaaaccaaccgacatagacaaactaatagacccacacaggaacgagaagctgtacgcagcaatacgggcacgactagaagcccacgggggcaagagtgacaaggcattcccagcggacaaccccctacgaaaaccagacagagacggaaaccccaccggcccaatagtaagagccgtaacgatggtgatagacaaactctccggaatccagatccgcggaggaatagccaaaaacgataccatgctcagagtagacgtattccggcacaagaaagacggaaaattccacttagtgccactatatgtacaccacgccgtcgcccaagaactaccaaatagagctatcgtcgcattcaaagacgaagacgaatggaccctcatagacgacaacttccatttcctattctccttccacccgaacgacttcatccgaataacgcagaaaaataaagcccccatactcggatactacgcgagctgccatcgcggaacgggcaacctaaacctgtgggcgcacgataggaaccaaaaagtcggaaaagacgggcaaatagaaggaataggcgtaaaaacggcggtcgcactcgaaaaattccatgtcgacgttctaggaaacatatatcctgcaccacccgaacaaagacacggactcgcatga

SEQ ID NO: 6272 - RNA, 3366 nt, synthetic construct
  misc_feature 1..3366: note = Cas9 variant
  source 1..3366: mol_type = other RNA
atgtcagacctagttctcggcctggacatcgggatcgggtcagtaggcgtcggcatcctaaataaagtcacgggcgaaatcatacacaaaaactccaggattttcccagcggcgcaggccgaaaacaacctcgtacgccgaacgaacagacagggccggcgcctgactcgccgaaagaaacaccgccgagtccgactcaatcgcctattcgaagaatccggactcatcacagacttcaccaaaatcagcatcaacctaaacccatatcaattgcgggtaaaaggcttaacagacgaactctccaatgaggaactattcatcgcactgaaaaacatggtaaaacaccgagggatcagctaccttgacgacgcgtcggacgacggcaattcctccgtaggcgactacgcacagatagtaaaagagaatagcaagcaactggaaacgaagaccccgggccagatacaactggaacgctaccaaacatacggtcaactaagaggggacttcaccgtagaaaaagacggaaagaaacaccggttaatcaacgtcttccccacctcggcctaccgcagcgaagctctccgaatactacagacccagcaagagttcaatccgcaaatcacagacgaatttataaaccggtacctagaaatcctaaccggcaaacggaaatactaccacggacctggcaacgagaaaagtcgcactgactatggccgataccgaacaagcggcgaaaccctagacaacatattcggcatactcatcgggaaatgcaccttctaccccgacgagttccgcgccgccaaagcctcctacacagcacaagagttcaacctactcaatgacctcaacaacctcaccgtcccaacagaaaccaaaaagctaagtaaggaacagaaaaaccaaataataaattacgtaaagaacgaaaaagccatgggccccgccaaactcttcaagtacatcgccaaactactttcctgcgacgtcgccgacatcaaagggtacagaatcgacaaaagcggcaaagctgaaatccacaccttcgaagcatatcggaaaatgaaaacactcgaaactctcgacatcgaacagatggaccgcgaaacactcgacaagttagcatacgtacttactctaaacaccgagagagaaggcatccaagaagccctcgaacacgagttcgcagacggctccttctcccaaaagcaagtggacgaactcgtacaattccgtaaggcgaactcctcaatcttcggaaaaggatggcataacttcagcgtcaaactcatgatggaactcatcccagaattatacgagaccagcgaggaacagatgaccatactaacccggctaggaaagcagaaaaccaccagcagcagcaacaaaaccaaatacatagacgaaaaactattaaccgaggaaatttacaatccagtcgtcgcaaaaagcgtccgccaagcaataaaaatagtgaatgccgcaatcaaagagtacggagacttcgacaacatcgtcatcgaaatggcgcgcgaaacgaatgaagacgacgaaaagaaagccatacagaaaatccaaaaagctaacaaagacgagaaggacgcggccatgctaaaagcggcaaaccaatacaacggcaaagcagaactcccacactcggtcttccacgggcacaaacaactagcaacgaaaatacggctctggcaccaacaaggagaacgttgcctctacacaggcaagaccatctccatacacgacctgatcaacaacagcaatcaattcgaagtagaccacatcctcccactcagcatcacgttcgacgacagccttgctaacaaagtactcgtctacgccaccgcaaaccaagaaaaggggcaacgaaccccataccaagccctagactcgatggacgacgcctggtccttccgcgagctgaaggccttcgtacgagagagcaaaacactctcgaacaaaaagaaagagtatctcctcactgaagaagacatcagcaaattcgacgtgcggaagaaatttatagaaagaaacctcgtggacacgcgatacgcctcaagggtcgtactaaacgctctacaagagcacttccgagcccacaagatagacacgaaagtttcagtagtacgcggtcagtttaccagccagctacgacggcactggggaatcgagaaaactcgtgacacttaccaccaccatgcagtagacgccctgatcatcgccgcatcgagtcagctcaatctatggaagaaacagaaaaacactctggtatcctactccgaagatcaactgttagacatcgaaacaggcgaactgatctccgacgacgaatacaaagaaagcgtcttcaaggccccgtaccagcacttcgtcgacacactgaaatccaaggagttcgaagacagcatacttttcagctatcaggtcgacagcaaatttaacagaaagatctccgacgccacaatttacgccacacgccaagccaaggtaggcaaagacaaggccgacgaaacttacgtactcggcaagataaaggacatctacacacaagacggatatgacgcatttatgaagatctacaagaaagacaaaagcaagtttcttatgtaccgccacgacccacagaccttcgaaaaagtgatagaaccgatactcgaaaactaccccaacaagcaaatcaacgaaaagggcaaagaggtaccctgcaacccgttcctaaaatacaaagaggaacatgggtacatacgaaaatacagcaagaaagggaacggtcctgaaataaagtccctcaagtactacgactcaaagctaggcaaccacatcgacatcacaccgaaagactccaacaacaaagtcgtcctccagagcgtgtccccctggcgagcagatgtctacttcaacaaaacaactggcaaatacgaaatccttggcctcaaatacgcggacctacaattcgagaagggaacaggaacctacaaaatttcccaagagaaatacaatgacatcaaaaagaaagagggcgtagactcagattcagagttcaaatttaccctctacaaaaacgacctcctcctggtcaaagacacagaaaccaaagaacaacagctctttcgcttcctgtcacgcaccatgccaaaacagaaacactacgtggaactaaaaccatacgataaacaaaaattcgaaggcggtgaagcactcataaaagtcctcggaaacgtcgcaaactcaggccaatgcaagaaaggcctagggaaaagcaacatcagtatctacaaagtgaggacggacgtgctcggcaaccagcacataatcaaaaatgagggggacaaacccaaactcgacttctga

SEQ ID NO: 6273 - RNA, 3366 nt, synthetic construct
  misc_feature 1..3366: note = Cas9 variant
  source 1..3366: mol_type = other RNA
atgaacggactcgtgctgggactcgacattggcatcggatctgtcggagtgggcatactaaacaaagacaccggagagatcatccacgcaaacagccggatcttcccggccgcaaccgcggataacaacgtcgtacgccggtcaagcagacagggacgccgcctaaaccaccgcaagaaacaccgcagcgtcagactaaaagacctcttcgagtattacgacctactgacggacttcagcaaagtgagtataaacctcaacccctatcgcctccgcgtagacgggctcaaccaacagctcaccaacgaagaactcttcatcgccttaaagaacattgtaaaacgccgcggcatcagctacctagacgacgcctcagaagacggcggtgccgtctcaagcgactacggcaaagcagtcgaagagaaccgcaaactcctggcggagcaaactcccggacagatccaactcgagcgattcgagaaatacggccaagtccgaggcgacttcacagtggtcgaaaacggcgaaaagaggcgcctcatcaatgtcttctccactagcgcgtacaagaaagaggccgaacggatacttaggaaacagcaggagtacaacaatcaaatcatggacgagttcatcgccgactacttaacgatactcaccgggaaaagaaaatactaccacggcccgggtaacgagaaaagtcgaaccgactacggacgtttcagaaccgatgggaccacccttgacaacatattcggtatcctcatcggaaagtgcaccttctaccccgaagaataccgcgcatccaaagccagctacacagcccaagagttcaacctcctaaatgacctcaacaacctgacagtaccgaccgaaacgaagaaactcagcgaagaacagaagaaaacaatcgtagaatacgccaaaagcgcgaaaaccctcggggccagcaccctcctgaaatacatcgctaaaatgatcgacgccagcgtcgaccaaatccgaggctacagagtcgacgtcaacaacaagcccgaaatgcacaccttcgaagtctatagaaaaatgcaactcctggaaacaatccccgtcggcgagttctcccgtgaagtactcgacgaactagcgcacatcttgacgctgaataccgagcgcgaagggatagaagaagcaatcaacacgaaacttatggacgtctttagccaggaccaaatcctggagctagtccaattccgaaagaacaactcctccctcttttcaaaaggctggcacaacttcagcttaaaactaatgatcgaactcataccagaactctacgaaacaagcgaagaacaaatggcaatactcacccgactcggaaaacaaaaattcaaagaaacttcaaaacgcacgaaatacattgacgagcaagaagtcaccgaagaaatctacaatccggtagttgcaaaaagcgtgcgccaggcgataaagatcatcaacgaagcaaccaagaaatacggcatcttcgataacatcgtaatagaaatggctcgcgagaacaacgaggaagaggccaagaaagactacattaaacggcaaaaagccaaccatgacgagaaaaacgccgccatggagaaagcagcattccaatacaacggagaaaaagaactccctgactccatattccacgggcataaagaactagccacaaaagtccggctctggcaccaacaaggggaaaaatgcctatataccggtaaaaacatacccatctcagacctcatacacaatcaatataagtatgagatcgaccacatcctccccctctccctcagctttgacgacagcctatcgaataaggtcctagtcctagccacagcaaaccaggagaaaggacgccgaaccccattccaagccctagacagcatggacgacgcctggagctaccgggaatttaaatcctacgtgaaagactccaaatcactcggtaacaaaaagaaagactaccttctgacagaggaagacataagcaaaatcgaagtaaaacaaaaattcatcgaacggaatctagtagatactcgatacagctcacgggtagtactcaacacactacaagatttctacaaagcccacaaattcgacacaaccatcagtgtagtgagaggtcaattcacatcccaactgcgaaggaaatggggactagaaaagagccgcgagacataccaccaccacgccgtcgacgccttaataatagcggcaagctcacaactcagactttggaagaaacagaacaacccgctcatcagctacaaagaaggacaattcgttgacagcgaaaccggcgagataataagcctgacggacgacgaatacaaagagctagtattcaaagccccctacgaccacttcgtagacacactcagatcgaagaagttcgaagactcaatactcttcagctaccaagtcgacagcaaattcaacagaaaaatatctgacgccacaatctacgccacacgaaaagcgaaactggacaaggacaaatccgaggaaacctacgttctaggaaaaatcaaagatatctactcccaatcaggatatgacgcattcatcaaaatatacaacaaagacaaaagcaaattcctaatgtaccacaaagacccacaaaccttcgaaaaagtcatcgaggaaatcttacgcacatacccatctaaagagttcaacgagaaaaacaaagaagtttcttgcaacccattcgaaaagtacaaacaggaaaacggcccaattcgaaagtacagcaagaaaggcaacggacccgaaataaaatccctcaaatactacgacaaaaacatccccgagagctttatcaacatcacccccagcaactcgaaaaacaaagtcatactgaggcagctcaacccctggcgtacggacgtgtacttcaaccatcaaacggaaaaatacgagctgcttggactcaaatacgccgacctccagtttgaaaagaaaaccgggacttactccataacaatcgacaaatacaacgaaatcaaagagaaagaaggcgtctctgaacactcagagttcaaattcacactatataaaaacgacctactactaatcaaagacacggaaatcaaagaagaacaaatcttcagattcctctcacggaccatgccaaatcagaaacactacgtggaactcaaaccctactacaaaggaaactttgaaggcaaagaacgtatcaaggtattcaatacaacaagcaacggccgctgtctcaaaggactcagaaagaaagggctctcgatctacaaaatcaaaacagacgtactcgggaacaaacacttcatcaagaaagaaggcgagaaacccaaactgaaattctga

SEQ ID NO: 6274 - RNA, 3369 nt, synthetic construct
  misc_feature 1..3369: note = Cas9 variant
  source 1..3369: mol_type = other RNA
atgaacggcaagatcctcggacttgacataggcgtagcatcagtcggagtcgggatcctggacaaaaagacaggagaaataatccacgccagctcccggatcttcccagcagcgaccgcagattcaaatgtggaacgccgcgggttcagacaagggcgcagattgggaagaagaaagaaacatcggaaggtccgcctagctgacctgttcagcgacacgggactcataacggacttcagcaaggtaagcataaacctaaacccttacgagctaagaataaaagggcttaacgaaaaactgacaaatgaagaactattcatcgcgctcaagaacattgtaaagcggcgaggaatcagctaccttgatgacgccaacgaagacggagaatccagctcgagcgaatatgggaaagcagtcgaggaaaaccggaaactactcgctgacaagacgcctggccaaatccagctggaaagattcgagaaatacggccaagtacgaggagatttcacaatagaggaaaacggcgagaaacaccgcctactaaacgtgttcagtacgtcggcatacaagaaagaagcagagcgaatcctcacgaaacaacaagactacaaccaggacatcaccgatgagttcatccaagcatacctcaccatcctcacgggcaaacgaaaatactaccacgggccgggcaacgaaaagagccggacagactacggcagattcagaaccgacggcaccacgctagacaacatcttcgggatactgataggaaaatgcacgttctacccagaagaataccgcgcagcaaaagcctcgtacaccgcccaagagttcaacctcctaaacgacttaaataatctgacagtccccaccgaaacaaagaaactatccgaggagcaaaaacggcaaataatcgaatacgccaaaggagccaaaacactaggcgccgccaccctcctaaaatatatagccaagctagtcgacggctccgtcgaagacataaaaggctaccgaatagacaaaagcgagaaacccgaaatgcacaccttcgacatataccgaaaaatgcaaaccttggaaacggtcgacgtcgagaagttgagccgagaagtcctagatgaactagcgcacatcctcacactcaatacagaacgagagggaattgaagaagcaataaaagtgagcttcattaagcgagagttcgaacaggaccaaatagccgaactcgtatctttcagaaaaagcaactcatcactattcggaaagggatggcataacttctcgatcaagctcatgacggaactaataccagaactctacgagacgagcgaggaacaaatgactatactgacacgcctgggaaagcagaaaacgaaagcacgaagcaagcgaacaaagtacatagacgaaaaggagctaacagacgaaatctacaaccccgtagtagcgaagtccgtccggcaagccataaaaataataaacctggcgactaagaaatacggcgtcttcgacaacatagtaatcgaaatggcacgagaaaacaacgaagaggatgccaagaaagactacgtaaaacggcagaaagcgaacgaagacgagaaaaacgccgccatggaaaaggcagcccaccaatacaacggtaagaaagagctacccgacaacgttttccacggccacaaagaactggcaaccaaaatcaggctctggcaccaacagggcgagaaatgcctctatacagggaaaaacatcccgatctccgacctaatacacaaccaatacaaatacgaaattgaccacatcctccccctgtcactatcgttcgatgacagccttgccaataaagtccttgtcctcgcaacagccaaccaggaaaaagggcagcggacccccttccaggctctcgacagcatggacgacgcctggtcttaccgagaatttaaagcctacgtccgaggggcaagggccctcagcaacaagaagaaagactacctgctaaatgaggaggacattaacaaaatcgaagtcaaacaaaaatttatcgagagaaacctcgtcgacacgaggtactccagcagggtcgtactcaacgccctccaagacttctacaaactaaacgacttcgacaccaaaatctccgtggtccgaggccaattcacgtcacaactacgccgaaaatggagaatagacaagagccgggaaacataccaccaccacgctgtcgacgcgctcatcatagcagcctccagccaactgaggctatggaagaaacaaggaaaccctctgataagttataaagaaaatcagttcgtggacagcgaaacaggcgagataataagcctgaccgacgatgagtacaaagagctagtattccgagcgccgtacgaccacttcgtagacacagtatcaagcaagaaattcgaagaccggatcctattcagctaccaggtagactccaaatacaacaggaaaatcagtgacgcaaccatttacagcacacgaaaggcaaaactaggaaaggacaaatcggaggagacatacgtcttaggaaaaatcaaagacatctacacccagacagggtacgacgcgttcataaagctctacaaaaaggataagtcaaaatttctcatgtaccacaaagaccccataaccttcgaaaaagtcatagaggagattctgaaaacgtaccccgataaagaaataaatgaaaaggggaaagaggtagcctgcaaccccttcgagaaataccggcaagaaaacggcccactgcgtaaatactccaaaaagggcaagggcccggaaatcaaaagtttaaagtactacgacaacaaactcggaaatcacatcgacataacacccgacaactccgaaaaccaagttatactgcagagtctaaaaccctggcgaaccgatgtctacttcaaccacaaaactaaaatatacgagctcatgggcctaaaatacagcgacctatcgttcgaaaagggctccgggaaatacaggatatccctagacaaatacaacgtgataaagaagaaagagggcgttcacaaagagagcgagttcaagttcaccctgtacaaaaatgacctcatcctcatcaaagacctcgagaaaagcgaacagcagctgttccgatacaatagccggaatgatacatcaaaacactacgtagaactcaagccgtacgacaaagccaaattcgaaggaaatcaaccactcatggccctattcggaaacgtcgccaaagggggccaatgcctgaaaggactcaacaaggcaaacatcagcatatacaaagtacaaaccgacgtgctaggaaataagcgcttcatcaagaaagaaggggatgcccccaaactcgaattttga

SEQ ID NO: 6275 - RNA, 3369 nt, synthetic construct
  misc_feature 1..3369: note = Cas9 variant
  source 1..3369: mol_type = other RNA
atgtccgacctcgtactaggcctcgacatcggcatcggtagcgtcggggttggcattctcaacaaagtaacgggagaaataatccacaaaaacagcagaatcttccccgcggcccaagcagaaaataaccttgttcgtcgaaccaaccgccaagggagacgactaacccgcagaaagaaacatcgaatagtgcgacttaatagactcttcgaagagtccggcctcatcaccgactttaccaaaatctccatcaacttgaacccatatcaactcagagtaaaaggactcacagacgagctctccaacgaagaactattcatagctctaaagaatatggtaaaacacagaggaatcagttacttagacgacgccagcgacgacggaaactcaagtgtgggagactacgctcaaatcgtcaaagaaaactcgaaacaactagagacaaaaacccccggccaaatccaactcgaacgataccaaacatacgggcaactgcgaggggacttcacggtcgaaaaggacggcaagaaacaccgtctcataaatgtctttcccacaagtgcgtacagaagcgaagcactccgcatcctacaaacccaacaagagttcaactcacaaatcaccgatgaatttatcaaccgctacctcgaaatcctaacaggcaaacgaaaatactaccacggccccggaaacgagaaaagccgcaccgactacggcagataccgcaccaacggcgagacactagacaatatattcggcatcctaattggaaaatgcacattctaccccgacgagttccgtgcggcaaaggcctcatacacagctcaagagttcaacctgctcaatgacctgaacaacctcaccgtacccaccgaaacaaagaaactatcgaaagaacagaaaaaccaaattataaattatgttaaaaacgaaaaagtaatgggaccggccaaactgttcaaatacatcgctaagctcctcagttgcgacgtcgccgacattaaaggacaccgcatcgataaaagcggcaaagccgaaatccacaccttcgaagcctatcggaaaatgaaaaccctcgaaaccctcgatatagaacagatggaccgcgaaaccctggacaagttagcctacgtactaaccttgaacacagaaagagaagggatacaagaagcccttgaacacgaatttgcggacggcagctttagccaaaaacaagtcgacgaactcgttcaattccgcaaagccaactcctccatcttcggaaaagggtggcacaacttctcagtcaaactcatgatggaactaatcccagagctatacgaaaccagcgaagaacaaatgacaatcctaacacggcttggcaagcagaaaacaaccagcagcagcaacaaaaccaaatacatcgacgaaaagctgttaacagaagaaatctacaaccccgtcgtagcaaagagcgtacgccaagccatcaaaatcgtaaacgcagccatcaaagaatatggtgactttgacaacatagtcatcgaaatggcccgtgaaaccaacgaggatgatgaaaagaaggcaatacagaaaatacaaaaagccaacaaagacgaaaaggacgccgccatgctaaaagcggcgaaccaatacaatggcaaagctgagctaccccactcagtcttccacggacacaaacaactggccacaaaaatccgcctgtggcaccagcaaggggaacgatgcctctacacagggaagactatctccatccacgacctaatcaataaccccaaccagttcgaagtggaccacatcctccccctctccataacgttcgacgactcactcgccaacaaagtcctggtctacgccacggccaaccaggagaaaggccagcgcacgccataccaagccctagacagcatggacgacgcatggtccttccgcgaactaaaggccttcgtgcgagaaagcaagaccctctccaataagaagaaagaatacttgctcaccgaagaagacatcagcaaattcgatgtgaggaagaaattcatagaacgcaaccttgtcgacacccgctacgcaagccgcgttgttctcaacgcactccaggaacacttccgggcacacaaaatagacacaaaagtctccgtagtccgaggacaattcacatcgcagctacgccgccactggggcatcgagaaaacacgggacacctaccatcaccacgccgtcgacgcattaatcatagctgcctcgagccagctcaacctatggaagaaacagaaaaacacactcgtaagctactccgaggaacaactcctggacatagaaacaggagagttaataagcgacgatgagtacaaagagagcgtattcaaagcaccatatcagcacttcgtcgatactttaaaatccaaggagttcgaagactccatattattttcataccaggtcgacagcaaattcaaccgaaaaatatcagacgcaacaatctacgcgacccggcaggccaaagtcggcaaagacaagaaagacgagacctacgtactgggcaaaataaaggacatatacacccaggacgggtatgacgcatttatgaaaatatacaagaaagacaaatcgaaatttctaatgtacagacacgatccgcaaacattcgaaaaagttatagaaccgatcctggaaaactacccaaacaaagaaatgaacgaaaaaggcaaggaagtaccatgcaaccccttcctaaaatataaagaagaacacggctacataagaaaatactctaagaaaggcaatgggccggaaataaaatccctgaaatattacgactctaaactcctcgggaacccgatcgacatcaccccagagaacagcaaaaacaaagtagtcctgcagtcactcaagccctggcgcaccgacgtgtacttcaacaaaaatacgggaaagtacgaaatactcggtttaaaatacgccgacctccaattcgagaagaaaacgggcacctacaaaatcagccaagagaaatacaacggcataatgaaagaagaaggggtagactccgactcggagttcaaattcactctctacaaaaacgacctcttattggtaaaagacaccgaaaccaaagaacagcaactcttcagattcctatcccgcaccatgccgaacgtcaagtactacgtcgagttgaagccatacagtaaagacaaattcgagaaaaatgaatcgctaatagaaatccttggctccgccgacaagagcggaagatgtattaaaggcctgggcaagagcaacatatcaatatacaaggtcagaacagacgtgctcgggaaccagcacataatcaaaaacgaaggcgacaaacccaagctcgatttctga

SEQ ID NO: 6276 - RNA, 3369 nt, synthetic construct
  misc_feature 1..3369: note = Cas9 variant
  source 1..3369: mol_type = other RNA
atgagcaacggcaaaatacttggactcgacatcggcatagcatccgtcggagtaggcgtaatcgatgcacagaccggagaaatcatccacgcaagcagccgaatcttcccatcggcgaacgctgctaacaacgcagaacggagaacgttcagaggatcacgcaggctaatccgacgcaagaaacacagaatcaaacgcctcgacgacctattcaacgacttccacataaaccttgacggcgagatgtcaaccgataacccctacgttctgcgcgtgaaaggcctcagccaaaaattaactgtagaagaactctacatctccatcaaaaacatcatgaaacgcaggggcatctcatacctagacgacgcagaatccgacaatgaagccggccgtagtgactacgcaaaagccatagagcgtaaccgacaactcctcacgagcaagaccccaggagagatacaacttgaaaggctcgagaagtatggacagctgaggggcaacttcaccatcatcgatgaagaaggacaatcccaacagataatcaacgtattctcaaccagcgattacgtcaaggaagtggaaaagatcctcgactgccagaaaatgtaccacaaattcatcagcgacgaattttgcgacaaattaatagaactactgcgagaaaagagaaaatactacgtaggcccagggaacgaaaaatcccgtaccgactacgggatctaccgaaccgacgggacgactctcgaaaacctattcggcatcctaataggtaaatgcaccttctacccggaccaatacagatcgagtcgcgcaagctataccgcccaagagttcaacttcctcaacgatctcaacaatctaaccgtacctaccgaaacaaagaaactaagtcaggagcagaaagagttcctcgtaaactacgcaaaagaaacaagcgtacttggcgccggaaaaatcctccaacagatcgccaaactggccgattgcaaagtcgaagacatccgaggataccggctcgacaacaaagacaaacccgaactacacatcttcgaaacctatcgggcaatgaaaggcctggtaccgctcgtcgacataggcgtactgtcccgtgagcaactggacatcctcgcagatatcttaacgctaaacaccgacttcgaaggcatacgggaagccctcaaaaagcagctcccaaacgtctttgacgaaaagcaagttaagggtttggccagcttcagaaagagcaagtcccaactattcgccaaagggtggcacaacctctcgcagaaaatcatgctagaagtaataccggagctgtacgccacgtcggacgagcagatgaccatactcactcgcctcggaaaattcgagaagtcaagcgtcgccgagtacccctcgagcatcaacgtagacgaaataacagacgaaatatacaacccggtcgtcgcaaaatccatacgacagaccatcaagatcatcaacgcatcaatcaagaaatggggcgagttcgaccaaatagtaatcgagatgccacgcgaccgaaacgaagacgaagagaagaaaagaatagccgacggccagaaagcaaacgcaaaagaaaaagcagacagcatccttagagccgcggaactctactgcgcgggtaaagtcctcccagactacgtttacaacggccacaaccagctcgcgaccaagatacgcctatggtaccagcagggagaacgctgcatatacaccggccagcctatatcaatccacgacctcatacacaaccaaaaccaatacgaaatcgaccacatcctccccttatcgctcaccttcgacgacagcctctcaaacaaggtcctggtgctagccacggccaaccaagagaaggcccagcgaacaccctacaattacctcaaatccgcaacctccgcctggtcctaccgcgagttcaaagactacgtcacaaaacggaaggggataggaaagaagaagtgcgaatacctgactttcgaagaggatatcaacggatttgaggtccgatccaaattcatacaacgcaacctagtagacacccgatacgccagcaaagtaatactcaacgcattacaagactacttcaaaatatcgggcatccagaccaaggttagtgtcgtcaggggacagttcaccagccagctgcgccacaaatggggaatcgaaaagacccgagaaacctaccatcaccacgccgtagacgcactaatcatagcggcaagtagccaattgagactctggaagaaacaagaaagtcccctcgtcgtcgactaccaagaaggccgccaagttgacctcgaaaccggcgaaatactagaactcacagacgaacagtacaaagagctcgtgtaccaaccaccctaccaaggcttcgtgaacacgatatctagcagtgccttcgacaacgaaatcttgtttagctatcaagtcgactccaaagtaaaccggaaaatcagcgacgccacgatctacgccacccgaaacgcacaactcggaaaagataaaacggagggaatttacgtcctggggaaaattaaagacatctatactcaagcagggtacgaagcattccttaagcggtacaccaaagacaaaaccagcttcctaatgtaccacaaagacctagatacgtgggaaaaagtcatagagataatactccgcgactaccgcgaatacgacgaaaagggcaaagaaatcgggaaccccttcgaaaggtatcgccgcgagaacggatacgtcaaaaagtacagccgaaaaggaaacggcactgcgataaagagcctcaaatattacgataacaagctcggcaaccacattgacatcacccccgagaactcccgaaacgcagtagtgctccagagcctgaaaccctggcgcaccgacgtatacttcaacaaggaaaccggcaagtatgagttcctgggcataaaatactcggaccttagcttcgaaaaagggaccggcgaatacggcatcagccaggaaaaatacgactccataaaaatcgcagagggcgtagcgaagaaaagcatcttcaaattcacactatacaaacaggacctactattcatcaaggacatagaaaacaacttcgggaaattattgcgcttcaccagcaagaacgacacgtccaaacactacgtagaacttaaaccctatgacaaaaacaaattcggcaccgaagaacccctgctccctgtactaggcaacgtagcgaaatccggccagtgcataaaaggcctcaacaaatccaatatctcgatctacaaggtcagaaccgacatactcggctaccgacactttatcaaacaggaaggagaacacccacaactaaaattcaagaagtga

SEQ ID NO: 6277 - RNA, 3369 nt, synthetic construct
  misc_feature 1..3369: note = Cas9 variant
  source 1..3369: mol_type = other RNA
atgagcaacggcaaaatccttggcctagatatcggaatcgcctcagtaggggtaggcgtcatagacgctcaaactggcgaaatcatccacgcatcatcacggatcttcccctcagccaacgccgccaacaacgcagaacggagaacgttcagaggatctcgacgtctcatcagacgaaagaaacacaggatcaaacggctggatgaccttttcaatgacttccacatcaatctcgacggcgaaatgagtactgacaacccctacgtactcagggtaaaagggctgtcccagaaactcaccgtcgaagaattgtacatctccatcaaaaacataatgaaacgacgaggcatatcgtacctggacgacgcagagtcagacaacgaagccggccgcagtgactacgccaaagcaatagagaggaaccggcaactccttaccagcaaaacgcccggtgaaattcagctcgagagacttgaaaaatacggtcaactccggggaaacttcacaatcatcgacgaagaaggtcaatcccaacaaatcatcaacgtattctccacgtccgactacgttaaagaggttgagaaaatcctcgactgtcagaaaatgtaccacaaattcatatccgatgagttctgcgacaaactcatagagttgctgagagaaaaacgaaaatactacgtagggccaggaaacgagaagtcaagaacggactacggcatctaccgaaccgacggaaccacgctagaaaacctatttgggatcttaatcggcaagtgcacgttttacccagaccagtacagatctagccgcgcatcctacaccgctcaagaatttaacttcctcaacgacctcaacaacctgacagtccccaccgagaccaagaagctctcccaagaacaaaaagagttcctcgtaaactacgcaaaagaaacctcagtgctgggggccggcaaaatcctacaacagatcgccaagctagccgactgcaaagtcgaggacatccgtggataccgactcgacaacaaggataaaccagaactacacacctttgagacttatcgagccatgaaaggccttgtccccctggtagacatcggagtactaagccgggagcagctcgacatacttgccgacatcctgactctaaacaccgatttcgaaggcatccgcgaagccctaaagaaacaattacccaacgtattcgacgaaaaacaggtaaaaggactagcgagcttccgcaaaagcaagtcacaactattcgcaaagggctggcacaatctcagccagaaaatcatgctcgaagtcataccagaactatacgccacaagcgacgaacaaatgacaatcctaacccgactgggcaagttcgagaaaagctccgtcgccgaataccccagctcaatcaacgtcgacgagataaccgatgaaatatacaaccccgtagtagccaaatccatccgccaaacaatcaagatcatcaacgcctccatcaaaaagtggggtgagttcgaccaaattgtaatcgaaatgccacgagaccgaaacgaagacgaagagaaaaagcgcatcgccgacggccaaaaagccaacgccaaagaaaaagctgattccatattacgcgctgccgaactctactgcgccggcaaagtgctcccagactacgtatacaacggccacaaccaactagcaacaaagatacgcctctggtaccaacaaggagaacgatgcatctacacgggccaaccgatatccatccacgatctaatccacaaccagaaccagtacgaaatcgaccacatactccccctatcactcacgttcgacgattccctaagtaacaaagtcctcgtcttagcaaccgcaaaccaagaaaaggcccagcgaaccccttacaactatctcaaaagcgccacaagcgcctggagctatcgcgagttcaaagactacgtcaccaaacgaaaaggaatagggaaaaagaaatgcgagtacctcacattcgaagaagacatcaacgggttcgaggtacgcagcaaattcatccaacgaaacctcgtcgacacccggtatgcttccaaagtcattctcaacgctctacaggactactttaaaatttccggaatccaaacaaaggtctcagtcgtacggggacaattcacaagccaacttcggcacaagtgggggatcgaaaagactcgagaaacgtaccaccaccacgccgttgacgcactcatcatcgcggccagttcacaactcaggctctggaaaaagcaggaatcacccctcgtcgtcgactatcaagagggacgccaggtcgacctggagacgggggagattctcgaactcactgacgaacaatacaaggagctagtctaccaacccccataccaaggattcgtaaacaccatcagcagcagcgcgttcgacaacgaaatactattctcatatcaggtagacagtaaagtcaaccgcaaaatctctgacgcaacgatctacgccacacggaacgcccaactagggaaagacaaaacagaagggatctacgtcctcggtaaaatcaaggacatctacacccaagccggatacgaggccttcctgaaacggtacaccaaagacaaaactagctttcttatgtatcacaaagacctcgacacttgggaaaaagtgattgaaatcatactgagagactaccgagaatacgacgagaaaggcaaagagatagggaacccattcgagcgctaccgccgcgaaaacggatacgtcaagaagtacagccgcaagggcaacggcacagccatcaagagcttaaaatattatgacaataaattggggaatcatatcgacatcactcccgaaaactcccggaacgctgtcgtcttacaatccctgaagccctggcgcaccgacgtatatttcaacaaagaaacaggcaaatacgagttcctcggcattaaatactccgacctctcattcgaaaaaggcaccggggaatacggaatctcacaggagaaatacgacagcataaagatagccgaaggtgtcgccaagaaatcgatattcaagttcaccctctacaaacaagacctcctgttcataaaagacatcgaaaacaacttcggcaaactccttcgcttcaccagtaagaacgacacttcaaaacactacgtagaacttaagccatacgacaagaacaaattcggcactgaggagccgctactgccggtgctcggcaacgtggcaaaatccgggcaatgcatcaaaggcctcaacaagtcgaacatcagcatctacaaagttcgcacagacatactaggataccgccacttcataaaacaagagggtgagcacccccagctcaagtttaagaaatga

SEQ ID NO: 6278 - RNA, 3372 nt, synthetic construct
  misc_feature 1..3372: note = Cas9 variant
  source 1..3372: mol_type = other RNA
atggccaagattctaggactagacctcggaacgaactcgatcggatgggcactcatagacgacgtccagaacaagatcctcggcgtcggaagccgcatctttccaatgggtgtagaaaatctcggagacggtgacggggagatcagcaaaaacgcttcacgaacaggcacacgtggcgtaaggcggcaattctttcgcagaagactccggaagaaagtgcttctaaaagccctatcagaaaacaacatgtgtcctatgataactagcgacttcgacaactggaagaaaaccaagcaattcccatccgagaaattagcatcgtggttcgccttaaatccatacgaactccggaacaaggccctcagcgaaaaactcaccctcgaggaaataggccgcatattttaccacctgatccaacgaaggggattcctgagcaactctcgcaagggaggaacagacgacggcgctatcttcaaagggaaccccaaagaagggaaaatagggataaccgacacacaagagagcatccaggacaaaacgctcggcagctacctcttcgaaatataccccaaggaaaaccaacctttccaaaacggcctagaacgcatacgcaaccggtacacagtgcggaagatgtatgttgacgagttcgaaatgatctgggaaaaacaagcccaatactactcaaacctcaacgaagacctaaaaacactcttcgggggacgaaaactagacggatacaaagaagacggaatactcttccaccaacgacccctgcgatcacagaaacatctggttggcaactgtgtctttgaaccgaataaaacgaaatgcccaatcagcgccatcccattcgaacaattcagagtgtggcagtgggtcaacacagttgaatataacgggaagaaaatctcccaggtcgagaaagagaaaatcgtggagttcctctacgcgaacgataaaaccgacttcaagaaaatacgcaaagcaatcggaaaagaatcaaccgagttcaagttcaactacaaagacgacgacaaaatagtaggcacgtacactgtatcccacctcagtaacaagaaatatttcggaaagaaatggttcgagttctccgagaaagaacaagaagacatctggcacatactctactttttcgacagtaaatcgaacctcaaagagtacgcaattaaaaactggaacttcaccgaggagcaagctgaaagcatcgcaaagtttaacgtcaaagacggctactccagcctgagccgaaaagccatcagtaacatactgccattcctgaaactgggattcacgtacgacgtcgcagtagttctaggcggcatcaaaaacgtcttcggacacgagtgggaaaaactgtcagacgaaaagcgaaacttccttatagacaacgtcgaaggcatcgtccgaagcaaaactaaaggcggcttcatcgacgtcatcaaagacatcttacgaaacgactacaacatcagcgacaatcaactccggaaactgtaccatcactcagcaaccatctacgtcgccgaattactcgaaaaactaccagtcggtaaagaggccgacaaagaaatacaatccattaggaacccgatagtgataacggcccttttcgaactacgcaagctagtcaacgaactaatcgatgatttcggctccatagacgaaataaaggtagaaatggccagagacctgaagataagcaagagccagcgaaacaaaatacgccgcgaacagaagcgtctagaaagagaaaacgaccgcgtaaaggcccgccttctcgaagaaggccagcggatcacccacgacaacatcctcctatacaaactatgggaggagtgtaagaaaacgtgcccgtacacgggaaacccgatccctctatacaaactgttcactggagaaatacaaatcgaacacatacacccatggtcccgaagcctcaacgacagcttcgccaacaaaacgctatgctacgctgacgaaaaccggaagaagggagacaaaaccccctacgagttctacggcaacgacgaaagcaactggagcgccatcaaagaaagggcccttaaactcttcagcgatacaaaggaataccccaacgcctaccaaaagttcaagcgcttcgtccaacataagttcgacgacgacttcagcagccgacaactaaacgatacccgatacatatcaaaagaggccaaaaactacctcagcaaaatctgcaaaaaggtcgcagtcagccccggacaggccacgagcaacctcagacaaaaatgggggatgaacaacatactcaacgacgaaaacgagaaaacgcgggaagaccaccgccaccacgcaatagacgcactggtcatggcctgcacaaaaatatcgtacgtgcaggagctctcgaaatggaacagatataaccgaaacgccgaactgaaaaagttcccgctaccgtgggagaccttctggtcagacgcaaatagagccgttgacaaaatcctgataagccacaagaaagtcagcaacgacataacgggcagaacacacatatcagagaaaaacgggaagaaatacaaaaacgtcggcgtcgcagcccgcggccaactacacaaagaaacagtctatggcaaacgcaccttcaatggagaagaggcatttcatgtaaggaaaacgatcgacagtctgacaacagaaaaacaactagagaaagtagtagacgagagcataaaactcctcataaagaaaagagtccaagaactagggggattcgtcaaaggcgctatcccggccaacacattctttgtagtcgacgaaaacggcatcaaacagcctcaaatctttctcccgaacaaaaacggagcaccggtaccggtcctcaaagtgcgcatgaaagaaaatataggcggcgcggaaaaactcaaggaaaatgtcaaccaatgggtaaacccccgcaataaccaccatgtcctaatctacaaggacgaaaaaggaaacctgaaagaggaagtagtcactttctggacagtagtggaacgcaagcgaacaggacagtccgcgtaccagctgcccttcgatggaaaagaaatcgtgaccacgctccatatcaacgacatgttcctgctaggcctaaacgaagaagagatcaactgggaaaaccccgactacgaagttctcaaagagcacctgtacagagtacagaagttcacctcaggcgactactacttccggatcgccaagacgtcctcaatacaaaatgcaatcgaaaaacaacaaatcaacagcttcgggttcggaaagaacggatggagtacccacaatcccatcaaagtgaaaatcagtgtttcgggcaaaatatcaaaagtctga

SEQ ID NO: 6279 - RNA, 3372 nt, synthetic construct
  misc_feature 1..3372: note = Cas9 variant
  source 1..3372: mol_type = other RNA
atgaacggcctggttctgggcctggacatcggaataggatctgtcggggtcggaatcctgaacaaagacacaggcgaaatcatccataccaactccagaattttccccgcagcaaccgccgacaacaatgtagagagacgaaacagccgccaggccagaagactcaaccgccgaaagaaacaccgtggagctcgtctacacgatctcttcgaagactacgaccttctgatagacttctcgaaagtaagtataaacctcaacccgtacagactccgagtacaaggacttgacaaccccctaaccacagaagaacttttcatcgcactcaaaaacattgtcaaacggcgcggcatctcatatctagacgacgcctccgagaacggaggcgccgtttcctcggactacggcaaagccgtggaggaaaaccgaaaactactcgccgaacaaacaccgggtcagatccagctagaacgattcgagaaatacggacaagtacgaggagacttcactgtcgaagaaaaaggagacaaacaccggctgataaatgtattctcaacctcagcctaccggaaagaagcagagcgaatcctccgaaaacagcaagagttcaacaaccaaatcactgacaaattcatcgaagactacctgaaaatccttactgaaaaacgcaaatactaccatgggcccgggaacgaaaaatcccgaaccgactacgggcggttccgcaccgacggcacaacgctagacaatatattcggcattctcataggaaaatgtaccttctatccgaatgagtaccgagcatccaaagcgagttacacggcacaagagttcaaccttctcaacgacctaaacaacctaacagtccccacagaaactaagaaactgtccgaggaacaaaagaaaaccatcgtcgagtacgcaaaatcagccaaaaccctcggagcctcgacgctcctaaaatatatcgccaaaatgatcgacgccagcgtcgaccagatacgcggctaccgagtcgacgtgaacaacaaaccggaaatgcacacgttcgaggtgtacaggaaaatgcaatccctggaaacaataccagtcggggagttctcaagagaagtcttggacgaactcgcccacattctaaccctgaacaccgagcgagaagggatagaagaggcgatcaacaccaaactcatggacgtattcagtcaggaccaaatactcgagctagtccaattccgtaaaaacaactcctcactattcagcaagggatggcacaacttcagcctcaaactaatgatggaactgatccccgaactatacgaaacctctgaagaacagatggcaatactgacacgcctcggcaaacaaaaattcaaagaaacctccaaacgcacaaaatacatagacgaaaaagaagtcaccgaggaaatctacaacccggtcgtagccaaaagcgtccgccaggccataaagattatcaacgaagcaactaagaaatacggcatcttcgacaacatcgtcattgagatggcgcgcgaaaacaatgaagaggacgctaagaaagactacatcaaacggcaaaaagccaaccacgacgagaaaaatgcagcgatggaaaaagcagccttccaatataacggaaagaaagaactgccagactccatattccatggtcacaaagaactcgcaaccaaaatccgactctggcaccaacagggcgaaaaatgcttatacacaggcaaaaacatccccatatccgatctcatccacaaccaatacaaatacgaaatcgaccacatactaccattaagcctcagcttcgacgacagccttagcaacaaagtcctagtcctggccaccgcgaaccaagagaaaggacaacgaacgcccttccaagcactggactccatggacgacgcgtggagctaccgagagttcaaaagctacgtgaaagactccaaactcctaggcaacaagaagaaagactacctactcaccgaagaagacatatccaaaatcgaagtgaaacaaaaattcatagaacgaaacctggtagacacgagatactcatcccgggtcgtactcaacacccttcaagacttttacaaggcccacaaattcgacaccaccatctcagtcgtaagaggccagttcacctcccagctccgacgcaaatgggggctcgagaaaagccgcgaaacgtaccaccaccacgccgtagacgcactcattatcgccgcatcctcccaactcaggctatggaagaaacaggcgaaccctctgatctcctacaaggaagaccaattcgtggactcagagaccggcgagatcattagcctcactgacgacaagtataaggaactcgtcttcaaagccccgtacgctcacttcgtcgacacgctctcgagcaaaaagtttgaagactccatactattcagctaccaagtagactccaagtacaaccgcaagatcagcgacgccaccatatatgcaacgcgaaaggtcaaacttgacaaggacaaaagcgaagaaacatatgtactaggaaaaatcaaagacatctatagccaggcaggatacgacgcattcatcaaaatttacaacaaagacaaatcgaaattcctcatgtaccacaaggacccccaaaccttcgagaaggttatcgaggaaatactccgcacgtacccctctaaagagttcaacgagaaaaacaaagaagtgccctgcaaccccttcgaaaaatatcggcaggaaaacggacccatccgaaagtactccaaaaagggaaacggccctgaaatcaaatccctaaaatactacgacaaaaacatccccgagtccttcataaacataactccctccaactcgaaaaacaaagtcattctccgccaactcaacccctggagaactgacgtgtacttcaaccaccagacagagaaatatgagcttctaggtcttaaatatgcggacctccaattcgagaaaaagacaggcacatacagcataaccatcgacaaatacaacgaaatcaaggaaaaggaaggcgtcggagaacaatccgagttcaaattcacactgtacaaaaacgatttgttactaatcaaggacaccaagaataacgagaaacagattttccgcttccttagtcgcacgatgcccaacgtcaaacactacgtcgaactgaagccctacgacaaggccaagttcgacgggaaccaacccctaatcacaatcttcggcaatgtcgccaaaggaggccagtgcctaaagggactcaacaaaagcaacatttccatattcaaagtcaaaacagacgttcttggaaacaaacacttcatcaccaaagaaggagaaaaacccaaactaaaattctga

SEQ ID NO: 6280 - RNA, 3378 nt, synthetic construct
  misc_feature 1..3378: note = Cas9 variant
  source 1..3378: mol_type = other RNA
atgaacggcctagtcctaggattagacataggtatcgcgtctgttggagtcggcatcctaaacaaagaaacgggcgaaatcatccacgtcaacagtagaattttcccagccgccaccgcggacagcaacgtcgaacgacgtgggttccgacaaggaaggaggttaggccgccggaagaaacaccgtagcgcaagactcaacgacctattcgaagaatttggattcataacagacttctcggccgttcccctaaacctcaatccctacgcactacgagtgaaaggcctctcagaagaactaaccaacgaggaactctttattgcgctgaaaaacataattaaacgacgcggaatctcatacctagacgacgcaagtgaagacggagaaacagcaagtaatgagtacggcaaagccgtcgaggaaaaccgcaaactcctcgcagacaaaacgccaggccaaatacaactggagcgattcgaaaaatacggccaagtacgtggcgacttcacagtcgtagagaatggagaaaaccaccgcctcataaacgtcttcagcacctccgcctataagaaagaagcagaacgtatactccggcgacaacaagagttcaacgtccgcatctcagacgagttcatcgaagcatacctgaccatcctcaccgggaaaagaaaatactaccacggaccaggcaacgaaaagagccgcacagactacggacgattccgcactgacggcaccaccctcgataacatattcgggattctgatcggcaaatgcacattctacccagacgaatatcgagcagcgaaagcctcctacacagcacaagagtttaacctcctcaacgacctaaacaacctcacagtccccaccgagactaagaaactgcgaccagagcagaaaaggcaaatcgtagaatacgcccgcacagccaagacgctcggaacgcccacgctcctaaaatacatcgccaagctagttgacggcagcatcgacgacatcaaaggataccggatagacaaatccgacaaacccgagatgcataccttcgacgcatacagaaaaatgcgaacgctcgagctagtagacgtagacatcctgtcgcgagaaaccctagacgatctcgcctacatcctaacattaaacaccgagtcggagggtatcctggaggccctgaacagcaaaatgcccggaaccttcaccaaagaacaaatcgacgagctgatccaattccgcaagaaaaattcagccgtgttcgggaaaggatggcacaatttcagcctaaaattaatgaacgaactaatccccgagctgtacgaaaccagcgaggaacaaatgacgatactaacccgcctcgggaaacaacgaagccgcgagatcagcaagcgcacgaagtacatcgacgaaaaggaactgacagacgaaatctacaatccagtagtcgcgaagtcagtcagacaagccatcaagataatcaatctggccaccaagaaatacgggatctttgacaacatcgttattgaaatggcccgcgagagtaacgaagacgacgagaaaaaggcaatccaaaacgtccagaaagctaacgaagacgagaaaaaggcagccatggaaaaagcagccgacctctacaacggaaagaaagaattgcctgactccatcttccacggacacaaagaactcgccaccaaaatacgactatggcaccaacaaggagagcgctgcctctacacaggaaagaacattagcatacacgacctcatccacaacccccaccagtacgaaatagaccacatcctaccgctcagcctcagcttcgacgatggcctagctaataaagtcctagtactcgccaccgccaaccaagagaagggccaacggacaccattccaggcactcgacagcatggacgacgcatggagctacatcgagttcaagcaatacgtccgcaacagcaagtcgctctcgaataaaaagaaagactacctcctcacagaagaagacatctccaaaatagaagtaaaacaaaaattcatagaacgcaacctagtagacacgaggtacagctcgcgagtcgtactaaatacactccaagagttctacaaaacaaacgacttcgacactaaaatatcagtcgtacgaggtcagttcaccagccagctgcggagaaaatggaaaatcgagaaaagccgcgacacctaccaccaccacgccgtagacgccctaatcatcgctgccagcagccagctacgcctttggaaaaagcaaaacaaccccctaatatcataccgtgaaggccaactggtagaccccgaaaccggagaaatcctcagcctcaccgacgatgaatacaaagaactggtgcttcgcccgccctacgactacttcgttgacaccctgaaatccaaatctttcgaggactccatcctcttcagctaccaagtcgattcaaaatacaaccgaaaaatatcggatgcgacgatatacggcacccggaaagcacaactaggaaaggacaaacaggaagagacctacgtactcggaaagatcaaagacatatactcacaaaaaggctacgaggatttcatcaagcgatacaagaaagacacgacacaattcttaatgtaccacaaagacccacagacattcgccaaagtaatagaggagatactcaaaacctacccggacaaagagctaaacgagaaaggcaaagaaataccctgcaaccccttcgaaaaataccgccaagaaaatggaccgatccgcaagtactcaaagaaggggaaaggccccgaaataaaaagtctaaaatactacgacaacaagctgggaaaccatattgacataacacccgtaaactcccagaaccaggtagtcctacaaagcctcaaaccgtggcgcaccgacgtgtacttcaatccgcaaacgagcaaatacgaacttatgggcctcaagtactccgacctcagattcgaaaagggaagcggaagctacggaatatcccccgaaaaatacaacaaggtcaaagccaaggaaggcgtggacgaagacagcgagttcaaatttacactttacaaaaacgacctgatactcataaaagacacagaaacaggcgaacagcaactcttcagatacggctcccgaaacgataccagtaaacactacgtagaactcaagccctacgaaaaagcaaaattcgagggcaaccaacagctaatgaacctcctaggaacggtagcaaaagggggacagtgcctcaaaggcataaacaaaccgaacctcagcatatacaaggtcaaaaccgatgtgctgggtaataaatacttcattaagaaggaaggagatcagccgcaactaaatttcaaaaagaaaatctga

SEQ ID NO: 6281 - RNA, 3378 nt, synthetic construct
  misc_feature 1..3378: note = Cas9 variant
  source 1..3378: mol_type = other RNA
atgacatcaaagcaagaaaacctcggagccctcacattcggcctagacataggcatcgcaagcgtaggctgggcagtactgggcgaaaaccggataatagacctaggcgtaagatgcttcgacaaagcagaaacagccaaggaaggagaatcgctaaacctcgcccgccgaatggccagactactacgccggagactgagaagacgagcctggaggctaacaaaactagcccgcctactcaagcgagaagggctaattgccgacgccaatctcttcaaaaacaaaatcgagaagaacacacccgtacccaaaagcagctggcaacttagagtagacgctctggaccgaaaattaaacgccgaggaatgggcacgcgtcatctaccacctctgcaaacacagaggcttccactggatatctcgagctgaggaaaaagccgccgagtcagactcaaaaggagagtctggaaaggtgaaacaagggctcgccggcacgaagaaactaatgcaagagaaaaactacagaacagccgccgaaatggtcctagcggagttcccggaagcccaaagaaacaaacaaggagactattcaaaagcactgagcagaatcctgcttggggacgaactcaagaccctgttcgaacaccagcggaaactagactcaccatttgcaaccgaaaaactagaagctgccatactagggaacggcgaccggaaaagcggactcttttgggcgcaaaaccccgctctagccgggagtgacctcctaaaaatgctcggctattgcacctttgaaaagaccgaataccgagcccccaaagccagcttcaccgcagaaaggcacgtgtggctcacaagactgaacaacctccgtatcgtagtagacggcaccacccgccccctaaacgaagcagaaagaaggatagccctactcatgccataccaacaagcaggggacttcacctataaacaattgcgcactgctctcaccaaagcgggcttcctacctgagagcttccgttacacaggactaagctacgcctccggacaaaaagcgggggagaaaaccaaagaccccgaatcagcagcacttgtgaaattcccggcctggcaagaactacgaaagacccttgagaaaaaggaactagcctcagaatggcagaaaatctctaccgacgcactagacggaaagccccagttattggaccaaatagcatgggtgctgagcgtatacaaagacgatgacgaagtaaaagcagaactaagcaaactgaacctcccaaacgcagagaaaatgatcgacgccctactcgacatcagattcgacaaattctcaaaccttagcctcaaagccctttgcaaaatcgtccccctaatggaacaaggccaacgatacgatgaagcgatcgcaaacatcccagaatatggccaccacagccagctacacaaggtaggcgcgggagaacacaaatacctcccgcccttctacaaagaacgagacaagaccggcagaatggtattcaacgacgatatggacatcccccgtaacccagtggtcctacgagccctaaaccaagcacggaaagttgtaaatgcactaataaagaaatacgacagcccccacgaagtccatatagaaatggccagagacttatccaggccgctggacgaacggagagaagttgaaaaactacaaaaagagttccgtgacaataacgagaaaggaaaagcacagttcgcgcaggacttcaatatcgtaggggccgttaaagggaaagagttcgaaaaataccagctctatcgagagcagcagggcaaatgtgcgtactccatcgaacccatggacatacaccgtctattcgaacagggatacgtcgagatagaccacgcactgccctactcccgatcattcgacgacagcaaaaacaaccgtgtactggtcttagccaaagaaaaccgagacaaaggaaaccggacgccattcgaatacctaggcgggaaagacaacagcgaaccgtggcgccaatttgtcgccttcgtggaagggaacaaagcgtacagattggctaagagatccaggctactcaggaaagactttggtgacaaagaagcaaaagagttccgtgaacggaacctaaacgatacccgttacatttgcaaattctttaaaaactacgtggagcagtacctacaactccacgaggattcagaagccaaaaggtgtgtcgtactaagcggacaaatgactagcttcctgagagcccgctggggactcgtcaaagtacgcggcgacagcgacaggcaccacgcactggacgccgcggtcgtagccgcatgcagccacggcatggtgaagcgccttagcgactacagcagacgcaaagaactagagcaagtaagagaaggctttgtagacgtagacacaggcgaaatcgtcaacccagctatgttccaacaggtacaagagcatttcccaaacccatggccccacttcagggacgaagtcaaactaaggctatccatggacgacccggcactactgcgatctgaaatggagaaattcgggacatacaccccagaggcactccaggccctccaccccttgttcgtgagcagagccccgcagagacgaaatagcggcgctgcacacaaggacaccatatacgcacagccaaaacgactcgtcgcccagggcggagtcacacagaaagtagccctaacctccctaaccctaaaggacctcgacaaactaatagacccccacagaaacgacaagctgtacaccgcaattcgcgcccgcctagagcagcacgggggcaagggagataaagccttcccgtcgtcaaacccactccgaaaaccagactcggaaggcaacccaacaggaccaatagttcgaggcgtgaccatggtcatcgacaaactgtcaggcatcccaatccgaggcggcattgccaaaaacgactccatggtcagagtcgacgtcttcacaaaagcaaacaagttccacctggtccccgtctatgtacaccacacagtagccaaagcccttcccaaccgggcagtcgtcgcattcaaagacgaagatgaatggacactgatcgacgactcattcgacttctgcttttccctacatcccaacgacctggtccaagtccaacaaaaagggaaagcgggaatgataggatactattcgtcctgccaccgcggaaccggaaacataaacctctgggcacacgataggaatctacaagtaggaaaagacggcatgatagaaggaatcggagtcaaaacggccctcagcctcgaaaaattcaacgtagacgtactcggcaacagatacccagcgcccccagagaaaagacgcgacctagcgtga

SEQ ID NO: 6282 - RNA, 3378 nt, synthetic construct
  misc_feature 1..3378: note = Cas9 variant
  source 1..3378: mol_type = other RNA
atgaccgaccggatctcactaggtctagacatcggggtcgcaagcgtagggttcagcgttctagacatcgacaaaggcaaggtaatcgaactaggcgcacgactgttcaacgcaacagtcgcagcaggcaaccaagaccgcagagacatgcgcggaagccgacgcctcctcaatcggaacaaacaacgacgtaaggacgtgtcgaaactcttccaggaatacgggctcctagacaatttcgacagagacaacttccacactgccttcaataacaactggaacccctatgagctacgcgtcaaaggactaacaaaacaactcaacaaagaagaactcgccgacagcctctaccaaatcataaaacgccgcggcatctcatacgcgctaaaagacgccgacgcaaacgaagacggcaccgactactcctcatcactcaaaatcaacagccaagaactcatcgaaaagaccccggcacaaatccagctacaacgcctcaacgattacggcaaagtccggggaaaagtcattgtcggcgacgacatcgacgaccagaaagttctcctgaatgtcttccccaccaacgcctacgaaaaagaagcccgtcaaatcatagccacccagcaacaattttaccccgaaatcttgacgggcgagttcgtcaaagaatactgccaaatcctgacgcgcaaacgcgactacttcgtcggccccggcaacgaaaaatcccgaacggactacggcatatacaaaaccgacggacgcaccctagacaatctctttgaggaactcatcggtcatgacaaaatctacccggacgaactcagagcctcagcggcctcctacacagcccaactattcaacgtactaaacgacctcaacaacctccgaatcctatcttacgaagacggaaagctgacgcaaatcgacaaagaaaagatcatagcagaaataaagaataacacaacggtcgtaaatatgcttaacgtcatcaaaaaggtcaccggctgccagaaagacgacataaagggattcaggctaaatgagaaggacaagcccgaaatcagctccatgcccatctaccgaaaagcacataaagatttcctaaaggtcgggatagacataacagactggcccatcgacttcatagaccggctttcgttcatcctcacgctaaacacagagaatggagagatcagaaagcaaattaacaagcgcctcgtcccagacttcgacttcctcaacgacgacttagtccaactcattatcgacaacaaagacagcttcgacatcaagacaaacaacaaatggcatagattctccctaaaaacaatgaacaaactcataccaaccatgatcgaacgcccggtcgaacagatgacattactaaccgaaatgggcctaattaagaaagataccaaacgctttgaagggaacaaatacctcccctacaaggaaatagccaacgacatattcaatccagtcgcgtcaaaaagtgtccgcgaagcgttgaagatcgtcaatgccgtactgaagaaatacggccacatagaatatatcgtcatagaaatgcccagggacaaaaacctagatgaggaaagaaagcagatcgctgacttccaaaagaaaaacaagaaaataaaggatgccgccttcaacgccttcgtcaaagcagtgggctcgaagaagaacgtaaaaatcgcactatccaaaaaccgcaaactgcaaatgggcatccgactatggcaccagcaacaagggatagacccctacaacggagaggaaataaacgctaacgacctgatcagcaacccagataaattcgagatcgaccacatcatcccgcaaagcatcagcttcgacgatggcataaacaacaaaacgctatgtttcgcgtcaatgaaccaagtcaaaggccaaaagaccccatacgagttcctcaacgaaggccacgggcaggggtacgcaaaattcaaagcaatagtatccaagaacaagaacttctcaaaagcaaaacgagacaactacctcttcgaggaaaacgtgagcaacatcgaaacgcgcaaacgatttctttcccgcaacctcgtagacaccagatactccagccgggtcgtactcaacagcctgcaggagttcttccacgaaaaatcagacgacaccaaagtaacagtgatccgcggcaaattcacaagcaacatgcgaaaacactggcacatcgacaaaacaagagacacttttcaccaccacgccatagatgccagcatcattgccgccacgccgttcctccgcatgtggaaaaaggggtcgacaatattccccaccaaaatcaacgaaacaagtattgacattgaaaccggtgaaatcctcgacgacaaaaacttcgacaaggtcatgtacgaagaaccgtactcaggattcatcagcgaaataatgaacgccgacgacagaattaagttctcccaccaagtagacaagaaaatgaaccgcaaagtaagcgacgcaaccatatactcaaccagaatcggcaagctcagcaaggacaagaaagacgccgagtacgtcgtggcaaaagtgaaagacatatactcagtagacggatacgaaaatttcaagaaagtgtacaagaaagataaaaccaagttcctcctatacaaatatgatccaagaaccttttccgagctcgagaaaatcgtcatcgactacccagacaagatcgaaaaagtccaaacgaacggcaagataaaggcagtggacatctcacccttcgaactgtaccgccgtgacaatggcatggtccgaaaatacagcaagaaaaccgggccagcaatcaaacaactaaaatacttagacaagaaactcgggagccacatagacatcaccccgaaaaatgcaaacaacaaacacgtggtattgcaaagcctaaaaccatggagaaccgacgtctatctaaaccacgagacgggcgaatatgaaatcatgggaatcaaatattccgacctgaaattcaataagaatgaaggctacggcataaagaaggacaaatacctcaaaatcaaaaacatcgagggagtctccgagaactcagagttcatgttcagcctctacaggaaagaccgcataaaagttcaggacatggaaaccaacgagagcgtagaactcctattctggtcgcgaaatttcagcaacaaaaagtacgcggagctaaagcccataagccaaatagacaacgacaaggtgttgccgatctacggtaggggccgcctcatcaagcgactaatacctaaaaactgcaagatctggaaggtcaacacaagcatcctaggcgatacctattacctcgaaaaagagtcaaactatccacagaaaatccttgactga

SEQ ID NO: 6283 - RNA, 3381 nt, synthetic construct
  misc_feature 1..3381: note = Cas9 variant
  source 1..3381: mol_type = other RNA
atgaacggcctcgtgctcggcctcgacataggaatcgcaagcgtcggggtagggatactcaacaaagaaacgggagaaatcattcatgccaacagccgcattttccctgccgcaacggctgactccaacgtcgaacgccgaggattcaggcaagggcggcgcctcggacgcaggaagaaacaccgaagcgcccgactgaacaacctgttcgaggagttcggattcatcacagacttctcggccatacccctaaacctcaacccctacgccctccgagtcaaaggcctgagcgaagaactcaccaacgaagaactatttatagccctgaaaaacataataaaaagaagaggcatctcttacctcgacgacgcatcagaagacggagaaaccgccagcaacgaatacggaaaggcggtggaagaaaaccgcaaactactagccgacaaaacgccgggacaaatacaactcgagcggttcgagaagtacggacaggtacgcggcgacttcaccgtcgtcgaaaatggggaaaaccaccgcctaatcaacgtattctcaacaagcgcctacaagaaagaagcagagcgtatactcagaagacaacaggagtttaacgtgcgaatctcagacgagttcatagaagcctacctgaccatcctcacgggcaagaggaaatactaccacggccccggcaacgaaaagtcgcgcaccgactatggacgtttccggacagacgggaccacactggataacatattcggcatcctgatcggcaaatgcacattctaccccgatgaatacagggcagccaaggccagctataccgcccaagagttcaacctactgaacgatctcaacaacttgacagtacccacagaaacgaaaaagctctcgccagaacagaaaagacaaatcgtagaatacgcccgcacagcaaaaaccctcggcacacccactctactgaaatacatagccaaactcgtcgacggatccatagacgacatcaaaggataccgaattgacaagagcgacaaacccgaaatgatgcacaccttcgacgcttacagaaaaatgcgcacccttgatctcgtcaacatcgacgccctctcccgcgaaaccctagacgacctagcccacattctcaccctcaacacagaaagcgaaggaatcctagaagccctgaactccaaaatgccaagcacattcaccaaagaacagatagatgaactcatccagttccgcaagaaaaactctgccgtattcggcaaagggtggcacaacttcagcttaaaactaatgaacgagctaatcagcgaactttacgagaccagcgaggaacaaatgaccatcctaacacgcctcggaaaacaacgctcccgtgagattagcaagcgcacaaagtacatagacgaaaaggagctaactgaggagatatacaaccctgtagtcgccaaatccgtaaggcaagccatcaagatcataaacgaagccacaaagcgctacgggatattcgacaacatcgtcatcgaaatggcaagagaaaacaacgaagaggacgccaagaaagactacatcaaacggcagaaagcaaaccaagacgagaaaaacgcctccatggaaaaagccgcattccaatacaacgggaagaaagaactcccagacagcatcttccacggccacaaagaactagcgaccaagatccgactatggcaccagcaaggcgaacgttgtctctatacgggcaaaaacatcagtatcagagacctgatacacaacccacatcaatacgaaatcgaccacatcctgccactttccctgagcttcgacgacggactagccaacaaagtcctagtgctcgcaacagctaaccaggaaaaaggtcaacggacaccctttcaagccatcgacagcatggacgacgcctggagctaccgagagtttaaacagtacgtacgtaactcaaaaagcctttcaaacaagaaaaaggactacctcctcactgaggaggacatatcaaagatagaagtgaaacaaaagtttattgaaagaaacctcgtggatacacgatacagcagccgggtagtcctcaacacgctccaagagttctacaaaacaaacgacttcgacaccaagatctccgtagtccgcggacaattcacctcccaacttcgtagaaaatggaagatagaaaagagccgcgacacctaccaccaccacgccgtggacgccctaatcatagcagcgagctcgcaactcagactatggaagaaacagaacaaccccctaatctcatacaaagaaggccagttcgtcgatcccgaaacaggggagatcctcagcctcactgacgacgagtacaaagaattagtattccgaccaccctacgactactttgtcgataccctgaaatcaaaatctttcgaagacagcatcttattcagctaccaggttgactcaaaatacaatagaaaaatttccgacgcaacgatctacggcacacggaaagcgcagctcggaaaagataaacaggaggaaacctatgtcctcgggaaaataaaagacatctacagccaaaaagggtacgaagacttcataaaacgatacaacaaagacgaaactcaattcttaatctaccacaaagacccacaaacattcgaaaaagtaatcgaagaaatactcaagacgtaccccgacaaggaactgaacgaaaaaggcaaggaaataccgtgtaacccattcgaaaaataccgacaggagaacggcccaatcagaaaatacagcaagaaagggaaaggccccgaaatcaaaattctcaaatactacgacaacaaactaggaaaccacatagacattacacctgttaactcccagaaccaagtcgttctacagtcactgaaaccctggcgaacagacgtctacttcaatccccgaactagcaagtacgaactcatgggactcaaatactccgacctacgtttcgaaaaaggcagtggttcctacggcatatccccagaaaaatataacaaagtaaaggccaaagaaggcgtgaacgaagattccgagttcaagttcaccctctataaaaacgatctcatacttatcaaagacaccgaaacaggagaacaacaactcttccggtacggatcgcgcaacgacacatcaaaacactacgtcgagctcaaaccatacgagaaagccaagttcgaaggcaaccaacagctgatgaacctactaggtaccgtcgctaaaggcgggcaatgcctcaaaggaataaacaaacccaacctcagcatctataaagtgaagacagacgtcctcggcaacaaatacttcatcaagaaggaaggagaccagccccaactaaacttcaaaaagaaattctga

SEQ ID NO: 6284 - RNA, 3381 nt, synthetic construct
  misc_feature 1..3381: note = Cas9 variant
  source 1..3381: mol_type = other RNA
atggcgagcaagcacgaaaacctaggagccctcacattcggactagacataggtatcgcgagtgtcggatgggcagtcctcggcgagaaccgcataatagacctcggagtcagatgcttcgacaaagcggagacagcgaaagagggagagtctctaaacttggcgagacggaccgctcggcttctacgccgtcgtctccggcgacgagcctggcgactaaccaaactagcaaggctactcaaacgagaaggactgattgcagacacgaacgtattccagaaaccattcaacctaaaggatgcgaacgaaaagggcctaagtttctggcagctccgcgtagacgccctagacagaaagctatccgcggaagaatgggcccgagtaatataccacctctgcaaacaccgaggatttcactggatcagccgcgccgaagagaaggcggccgaaggtgactcaaaatccgagggcggaaaagtaaaacagggactagccggcaccaagaaactgatgcaagagaaaaattacaggacagccgctgaaatggtgctcaccgaatttcccgaagcacaacgaaataaacagggagactacagcaaggccctcagccgcatcctactaggggatgaaatgacccaactcttcaaacaccagcgagagttaggaaacccgcacgcgacggaaaagctagaagccgcaatcctgggcaatggggaccacaaatccggcctattctgggcacaaaaccccgccctcgccggaaatgatctattaaaaatgttaggacactgcacattcgaaaaggcagaataccgtgtacccaaagcctcttttacagcagagagacacgtctggttaacccgtctcaacaacctaagaatagtagtagacggaacaactcgcccactgaacgaagcagagcgacatctagcactactcatgccataccaacaggcgggcgacctcacgtataaacaactccggaccgcgctcacgaaagcaggatacctgcccgaatcattcagatacaccgggcttgcctacgcctcaggtcaaaaagcagatgagaaagctaaagacccggagagcgccccactggtcaaactcccggcgtggcacgaattgcggaaaacactagaaaagaaagagctcgcctcggagtggcagaaaataagcagcgacgcgcttgacggaaaaccccaactgctagaccaaatcgcctgggtcctgtccgtatacaaagacgacaccgaagttgaagccgagctctgcaaattaaatctaccgaacgccgaaaagatgatagacgcactactagacataaggttcgacaaatttagcaatctctcactcaaagcccttcgacaaatagtacccctcatggagcaaggccaaagatacgacgaagccgtcgccaacataccagaatacggacaccactcacaactgcacgaagtgggagctggcgagcacaaatacctcccacccttctacaaagaacgcgacaagaccggccgaatggtcttcaacgacgacatggacatcccaagaaaccccgtagtcctccgcgctctcaaccaagcgcgcaaagtcgtaaacgccctgatcaaagagtacggctcaccccacgaggtccatatagagatggcccgcgacctcagcagaccactggacgaacgccgcgacgtagaaaagctccaaaaagaatttcgagaccgcaacgaaaaagacaaagccctcttcgcgcaagacttcaacatcgtgggagcggtgaaagggaaagagttcgaaaaataccaactctaccgagaacaacaaggaaaatgcgcatacagcatcgaacccatggatatccaccgactcttcgaacaaggctacgtcgagatcgaccacgccctcccttatagccgatcattcgacgacagcaagaacaaccgagtactcgtactcgccaaagaaaacagagacaaggggaaccggacaccgttcgaatatctgggcggaaaagacaacagcgagcgttggcgccaattcgttgccttcgtagaaggaaataaatcctaccggctagcaaaacgctcacgcctcctgcgcaaagacttcgggaaggacgaagcaaagggcttcagagaacgcaacctaaacgacacaaggtacatctgccggttcttcaaaaactacgtcgaacaatacctacaactacacgaagactccgacgcaaaacgctgcgtcgtactctcgggtcaaatgacctcattcctgcgcgcacgatggggactcgtaaaagtcagaggcgactcggacagacaccacgctctcgacggagcaatagtcgccgcctgcagccactcaatggttaaacgcctctctgactacagccgtagaaaagaacttgaacaagtacgcgcgggcttcgtagatgtcgatacaggcgaaatagtcaacccagcaatgttccagcaagtacaagagcacttcccgaacccttggccacacttccgcgacgaagtaaagctacgacttaatgtcgacgatcccgccctacttcacagcgagatgaaccgcttcggcacatacagccctgaagccctaaaagcgctacgacctctcttcatttcacgcgcaccccagagaaggaactccggcgcggcccataaagacacgatctacgcacaacccgaacgactggttgcccagggtggagtcacccaaaaagtcccactgacctccctaacgctcaaggacctagacaagctgatcgacccccaccgaaacgaaaagctatactccgcaataaggatacggctggaacagcatgggggaaagggcgacaaagcattccccgcctcgaatccgctgcgaaagcccgacagcgaaggaaacccgaccggacccatagtacggggagtaacgatggtgatagacaaactcagcgggatcccaatacggggcggtatagctaaaaacgactcaatggtgcgcgttgatgtattcaccaaagccgggaaatttcacctagtaccagtctacgtacaccacgcggtcgctaaggtcctacccaaccgcgcagtcgtggcctacaaagacgaaacggagtggacgctcatcgacgatggcttcgacttctgcttcagcatgtaccccaacgacctcctaaggataaaactgcgaaacgcgagccacctcggatactacgcttcctgcaacagatccacaggcgccatcaacctatggagccatgatcgaaaccaacaagtaggcaaagacggcatgatcgaaagcataggcgtcaagacggccctcaatgtcgagaaactaaacatagatgtcctaggcaatcgatacccggccccaccggagaaacgccgggacctagcctga

SEQ ID NO: 6285 - RNA, 3384 nt, synthetic construct
  misc_feature 1..3384: note = Cas9 variant
  source 1..3384: mol_type = other RNA
atgagcgacctagtactcggcctcgacatcggcatagggagcgtcggggtaggaatactcaacaaggtcacaggagagataatccacaaaaactcccgaatctttccggctgcccaagccgagaataacgtcgagcgccgcataaaccgacaaggccgccggctcacccggcggaagaaacatcgacgcgttagactgaaccacctcttcgaagagtccggactaattactgacttcaccaacgtcagtatcaatctaaacccctaccagctgagagtaaagggactaacggacgaactgagcaacgaagaactattcatagcactcaaaaacatggtgaagcaccgcgggatcagttacctagacgacgcttcagatgacggtaactcatcagtcggagactacgcccagatcgtgaaagaaaacagcaaacagctcgaaacaaaaacgccaggacaaatacaactggaaaggtaccaaaaatacggacagttacgcggagacttcaccgtcgaagaagacggcaagaaacaccgactaatcaacgtattccccaccagcgcgtacagggcggaagcgttgagaatcctacaaacccagcaagagttcaacccacagataaccgacgagttcataaactcatacctacaaatcctaaccggcaaacgaaaatactaccacgggcccggcaacgagaaaagccggaccgactacgggcggtacacgaccaagaaagacagcgaagacgaatacatcaccctggacaacatattcggaatacttatcggaaagtgcaccttctacccggaagaataccgcgcagccaaagcctcctacaccgcccaagagttcaacctactcaacgacctaaataacctcacagtacccaccgaaaccaagaaactaagcgaagaacagaaaaaccaaataataacaaacgtcaaaaacgaaaaagccatgggccctgcaaaactattcaaatatatagccaaactactctcatgcgacgttgccgatatcaaaggctaccgcatcgacaaatccgataaggccgaaatacacacctttgaagcctacagaaagatgaagacgcttgcgaccatcgacatagaacaaatggaacgggaaaatctggataaactcgcctacgtcctcaccctgaatacggaaaaggaggggatccaggaagcactagagcacgagttcgccgacggtacattctcccaggaacagatagacgagctagtacaattcaggaaagccaacagttcaatcttcggcaaaggctggcacagcttttccgtaaaattaatgatggaactcatacccgaactttatgccacatccgaggaacaaatgaccatcctcactcggctcggcaaacagaagacaacgagcagctcaaacaagaccaaatacatcgacgaaaaacagctaactgaagaaatctacaaccccgtcgcggccaaatccgtacgccaagcaataaaaatagtaaacgcggccatcaaagaatatggagacttcgacaacatcgtcatcgaaatggcacgcgaaaccaacgaagacgacgaaaagaaagctatccagaaaatacaaaaggccaacaaagacgaaaaagacgccgccatgctaaaagcagccaaccagtacaacggtaaagccgaactcccacacagcgtattccacggtcacaagcaactagcaacaaaaatccgcctatggcaccaacaaggggagcgctgcttatataccggcaaaaccatcagcatccacgacttaatcaacaacagcaaccagttcgagatcgaccacatattaccgctctccataaccttcgacgacagccttgcaaacaaagtgctggtatacgccactgcaaaccaggaaaaaggccaacggaccccataccaggctctcgactccatggacgacgcctggtctttccgtgaactaaaggctttcgtccgagactccaaagccctctccaacaaaaagaaggagtacctcctgaccgaggaggacatctcgaagttcgacgtccggaagaagttcattgagcgaaacttagtagacacacggtacgccagcagggtggtcctcaacgcgttgcaagagcactttcgggtccacaaaacagataccaaagtcagcgtcgtgcgaggccaattcacctcgcaactacgacgccactggggaattgaaaagacgcgagatacctaccaccaccatgccgtggacgctctcataatcgccgcctcctcccaactcaacctatggaagaaacagaaaaacactctcgtttcgtactcggaagaccaacttctggacatcgaaacgggggagctcatcagtgacgacgaatacaaagaaagcgtcttcaaagcaccataccaacattttgttgacacacttaaatcgaaagagttcgaagactccatccttttcagctaccaagttgactccaaattcaatagaaaaatcagcgacgcgacaatatacgccacgcgacaagcaaaagttggaaaggacaagaaagacgaaacatacgtcctcggcaaaatcaaagacatctactcgcaaaccggctatgacgctttcatcaaaatatacaagaaagacaaatcaaaattcctcatgtaccgacacgacccgcagacattcgaaaaagtaatagaacccatattggaaaattaccccaacaaagaacttaacgaaaaagggaaggaagtcccctgcaaccccttcctaaaatataaggaagaccacggctatattcgaaaatactccaaaaagggcaatggtccggaaataaagagcctcaaatactacgactccaaactgggcaaccacattgacatcaccccgaagaactccaacaacaaagtcgtactacaaagcgtatccccatggcgggccgacgtgtactttaataaaacgacaggaaaatacgaaatccttggactaaaatatgcagatctaaaatttgaaaaaggcaccggaacgtacaaaatcagtgaagaaaagtacaatgatatcaagatcaaggaaggagttgactccgatagcgagttcaaattcacactttataaaaacgacctcctactcataaaagacaccgaaaccaaagaacagcaactcttcagattcctcagccgcacgatgcccaacgtaaaacactacgtagaactcaaaccatacgacaagcagaaatttgacgacaatgaggaacttataaaaatcctgggaatagtagcgaaaggcggacaatgcaagaaaggagtcagcaaaccaaacataagcatctacaaaatacgcaccgacgtcctagggaaccagcacatcatcaagaacgagggcgacaagcccaaactcgacttctga

SEQ ID NO: 6286 - RNA, 3384 nt, synthetic construct
  misc_feature 1..3384: note = Cas9 variant
  source 1..3384: mol_type = other RNA
atgaacggactggtcctaggcctagatatcggaatagcctccgtcggagtaggcatactcgagaaagactcgggaaaaatcatacacgctaactcacgtatctttccagcagctacagctgacaataacgtcgagcgacgaacaagtcgacaagcgcggcgactcaaccgacgcaaaaagcaccgaagcgtccgcctacacgacctcttcgaagaatacggactgctcaccgacttctccaaagtctccataaatcttaacccataccagatccgggttcaaggactcgacaagcgcttaaccaacgaagaactattcatcgccctcaagaacatcgtcaagcggcgtggtataagctacctagacgacgcctcggaagacggaggcgccgtaagttccgactacgggaaagccgtcgaagagaaccgcaagttactagctcagcaaactccaggacaaatacaactcgaccgctttgaaaagtatggccaggtccgcggagacttcacagtcgtagagaatggcgaaaagagacgccttatcaatgtcttctccaccagcgcatacagaaaagaggcggaacggattctccgcaaacagcaggagttcaacaataagatcaccgaaggctttatagaggactacctcaccatcctcactggcaaacggaagtactaccacggacccgggaacgagaaaagccgcaccgactacggccgctacaccaccaagaaagactcgcaaggagagtacatcacactcgacaatatcttcggcatcctcatcggcaaatgtaccttctacccagatgaataccgcgccagcaaagcatcctacaccgcccaagagttcaacttactcaacgacctaaacaacctcacagtcccaacagaaaccaaaaagctcagcgtcgaacagaagaaaacaatagtagagtacgccaaaacggccaaaaccctgggagcctccaccctcctaaaatatatagccaaactaatcggggtcagcgtcgaccaaatccacgggtatagaatcgaccctaacgaaaaacccgaaatgcacaccttcgaagtgtatcgcaagatgcaatccctggaaaccatccgcgtagaagaactaccacgtaaagtcatagacgaactggcccacatcttaacgctcaataccgaacgagagggcattgaggaggcaatcaacgccaagttaaaagatatattctctcaagaccaagtacttgaactcgtgcaattccgtaaaaacaattcctcactcttctcaaaaggatggcacaacttctcactgaaattaatgatggaactaattccggagctgtacgagacatcggaagaacaaatgaccatactcacgaggctgggcaaacaaaagagcaaggagactagcaaaagaacaaaatacatcgacgagaaagaactaaccgaggaaatatacaaccccgtagtcgccaaatccgtacgccaagccattaaaatcatcaacgaagccaccaaacggtacggaatcttcgacaacatagtaatcgaaatggcccgcgaaaacaacgaagaagacgcgaaaaaggaatacatcaaacgccaaaaggcaaacctggacgagaaaaatgccgctatggaaaaagccgccttccagtacaacggcaaaaaggaattaccagacaacgtattccacggccataaagaactcgccacgaagatacgtctctggcaccagcagggagaaaagtgcctctacacaggcaaaaacatccccataagcgacctcatccaaaacagatacaagtacgagatagatcacatcctccccctcagcctctccttcgacgactccctcagcaacaaagtcctagtacttgccacagccaaccaggaaaaaggacaacgaacacccttccaagccctcgactccatggattacgcttggtcatacagggagttcaaatcctacgtgaaggacagtaagctactctccaacaaaaagaaggactaccttctcactgaagaagacatctcaaaaatcgaagtaaaacaaaaattcatagaacggaacctggtcgacacacggtactcttcacgcgtagtcttgaacgccctacaggacttctacaaagaacaccaatttgacacaaccatcagcgtagtccgaggacaattcacctcgcagctccgacgcaaatggggaatcgagaagtcaagggagacataccaccaccacgcagtcgacgccctgataatagctgcaagctcccagctacgactgtggaaaaagcataacaaccccctcatctcctacaaagaggaacaattcgtagactccgagaccggagagataatctcaatgagcgacgacgaatacaaagagctcgtattcaaggcgccatatgaccacttcgtagacaccctaaaatcgaagaaattcgaggactcaatcctgttctcgtaccaagtagactcaaaatacaatcgcaagataagtgacgcaacgatatacgcgacgcggaaagccaaacttgacaaagacaagtccgaggagacgtacgtcctaggcaaaatcaaggacatctactcacaagccggttacgacaccttcatcaaaatatacaacaaagacaaatcaagatttctcatgtatcacaaagacccacagaccttcgaaaaggtcatcgaagaaatccttcgcacctaccccagcaaagaactcaacgagaaaaacaaggaggtcccgtgcaacccgttcgaaaagtaccgccaggaaaacggcccgatacgcaaatacagccgaaaaggcaacggacccgaaatcaaatccctcaaatactacgacaataaacttggcaaccatatcgacataacacccaacgagtccatgaaccaggtggtactacaaagccttaaaccctggcgcaccgacgtcttcttcaaccaccaaaccgaaaagtacgaactcatgggcctgaaatacagtgacctgaacttcgagaagggaagcggaaagtacagtatctctctcgaaaaatacaactcgatcaaaatgaacgaaggggtatcagaagagagcgagttcaaattcacactctacaaaaacgacctcatactaatcaaggacgcactaaccaaagaggcgcaaatattcagatacggatcccgaaacgacaccagcaagcactacgtagagctaaagccgtacgacatgagcaagtttgaaggcgatgaacgcctaatcaaagtcctaggcacggtcgccaaaggcggccgatgcataaaggggctaaacaagaaagacatctcaatctttaaagtcaaaacagacgtgctcggaaacaaacacttcataaagaaagagggggaagaacccaagctaaaattctga

SEQ ID NO: 6287 - RNA, 3387 nt, synthetic construct
  misc_feature 1..3387: note = Cas9 variant
  source 1..3387: mol_type = other RNA
atgaccaaactaggaaaaccatacggaatcggggtcgacataggctccaattccattgggttcgcagcagtcgacgaaaattcgcacctcatccgcctaaaaggaaagaccgtaatcggagcccgcctattcgaagaaggcaaggccgccgccaagcgacgagccggacgcaccacccgacgacgtctttcgcgaaaccgctggcgactcagcttcctacgcgacttcttcgagagtcacatcacccccaccgacccaaacttcttcatgaggcaaaagtacagcgagatatcacccaaagacaaagctagatataagtacgagaaacgcctatttaacgaccgcacagacgccgagttctaccaacaatacagcaccatgtaccacctacgaaaccgcctgatgacagacccgagtagagcggacgtccgggaaatctacttcgccatacaccacatacttaagtcccgcggacacttcctaacccccggggatgccaaagactttaacactaacgacgtcgctcttgatgaaatcttccccgcactccaagatgcgtacgcacaggtgtaccccgacttaggaataactttcgacgaagacaaggccaacgagttcaaaaccatacttctcaatgaaatcgccacctcaattgatactcaacgcgccctagtcaaactgctcctggcggaagaagacgacaaagacatactaaaacaacaaaagcaagtcctcacagagttcgcaaaagcagtcgtaggtctaaaaaccaagctaaatctcgccctaggcacagaagtcgactccagcgaagcaaccgcctggaatttttccctcggccagctcgacgataaatgggccggcatcgaatccgccatgacagacgagggcacggaaatactagaccaaatccgcgacctgtacagagccagactcttaaacggcatcgtacccactggcaaaacgctctcccaggcaaaagtggacgactacacacagcaccacgaagacctccaactattcaaggcgtacctaaaacagctcgaagacgacggcaccgccaaagccatccgacaactttacgatcgatacatagacggcgacgacgcagcccctttcctccgcgagaacttcgtaaaagccctaaccaaagacgtgaccgcccacccgaacacaaaatcacccgaactactcgaacgattagcacaaccagacttcatgctaaagcagagaaacaaagccaacggcgctatacccgtccaaatgcaacaacgagaactcgatcaaataatcaaaaaccaggccgtctactacgactggctagccgcccccaacccagttgaaaaacaccgaaagtcgatgccataccaactagatgaactactcaacttccgcataccgtactacgtagggccactcgtaaccgctaaagaacagaaggcggcgcaaggcggtgtcttcgcctggatggtgagaaaagaccctgaaggcaatataaccccatacaattttgacgaaaaagtcgaccgcgaggcctccgcaaacaccttcatccaacggatgaaaaccactgacacctacctcattggcgaagacgtactaccaaaacaatcactactataccagcgatacgaagtactaaacgaactaaacaacgtgcgtgtcaataatgaaaaattatcaatcgaacaaaaacaacaagtaatccgagaactctttgagcgccacaactccgtaaccatcaaacaattcgcagaaaacctaagagcacacggcgattacgcccacatccccgaaatccgcggcctagcagacgaaaaacgcttccttagctcgctctcaacataccgacaactcaaatcacttctccccgaagcgatagacgaccccgctaagcaagcggacattgaaaacatcatagcctggagcaccgtcttcgaagatgccgccatatttaaaacgaaactcaaagaaatttcctggctaggatccgaggccataaccaaactaagcaacattcgatatcgcgggtgggggcaattcagccgaaaattcttgaacggccttacactgggcaacgggcataccatcattcaagagctgctcctctcaacaaacaacttgatgcaaatactgaccgacgaaaccctccaaaagaaaatgactgaactcaacgccgacaaactaaaaaccgcaaatatcaacgacgcaatagataacgcctacaccagcccttcaaacaagaaagccctacgccaagtactccgagtcgtcgatgatataaaaagagccgctgatggccaagaccccagctggctatacgtggagacagcagacggcggcggtacccccggcaaacgaacaagagcacgtcaacaccagctacaggaaatatacgcaaacgcagcccacgaactcatcgacaccgccgtacgaggcgaactcgaagacaaaatcagtgacaaggcagacttcaacgaccgtctagtcctctacttcatgcagggaggccgtgacatctatacaggcgcacccctcaacatcgaccaactcagctcatacgacatcgaccacattctcccccagtccctcattaaagacaactcactggacaaccgcgtcctcgtacacgccataatcaaccgggagaaaaacgccaccttcgccagcaccatctacgcccagaaaatgaacgccacctggcgacagtggcacgaagcaggactcatatcgggaagaaaacttagaaatctccaaatgcgccctgaccagatcgataagtacgcctccggcttcgtcgccagacagctagtggaaacacgtcaaatcatcaagctcactgaacaaatagtagccgcacagtacccagacaccaaaatcatagccgtaaaagccgggttatcgcaccaacttcgagaggaactggagttccccaaaaatcgcgacgtcaaccactaccaccatgccttcgacgcattccttgcagcccgcatcggaacctacctcctcaaaaggttccccaacctccaagccttcttcacctacggcaaatttaccaaggccgacgtcaaaaagctccgaggcttcaacttcataagagacatcacacacgcggaagacaaaatcgtagcgaaagacactggcgaagtagtatgggacaaacaaagggatgtagacgaacttgacagaatctacaatttcaagcgcatgctcatcacccacgaagtccgcttcgaaacagcagacctcttcaagcaaaccgtatacggggcccgagactcaaaagaggcaggaggctccaaacaacttatccccaagaaaaaggacatccaactaatcttcatgggcgcgatctccgaaagaacacgacccatcctaccactatga

SEQ ID NO: 6288 - RNA, 3387 nt, synthetic construct
  misc_feature 1..3387: note = Cas9 variant
  source 1..3387: mol_type = other RNA
atggacgagaaaatggactaccgcataggactggacattggaatagcaagcgtaggctgggccgtcctccagaacaacagcgacgacgaaccagtcagaatagtagacctgggagtgagaatcttcgacacggcagaaattccaaagactggagaaagtctcgccggacccaggagggcagcgagaacaacaaggagacgcctaagacgacgaaaacacagattagatcgaatcaaatggctattcgaaaaccaaggcttaataaacatcgacgacttcctcaagagatataacatggctggcctaccagacgtctatcaactccgatacgaagcattagacagaaagctaactgacgaggaactagcccaggtactgctacacatcgcaaaacacagaggattccgcagcacccgaaaagcagagacagccgcgaaagagaacggagcggtccttaaagccaccgacgaaaaccaaaagcgaatgcaggaaaaaggctaccggaccgtaggcgaaatgatctacctagacgaagcattccgcatagggtgcagctggtccgaaaaaggatacattctaaccccaaggaacaaggccgagaactaccagcacacaatgctgcgagcaatgctcgtggaagaagtcaaagaaatcttcagcagccaaaggaggctggggaataaaaaggcgaccgaggaactggaggagaaatatctggaaatcatgactagccaacgatcctttgacctgggcccgggaatgcaacccgacggaaaacccagtccctacgccatggagggcttcagcgatagggtaggcaaatgcacctttctgggggaccaaggcgaattaagaggcgcaaaaggaacatacacggccgaatactttgtcgcgctccagaaaatcaaccacacgaagctcgtcaaccaagatggcgagacacgaaacttcacagaagaagaacgaagggccctaacactcctcctcttcacgcaaaaagaagtcaaatatgcggccgtacgaaagaaactcggactgccagaggacatcctattctacaacctcaattacaagaaagccgcgaccaaagaggaacaacaaaaggaaaaccagaatacggaaaaagctaagttcataggcatgccatactaccacgactacaaaaagtgcctcgaagaaagagtcaaatacctaacagaaaacgaggtacgcgacctcttcgacgaaataggcatgatcctaacctgctacaagaacgacgactccagaacggaacgcctcgcgaagctagggctggtcccgatcgaaatggaaggcctcctcgcatacacacccaccaaattccaacacctgagcatgaaagccatgcggaacatcatccccttccttgagaaaggaatgacatacgacaaagcatgcgaggaagccggatacgattttaaggccgactcaaaggggaccaagcaaaaactactaacgggagagaatgtaaaccaaaccatcaacgagatcacgaacccggtagtgaaacgcagcgtctcacaaaccgtcaaggtaataaacgcaattataagaacatacgggagtccacaagcaatcaacatcgaactcgcaagggaaatgtccaaaacattcgaagaaagaagaaaaataaaaggagacatggagaagcggcagaaaaacaacgaagatgtcaagaaacaaatccaagagctcggtaaactgagcccgaccgggcaggacatactaaaatacagactatggcaagagcaacaagggatctgcatgtactcggggaaaaccatacccttagaggaactattcaagcccggatacgacatcgaccacatcctcccatactccatcaccttcgacgacagcttccgaaacaaggtactggtaaccagccaagaaaacagacaaaaaggcaatcgtacaccctacgaatacatgggaaacgacgaacaacgctggaacgagttcgaaacccgagtcaagacaacgatacgggactacaaaaagcaacagaaactactcaaaaagcatttctcagaagaagaacgcagcgagttcaaagaaagaaatctcacagacaccaaatacatcaccacagtcatttacaacatgatacgccaaaacctagaaatggccccgctcaacagaccagaaaagaaaaagcaggtaagagcagtaaacggggccataaccgcctacctccgaaaaagatggggactcccacaaaagaacagagaaacagacacacaccacgccatggacgcggtagtcatagcatgttgcacagacggtatgatccagaaaataagtcggtacacgaaggtacgagaacgatgttactccaaaggaacagagttcgtggacgccgaaaccggggaaatcttcagaccagaagactacagcagagcggaatgggacgagatctttggggtgcacatccccaaaccctgggagacattccgcgcggaactcgacgtacggatgggagacgaccccaaaggctttctagacacccactcggacgtagccctagaactagattacccagaatacatctacgaaaacctacgacccatattcgtaagccgcatgccaaatcacaaggtaacaggagccgcacacgcggacaccatcagaagcccaaggcacttcaaagatgaaggaatagtattaacaaaaaccgccctcaccgacctaaaactggataaagacggtgaaatagacggatactacaacccacagtctgacctgctcctgtacgaagcattaaagaaacaactgctattatatggtaacgacgctaagaaagccttcgcccaagacttccacaaaccaaaagccgacggaaccgaaggaccggtggtccggaaagtaaagatccaaaagaaacaaacaatgggagtgttcgtcgacagcggaaacggaatcgcagaaaacggcggtatggtgcgaatcgacgtcttccgagtcaacgggaaatattacttcgtgcctgtatacacagccgacgtagtcaagaaagtactaccaaaccgcgcgagcaccgccaataaaccgtacagtgagtggcggacgatggaagacaaggacttccttttcagcctgtactcacgggacctagtgcacataaaaagcaagaaaggaataccgatcaaaaacgtcgacggcagcctcggcgaatccaaagaagtatacgcatactacataggcgcggacataagtggggccaaaatagaagggaaagcccacgacagcagatacaccttccgagggataggcgtgcaaaaattagagttgatcgaaaaatgccaagtcgacatactcggccacatatccacagtcaaaaacgaaaagaggatggggttttcatga

SEQ ID NO: 6289 - RNA, 3387 nt, synthetic construct
  misc_feature 1..3387: note = Cas9 variant
  source 1..3387: mol_type = other RNA
atgaacgacaaaaaccaaaaataccgactagggctcgacctcggcacaaatagcataggatggtgcatatacagcctggacgtcaacaacaaaccagaaacgctgatcgacatgggtgtaagaatcttctccgacggccgggacccaaaaaccaaagaaccactcgctgtggaacggcgaaccgcacggggacttcgccggatactacaccgcaggaagctgcgcagaagacagatgttccggctactacaagagcagggcctcatgccaaacgacgctagcgaggcagcagcactcaagtccctcaatccatacgaacttagggtaaaagcacttgacacgaaactggaaccgtacgaactcggacgcgctttattcaacctaagtgtacgcagaggattcaaaagcaaccgcaaggaagccgttcaagaaaaggagaaagatagccaaaacgacgccaaatcacagaacgagaaatgcgaacacctcgcaaaggccatcaaagacagcggttgtaggaccctcggagagttcctgtggaagcacaagaataccgaaacacaacaaacagaaaatgatgcccgcaacataggaatgcgtttcgtccccggccgctcaaactactaccccacccgccggatgtacgtagaagagttcgatgcaatacgtaaagcacaagaaccctactactcgggcgtaaactgggacgcactacacgaaaaactattctaccaacggcccctccgcgcccaggaacgcggcaagtgtcgctacatgccagacaaagaaagaacattcaaagccatgccctgcagccagaagataaggatcctccaagaagtgtacaacatggactacatagacgaatacggcaaaacaataccactcgaagaagcgcagaccgacagcctaatcagcctactagacaaacgcgaaaaactcagcttcaaagcaatgaaaaaggaactaggcatcgacgaatcgtgcacctttaacctcgagcgcggcgggcgggaatacctacaaggtaacgcagcggcagtgaaactccgcaacaagaaacggttcggagaactgtgggactcactaagcctcgccaaacaagacgcaatagtcgaaaaattaataacagccgacgaggatgccgaaatcatcagtatgctcgcccaatacaatctaacagacgaacaaaagaagaacatcgccgtgaccgtactaccttcgggcacagcaatgctttgcaaagaggtgacagaaatgctcgtacaaaagatggaacagaacaaaatacctctaaccgtagcggtacagatgctcggttacacctacgctgaccagagcgtacgcgaagaagacacactaccctattacggcgccatcctaacaggcagcacaatgggcgcacacccagaagccgacgagtccgaacccgagctcaaatacggcaaaataagtaacccgacagtacacgtagcactcaaccagacccgaaccgtcgtaaacgccctcatcaaagcgtacggcaaaccccagcagatcgttgtggaactctcccgagacctcaaggcatcccgcgaagcaaaagcacgcatacagaaaacaatcacaatgaaccaaaaacgcaatgaacgagacaacaaaaacatcaccgacatcaccaaaattccgtaccccaaccggaacgaccgactgaagtatcgcctgtgggaagaactgggatcgggaagcaactccttctcccgtaagtgcctctactgcggaaagcctataagcggctccgaaatattcaccgaaaacatagaaatcgagcacatcctcccgttcggacgaaccctcttcgacggcgaaaccaacaaaaccgtggcccacaccgattgcaaccgagacaaaggagacaggagcccattcgaggccttcgggtcctcaccaaacggatacaactggcacgaaatatgtgcccgagccaacagccttaaaaaccccgccaaaagaacactattcgcagaaaacgcaatggaaaaattcgagaaggacaactcattcatccaaaggcaactcacggacaatgcctatctatcacgcagtgcccttcgctatctgcgctgcatctgcaaagacgtctggtcaatcaacggcgggatgacaaaactcttacgagacaagtggaatattgactccatactcaagcgaaaaatagacgacccagaaatcgcccacttcgaactcaaaaacgatcaaatagggcaatacaagaaaaaccggtacgaccacaggcaccacgccctagacgccagcgtaatcgccctaatcgacagggccatggtacaagaaataagccaactcaacaaaatccgcctgaaaaaccgaatagaggcaccccaaatgccagtcctaagaagcgagctaatcgagaaagtgaaacacataacagtatcattcaaaccggatcacggcagacaagggaagctatcaaaggaaaccctgctgggcaaaattaaaaagatagaaaaggtcgacatcgactctatccaaaccgacgacatcgcaagcataaaagatgacgcgatacgaacgagattcgagaccaagcggcgagaactcggcgatatcacaaaggcgaaggcagccctcaaaaccgagttccctaaactcgacgttttcaaaacctattacgtcagccgcacgccgatcgtgagcctaacggagaaaaacatcaacagcatcgtcgacgagaaaatcaaagaaaagctaaaaaccttcattaaggaacacgcagacctgtcattcgccgagcaactacaaaaattctcagaaacagagtggataggaaaaccatcagccgccgggaaaccgggcaagaaatatcgaatcgaaaaagtacgatgtataaactggggccaaaccccgataacaatcacctccagcgcggtaccccgatacctctgcccagaggactatctggccgcagtagtctggcagattcccagcaagaagaaagacaccgaacccgaatataaagccaccttcctccgaagagacgagttcgacgtaaacaacaaaccaaagaaactcgaaaaaccacatgacgcagcccaatacatctgcatgctgtacaaggacgactacctggagttcacggaatcaggtgcgacacacctctgcaggatcgcaggactaccagcatcccaaaacaacaaaatcgacatcagaccaatctacgcggtctccgattgcaaagactggatcatcgcaaccaacgaaaacatgctagagccatgttggaagccccaaaaagaagagaaaagaatcagcgtaaacgttctcttcggcaaacacaaagcgcgatcggtcaccgtaaacccgatcggcagagtctttaggaaatga

SEQ ID NO: 6290 - RNA, 3387 nt, synthetic construct
  misc_feature 1..3387: note = Cas9 variant
  source 1..3387: mol_type = other RNA
atgagcgacctagtgctcggactagacatcggaattggctcagtcggcgttggaatcctcaacaaagtaacgggcgaaatcatacataaaaacagccgaatcttccccgccgcccaggctgaaaacaacgtcgaacgacgaaccaaccgacaaggacgcagactaacacgcagaaagaaacatcgccgggtacgactaaaccatctattcgaggaaagcggactgataaccgatttcaccaaagtcagcatcaacctcaacccataccaactccgggttaagggactcatagacgaactcagcaacgaagaacttttcatagccctgaaaaacatggttaagcaccgcgggatatcatatctagacgacgcgagcgacgacggcaattcctctgtcggcgactatgcccaaatcgtgaaagaaaactccaaacaacttgagacaaaaaccccgggacaaatccaacttgaacggtaccaaaaatacggccagctgagaggagacttcactgtggaggaagacgggaaaaagcaccgcctaatcaacgtattcccaacaagcgcctaccgcagcgaagccctccgcatattacaaacacaaaaagaatttaacccccaaataacagacgagttcatcaaccgctatctggaaattctaacaggcaagcggaaatactaccatggcccaggcaacgagaaaagcagaacggattacgggcgctacaccacaaagaaagacagcgaaaacgaatacattacacttgacaacatcttcggcatcctcataggaaaatgcaccttctacccagaggaatacagagccgccaaagccagctacacagcccaggagttcaacctcctaaacgacctcaacaacctaacggtacccactgaaaccaagaaacttagtgaggaacagaaaaatcaaatcatcaactacgtcaaaaacgaaaaagccatgggtccggcaaaactcttcaaatacatagccaaacttctctcatgcgacgtcgccgacataaaaggataccgcatcgataaatccgacaaagccgaaatacataccttcgaagcctaccgtaaaatgaaaaccttagaaacaatcgatttcgagaaaatgtcccgagatcaattagacaaattagcctacgtcctcacactgaacacggagcgtgaagggatccaagaggccctagaccacgagttcgcggacggaaacttcagccaagaacaaatcgacgagctggtccaattccggaaagcgaactcaagcatattcggaaaaggatggcacaacttctcagtcaaactcatgatggaactcatcccagaattgtacgccaccagtgaggagcaaatgacaatactcacccggctcggcaagcagaaaacaacaagctctagcaacaagaccaaatatatagatgaaaagctactgacagaagagatctataaccccgtcgtggcaaaatcggtacgtcaagccatcaaaatcgtcaatgcagcaataaaggaatacggcgacttcgacaacattgtcatagaaatggcaagggaaaccaacgaggacgacgagaagaaagccatacagaaaatccaaaaagctaacaaagacgagaaagacgccgcaatgctaaaagcggccaaccaatacaatggcagagcagagctaccccactcggtcttccatggacacaagcaactcgcaacgaaaattcgcctgtggcaccaacaaggagaacgctgtctctataccggcaaaaccatctcgatacacgacctgatcaacaacccaaaccagttcgaaatagaccacatcctaccgctctcgatcacctttgacgactccctagccaacaaagtcctagtctacgccacggccaaccaggaaaaagggcaacggacaccctatcaggccctagacagcatggacgacgcctggtccttccgggagctcaaagcattcgtacgagagtcaaagtccctctcaaacaaaaagaaggaatacctactaactgaagaagacataagtcgtttcgatgtacgcaagaaattcatagagcgcaacctagtagacacccgctatgcctcccgggtcgtacttaacgcgctacaagagcacttccgcgcacacaaaaccgatacaaaagtgtccgtggtacggggccaattcactagccagctccgccgccactggggaatagaaaagaccagggacacgtaccaccaccacgccgtagacgccctaataatagccgcaagcagccaactcaacctatggaagaaacagaaaaacaccctcgtcaactactcagaaaaccaactactcgacatcgaaacaggcgaactcatcagcgacgacgaatacaaagaaagtgtattcaaagccccctaccaacacttcgtcgacacactaaaatccaaagagttcgaggacagcatcctcttcagttaccaagtcgattcgaaatttaaccgaaaaatatcagacgccaccatctacgccacgcgccaagccaaagtcggcaaagacaagaaggacgaaacctacgtcctcggcaagataaaagacatctactcccaaacgggatatgacgcattcatcaaaatttaccagaaagacaagagcaaatttctcatgtaccgtcacgacccccaaacattcgagaaagtaatcgaacccatcctggaaaactacccgaacaaagagatgaacgaaaaaggcaaagaggtaccctgcaacccgttcctaaagtacaaagaggaacacggcgattacatccgaaaatactcaaagaaaggcaacggcccagaaatcaaatcgcttaagtactatgactcaaagctaggcaaccacatcgacataaccccaaaagactccaacaacaaagtcgtactccaaagcgtatccccatggagagcggacgtctacttcaacaaaaccaccggaaaatacgagatactcggcctgaaatacgccgacctgcaattcgaaaaaggcaccggaacctacaaaatcagccaggaaaaatataacgtcatcaaaaagaaagagggagtcgactccgactctgagtttaaatttacactctacaaaaacgacttactactaataaaagacactgaaaccaaggaacaacaactcttcagattcctatcccgaacaaaacccaacgtaaaacactacgtcgaactcaaaccgtacgacaagcaaaagttcgagggcaacgagtcgctgatcaacgtcttgggcgccgtagcaaaaggtggacaatgtcagaaaggcatcaacaagcccaacataagcatatacaaggtgagaacagacgtcctcggcaaccaacatatcatcaaaaacgaaggcgataaaccaaaactagatttctga

SEQ ID NO: 6291 - RNA, 3387 nt, synthetic construct
  misc_feature 1..3387: note = Cas9 variant
  source 1..3387: mol_type = other RNA
atggacgagaagatggactaccgaatagggctagacatcgggatcgcctccgtaggctgggccgtactacagaacaacagcgacgacgaacccgtacgaatagtagacctaggagtacgaattttcgacacagcagaaatacccaaaactggcgaaagcctagccggacccagacgcgcggcaaggacaacacgccgccgcctcaggcggcgcaaacaccgactagaccgaatcaagtggcttttcgagaaccaaggcctcatcaacatagacgacttcctaaaaaggtacaatatggccggcctccccgacgtatatcagcttcgatacgaagcgctggacagaaagctcacagacgaggaactagcacaagtcctgttacacatcgccaagcaccgaggttttagatccacacgaaaggctgagaccgccgcaaaggaaaatggggccgtcctaaaagccacggacgaaaaccaaaagagaatgcaggaaaagggataccggaccgtcggagaaatgatctacctcgacgaggctttccggacgggatgttcctggagcgaaaaagggtacatacttacaccccggaacaaagcagaaaactaccagcacaccatgctccgtgccatgctcgtagaagaagtcaaggaaatattcagcagccagaggcgcctaggcaacgagaaagcgacagaagaactggaggaaaaatacctagaaataatgacgagccaacgatcattcgacctagggccaggcatgcaaccagatggaaaaccgagcccgtacgccatggagggcttctccgatagagttggaaagtgcactttcttgggcgaccaaggagaactcagaggggcaaaaggaacatacacagcagagtacttcgtcgcgctgcaaaagataaaccacacgaaactcgtcaaccaggacggtgaaacgcggaacttcacagaagaggagcgccgcgcactgaccctacttcttttcacgcaaaaggaagtaaaatacgctgcagtaagaaagaaactaggcctcccagaagacatactcttctacaacctgaattacaagaaggcagcgaccaaagaggaacagcaaaaggaaaatcaaaacacagaaaaggctaaattcatcggaatgccctactaccacgactacaagaaatgcctcgaagaacgggtcaaatacctgacggaaaatgaggtgagagacttattcgatgaaatcggcacgatcctaacctgctacaagaacgacgactcgcgaacagaacggctcgccaagctcggcctagtaccgatagaaatggaaggcctcctggcctataccccaacgaaattccaacacttatccatgaaggcgatgagaaacataatacccttcctcgagaaaggcatgacatacgacaaagcctgcgaagaagccggatacgacttcaaagccgactccaagggaatcaagcagaaacttctgaccggcgaaaaagtaaaccagacgatcaacgagatcacgaaccccgtggtaaaaaggagcgtatcgcagactgtgaaagttatcaacgcgatcattcgaacgtacggctctccgcaagccatcaacatcgaactcgcacgagaaatgagcaaaacattcgaagaacgccgcaaaataaaaggagacatggagaagaggcagaagaacaacgaagatgtcaagaaacaaatacaggaactggggaaactctcgccaactgggcaagacatcctaaaatacagactctggcaagaacaacaaggtatatgcatgtactcgggcaagacgatccccctagaggagctattcaagccgggatacgacatagaccacatcctaccatacagcataaccttcgacgactccttccgtaacaaagtcttagtcacctcacaggaaaacaggcagaaaggcaaccgcaccccatatgagtacatgggcaacgacgaacagcgctggaacgagttcgaaacaagagtcaagaccaccatacgagactacaaaaagcagcaaaaacttctcaagaaacacttctcagaagaagagagaagcgagttcaaagaaagaaacctgactgatacaaaatacataacgacggtcatatacaacatgatccgacagaacctagagatggcaccactaaaccgaccagaaaagaagaaacaagtcagggcagtgaacggcgccatcacggcctacctacggaaacgctggggattaccgcagaaaaaccgcgaaacagacacccaccacgccatggacgcagtcgtaatagcatgctgcaccgacggcatgatccagaaaatatcacgctacaccaaagtccgggagagatgctacagtaaaggaaccgagttcgtcgatgccgaaacgggggagatcttccggccagaagactactcacgggcagaatgggacgaaatcttcggagtacacatccccaaaccctgggaaaccttcagagccgagctagacgtccgcatgggcgacgaccctaaaggtttcctggacacacacagcgacgtagcgctagaactcgactacccagaatacatatacgaaaacctaaggcccatcttcgtgagccgaatgcccaaccataaggtcacaggagcagcccacgcggacacaatacgctcaccgcgacatttcaaggacgaaggaatagtactaaccaaaacagcactaaccgacctgaagctggacaaagacggcgaaatcgatgggtactataacccgcaaagcgacctgctactgtacgaagcactcaaaaagcaactcctcctgtacggaaacgacgcaaagaaagccttcgcgcaggacttccacaaacccaaagcggacggcaccgagggaccagtagtacgaaaagttaaaatccagaagaaacagaccatgggagtcttcgtcgacagtgggaacggaatcgcggaaaacggaggcatggtgcgaatagacgtctttcacgtaaacgggaagtactacttcgtgccagtatacacagcggacgtcgtaaagaaagtgctacccaaccgcgcagcgacagcccacaaaccatacggcgagtggaaagtaatggaagacaaggactttctgttcagcctatactcccgggacctgatacacataaaatccaagaaagacatccccatcaaaatggtaaatggcggaatggagggcatcaaagaaacctacgcctattatataggcgccgacatcagcgcggccaacatacaagggatagcgcacgacagcaggtacaagttcagaggactaggcatccaatctctagacgtcctagagaaatgccagatcgacgtcctgggacacgtcagcgtggtacgatcagaaaaacgaatggggttcagctga

SEQ ID NO: 6292 - RNA, 3387 nt, synthetic construct
  misc_feature 1..3387: note = Cas9 variant
  source 1..3387: mol_type = other RNA
atgtctgacctggtcctcggcctggacatcggcataggctccgtcggcgtaggtatactcaacaaagtgaccggcgaaatcgtccacaagaacgcccgcatattccctgccgcccaagccgaaaacaacgtcgaacgccgcaccaaccgccaaggacgaagactcacccgtcgcaagaaacaccgacgcgtccgactcaaccacatattcgaagaatccggcttaataacggacttcacaaaagtctcgataaacctgaacccctatcagctccgggtcaaaggcttaacggacgaacttagcaacgaagaactcttcattgccctcaaaaacatggtcaaacacagagggatatcatacttagacgacgcctccgacgacggcaattcctcagtcggcgactacgcacaaatcgtcaaggagaactcaaaacaattagaaacaaaaaccccggggcaaatccaattagaacgataccaaaaatacggccaactgcgcggcgacttcaccatcgaggaggacggcaaaaagcaccgcctaataaatgtattcccaacaagtgcctacagggccgaggccctcagaatactccagacacaacaagaatttaacccacagatcaccgacgagttcataaattcctacctacaaatcctaaccgggaaacgcaaatactaccacggtcccggcaacgaaaaatcccgcaccgactacggacgatacaccacaaagaaagactctgaagatgaatacatcactctagataacatcttcggcatcctcatcggcaaatgcaccttctatccagaagaataccgggccgccaaagcatcatacacagcccaagagttcaacctcctcaacgacctcaacaacctcaccgtcccaaccgagacgaagaaactatcagaggaacagaaaaatcagatcataacatacgtcaaaaatgaaaaagccatgggtcccgcaaaactcttcaaatacatagcaaaactcctcgcctgcgacgtcgcagacataaaaggctacaggatcgacaagtcggacaagcccgaaatacacacattcgaagcctaccgcaaaatgaaaaccctcgaaaccatcgacgtagaacagatggaaagagaaaaactagacaagctcgcctacgttctcacactaaacacagaaagggaaggcatacaggaagctatcgaacacgagttttctgacggcacgttctcccaagaacaagtggatgagctcgtacagttccggaagtcaaactcttccatctttggcaagggatggcataacttcagcgtcaagctgatgatggaactcattccagagctatacgcaaccagtgaggaacagatgaccatactgacacgccttggcaagcaaaaacgcacgagcagcagcaacaaaaccaaatatatagatgagaaaaggctcacagaagaaatctacaatccagtagtggccaagtccgtgcgccaggctattaagatcgtcaacgcagccatcaaggaatacggggacttcgacaacatagtaattgagatggcccgcgaaatgaacgaggacgacgaaaagaaagcgatcaaaaagatacaagaggccaacaaatcagaaaaagacgccgctatgcgtaaagccgcaaatcaatacaacggcaaagcagaactcccccacagcgtcttccacgggcataaacaactcgccaccaagatccgcttatggcaccaacagggggaacgatgcctatacacaggcaagacgatctccatacatgacctgatcaacaaccccaaccagttcgagatcgatcacatcctcccgctatccatcacgttcgacgactccctagccaacaaggtactcgtatacgctacagccaaccaggaaaaaggacagcgcacaccctaccaggctctagacagcatggacgacgcatggagcttccgcgagctaaaggccttcgtccgggaatccaagacacttagcaacaagaaaaaggagtacttactgaccgaggaagacatcagtaaattcgatgtacgcaagaaattcatcgaacgtaacctcgtggacacacggtacgcatcgcgcgtagtcctcaatgcactccaagagcacttccgcgccaggaaaatcgataccaaagtgtcagtagtccgaggacagtttacctctcaactaagaagacactggggaatcgacaaaaccagagacacctaccaccaccacgccgtggacgcactaataatagcggctagctcccaactcaacctctggaaaaagcagaagaacaccctagtttcttactccgaagaccaactgcttgacatagaaacaggagagctgattagcgatgacgaatacaaagaatccgttttcaaagcgccctaccaacacttcgtcgatacattaaaatcaaaagagttcgaagacagcatactcttctcttaccaagtcgatagcaaattcaaccgaaaaatatcagacgccaccatctacgccacccgccaagcaaaggtgggaaaggacaagaaagacgaaacatacgtcctcggaaaaataaaagacatatacagccaagccggctacgacgcattcatcaaaatataccagaaagacaaatccaaattcctaatgtaccgccatgacccccaaacattcgaaaaggtaatagagccaatcctcgaaaactaccccaataaagaaatgaacgaaaagggtaaggaagtaccttgcaaccccttcctcaaatacaaagaggaacacggagactacatccgaaaatactcgaagaagggcaacggacccgaaattaaatccctaaaatactacgactcgaaactaggcaaccacatagacataaccccaaagaacagcaacaacaaggtcgtgctccaatcagtctcgccatggcgtgcggatgtatacttcaacaaaacgacgggaaagtacgaaatactcggactcaaatacgccgatctacaattcgaaaaaggtacagggacctataaaatctcccaagaaaagtacaacgatatcaagaagaaagagggcgtagattcagactcagagttcaaattcacgctatacaaaaacgacctactcctcatcaaagatacagaaaccaaagaacaacaactcttccgatttctatcccgctcaatgcccaacaagaaacactacgtcgaactgaagccctactccaaagataaattcgagaaaaacgaaacccttatcgaaatactaggccccacggacaaatcaggtcgttgcataaaaggcctcgccaaatcaaacctgagcatcttcaaggtacgtactgatatcctaggaaaccagcatatcatcaaaaacgaaggcgacaagcccaagctcgacttctga

SEQ ID NO: 6293 - RNA, 3387 nt, synthetic construct
  misc_feature 1..3387: note = Cas9 variant
  source 1..3387: mol_type = other RNA
atgaccaagattttaggtctcgacttgggcaccaactccatcgggtgggcagtcgtagacgaaaagaaagagaaaatcctaggaatgggctcccgtatcttcccggaaggcgtcgtcaatatcggggaaggagagggcagagaaaccagcaaaaacgcaagccgcaccgacgccagggggacccgccggcaattcttccgaagacgcctaagaaaacgatacctcctacgtgaactcgccaagaaaggtctatgcccaatcaactacacactggtaaaagaatggaacgaggcccaaatcttcaaaaacaaacagctccaagaatggttcaagctcaacccgtacgaactccggagcaaggccatacaggagaaaatttccctcgaagaactaggccgaatcttctaccacttcatccaacgaagaggcttccagtccaacagcagatccgcaggagtcgacaacatagaaaagagcgttattttcaaaggcgacacgaaaaccggcaagatcggaatctccgagacactcgaatcgatcaagaacaccaaaaccctaggctcgtacctccacaccatctacccgaaacagaataagccatatagcggacacaaggagagaatccgaaaccggtacacaacccgccagatgtacatctacgagttcgaaaccatctgggaataccagaaacaattctacagcgagctcagcaacgagcttaagaccgtgctgggcggacgaaagaaagacggctacaaagaagacggcatattattccaccagcggccactgcgaagccaaaaacacctggtgggctactgcagcttcgaaccaaagaagaccaaatgtcaaattaacaccatcccatttgagctattccggatctaccaatgggtgaacaccgtcgactgcaacgaaaaggtcacctcagaagaccgcggaaaaatggtcgagcttctgctgagcaaggagaaagtctccttcaaggaaatccgcaaagtcatcaacaaatcggatggatactaccaattcaattacaaaaacgacgacaaaatcgtaggctcatataccatctccaacctgagcaacaagaaattcttcggaaagaaatggtttgacttctctgacaaagagcaggaagacatctggcacgtcctctcattcttcgacgaccgagacaaactcaaacaatatgcaatcaagtactggggattcaacgaggaaaaggcagtcaaaatctcgaaatttaacctaaaggaagggtactccaacttaagcagaaaagcaatacacaacatcctcccattcttgaaactaggcttcatgtacgacgtcgcggtgggcctcggcggcgtcaagaacgccctcgcggacaagtggatagaaaatgaacagttcatcctcgataacgtgccatcagtggtgcgctcaaacttcaagggcggatacatagaaccactcaaacaaatgctaaaatacgaatttgacgtcagcgacaagcaactgctaaaactctaccatcacagctccgccatagaaaccaccgaactactcaagaaattgcccatcaacagcgaggccgacaaagaaatacaatcgatcaaaaacccggtagtaataacagcattatttgaaataaggaaactcgtcaacgaaatcatagacacctacggaaaattcgacgaaattaaggtcgagctggcaagggacctcaaagcctcaaaaagcaagcggtacgacacccgccgcgaacaactacgcttggagaaagagaacgacaggatcaaaatagaactcgaaaacctcggccagcgaatcaaccacataacaattctgaaatacaagctatgggaagaatgcgacaaacgatgcccattcaccgggaaaaatatcgaagtaaacgaactatttagcggcgaagtacagatcgagcacatcttcccctggtctcgctcactaaacgactccttcatgaacaaaaccctctgctttgcagacgaaaaccgcgctaaaggcaacaagacaccatatgagttctacagcgaacaaggagaacaaaaatgggaggaaataaaaatacaagccctctcatgctttaaaaacaaaccaaattacccaaacgcataccaaaaattcaaacaattcgtaaagaagaaacacgatgaagacttcataagcagacagctcaacgacacacgctacatcagcaaagaagcgaagaactacctctcaaagatctgcaacaacgtccaagtcgcacccggacagatgaccgccacactccggcacaaatgggggctgaacacgatactgaacaaagacgacgacacaaagacgcgtgacgaccaccgacaccacgcaatcgacgccctagtaatggcatgcagcactcggtcacacctccaagagctcagcaaacgcaaccgttaccaaaaagactacgagttcaaggacttcccgatgccttggcaattcttccggcaagacgccgagaaaagcgtagaacaaatcctcgtatcacacaagaaacttaacaccatactcacggtccgcacacacaaaaccaaaaagaacggggtagtctataaaaacatcggagtagccgcgcgcggacaactgcacaaggaaacagtattcggcaaaagaacagccccggacggaatcgaagcctatcacgtccggaaaccgatagaatccctcagtactcacaagcacataaacaaagtcgtcgacgaaaccatccggctcctaatactcaaacaagtaaacaagctagggggattcgtcaagggaaaaatacctgaaggcaccttctacaacaccgacgagaatggaaacaaacaaccacagatcttcctgcccaataaaaacggcaatccggtcccaataaagaaaatacgcctgagagagaacataggcggagcggaacaactaaaatcaaccgtaaaccagcacgtcaacccacgctccaaccaccacgtcctaatatacaaagacttcgatgacaatctcaaagagaaagtcgtaactttctggaccgccgtcgaacggaaaaagcaaaaacaagccgtctttcaactcccggaaaacggaaaagagattgtaaccaccctccagattaacgatatgttcctactaggactgaaggacgacgagatcaactgggagcacccaaaattcaccctcctcaaggaacacctgtaccgagtccaaaaattcacctccggagactactacttccgcaaacacatcgaaagcaatctgaacggcgaactcgggaaggcctaccagtacattaaaggattcggagaaggcaaaacaggctggaagacgttcaaccccatcaagatcaaggtgagcgtcagcggcaaaattgagaaagtctga

SEQ ID NO: 6294 - RNA, 3390 nt, synthetic construct
  misc_feature 1..3390: note = Cas9 variant
  source 1..3390: mol_type = other RNA
atgaacggtttagtgctaggcctggatattggaatcgcgtcagtgggcgccggcatcctaaagaaagatacgggcgagataatacacgcgaactcgcgactgttccccgctgccacagcagataacaacgtactgcgacgctcgtccaggcaggctcgccgaagtacacgacgcaaacgccaccgtgcggttcgcctacacgacctattcgaagattacggactgctaacggacttctccaaagtatccataaatctcaacccctacaaactccgcgtcgagggcatggacatacaactcacgacagaagaactcttcatcgccctcaaaaacatcataaaacgccggggcatatcttacctcgatgacgccagcgaagacggcgtcacggtctcgtccgactacgggaaagcagtagaggaaaaccgcaagctccttagtgaacagacgccaggacaaatacagctagaacgcttcgagaagtacggtcaggtgaggggagacttcacggtagaagaaaatggcgaaaaacgccgactaataaacgtcttctcaaccagcacataccgaaaggaggccgaacgaatcctccgcaaacaacaggagttcaacaacaaaataacggacgacttcatcgacgactatctcacaatactcaccgggaaaagaaagtactatcatgggcctggcaacaaaaagtcccgaaccgactacggccggtacacaaccaagaaagactcagaagggaaatacataacgctagacaacatcttcggcgttctaattggaaaatgcaccttctacccagacgaataccgagcctcaaaggcctcttacacagcacaagagttcaacctactcaacgacctaaacaacctaaccgtaccaaccgaaaccaaaaagctgtccgaaaaacaaaagaagacaatcgtagagtacgctaaaacggccaagaccctgggcgcgtccacgcttctcaaatacatcgcgaagatggtagacgccagcgtcgaccaaatccacggctaccgagttgacgtgaacaagaaacccgagatgcacacgttcgacgtctaccggaaaatgcagtcactggagaccttcaacgtaaatgaaatgccccgggaagtgctagacgaactcgcacacatcctcaccctaaacacagagcgggaaggcatcgaggaagccataaacacgaaactcaagggcaccttcaaccaagaccaagtgctcgaactcgttcaattccgaaagaacaacagctccctcttttccaaaggctggcacaacttctcactaaaactcatgatggaactcatacccgaactatacgccacttcagaagaacaaatgaccatacttaccaggctaggcaaacagaaaagcaaggaaatatccaagcgcaccaaatatatagatgagaaagagatcacggaagagatctacaatccggtcgtagcaaagtccgtccgccaagcaataaaaatcataaatgaggccacaaagcaatatggcatcttcgaccacatagtgatcgaaatggcccgcctcacaaatgaggaggacgcaaagaaagactatataaaaaggcaaaaagctaacctagacgagaaaaacgccgcaatggaaaaggccgccttccaatacaacgggaagaaagaactccccgactcaatctttcacggccacaaagagctggccacgaaaatccgcctatggcaccaacaaggcgaaaaatgcctatacaccggcaaaaacatcccaatatccgatctcatccagaaccaatacaaatacgaaatcgaccacatactgccccttagtctctccttcgacgacagcctatccaacaaagtcttagtcctcgccacagcaaaccaagaaaaaggacaaaggacacccttccaggccctcgaccgcatggacgacgcgtggtcctaccgcgagttcaaatcgtacgtcaaggacagcaaattgcttgggaacaagaaaaaggactacctcctaactgaagaagacataagtaagatcgaagtaaaacaaaaattcatcgaacggaaccttgtagacactcggtacagctcccgcgtcgtactaaacgcactccaggacttttacaaaaaccaccacttcgacaccaccataagcgtagtccgcggacaattcacctcccaactccggagaaagtggggactagaaaagagccgcgaaacgtaccatcatcatgcagtcgatgccctcatcatcgccgcaagctcccaactgcgactctggaaaaagcaaaacaaccccctaatcttctacaaggaaggtcagttcgtggacagcgagaccggagaaatcctctcgcttaatgacgacgaatacaaagaacttgtattcaaagcaccatacgaccacttcgtcgacaccctacgctccaaaacattcgaagacagcatcctcttcagctaccaagttgacagcaaatacaaccgcaagatctcggacgccaccatatacgcaacacgcaaagcaaaacttgacaaagacaagagcaaagaaacatatgtcctgtcaaagataaaagacatctacagccaggcaggatacgacgccttcataaaaatatataacaaggacaaatcaaagttcttgatgtaccacaaagactcgcaaacgttcgaaaaagtcattgaggaaatcctgcgcacatacccctccaaagagttcaacgacaaaaacaaggaagtcccctgcaaccccttcgaaaaataccgacaagaaaacggccccattcgaaaatactcaaagaaaggaaatgggcctgaaatcaaaagcctcaagtactacgacaaaaacatccccgaatccttcatcaacattaccccatccaacagtaaaaacaaggtcattctgcggcagctcaacccttggagaaccgacgtatacttcaaccaccaaaccgaaaaatacgagctcctgggactaaaatacgccgacttgcaattcgaaaagaagacaggaacgtacagcatcacgatcgacaagtacaacgaaatcaaggaaaaggagggagtcggagaacaatcagagttcaaattcaccctatataaaaacgacctcctcctaatcaaagacaccaaaaacaacgaaaaacaaatcttccgtttcctatccagaaccatgccaaacgtcaagcactatgtggagctcaaaccatacaacaaagcaaaatttgacgggaaccagcccctgatcacgatctttggcaacgtagccaaaggtggccaatgtctaaagggtctcaacaagccaaacatctccatctataagatcaaaacagacgtcctcggcaacaagtactttatcaaaaaggaaggagacaagcctaaactcaagttctga

SEQ ID NO: 6295 - RNA, 3390 nt, synthetic construct
  misc_feature 1..3390: note = Cas9 variant
  source 1..3390: mol_type = other RNA
atggcagacagaataagcctgggactagacatcggcgtcgcaagcgtaggattttctgtcctcgacatcgacaaaggaaaggtgatagagctaggctcccgcctattcaacgccacagtagcggagggaaaccaggatcgaagaagcatgcgcggggcacgacgcctcctcaacagaaacaaacagcgtcgccaggacacaggaaaactgttccagaaatttggcttactcgacaacttcaacaaagacaacttttacgacacgttcaaccaaaactggaacccctacgaactccgagtaaaaggactcacagaacacctgacaaagaaagagcttgctgaatcgctctaccagatcgtaaaacataggggaatctcatacgccctcaaagacgcagacgccgacgaaggcggcactgattactcagcatccctaaagattaactcacaagaactcgcagagaaaacgccagcgcaaatccagctgcaacgcctaaacgactacggcaaagtacgcggccaagtggttataggtgacgacccagacaaccaaaaagtgctcctaaatgtcttccccacgtccgcgtacgaaaaagaagccaaacagatcatcgccacacaaaaacagttctacccagaaatactgactgacgagttcactaaggaatactgcaagatcctcaccaggaagcgcgactacttcgtaggacctggaaacgaaaaatcccgcacggactacggcatatacaagacagacgggcgaacactcgacaacctcttcgaagaactgataggccacgacaaaatctacccggacgaactcagagccagcgcagcaagctacacagcacaactcttcaacgtccttaacgatctgaataacctccgcatccttagctacgaagacggaaaactgaccaaagaagacaaagagaaaataatagccgagatcaagagcaacaccaccactatcaacatgctcaacgttatcaagaaagtcgccggctgctccaaagaggatatcaaaggcttccgagtcaacgaaaaggacaaaccagagatcagctccatggccgtttaccgcaaagtacacaaggacctcctcaaagtgggagtagacatctcagactggccagtagagttcatagacaaactcagcttcatcctgaccttaaatacagaaaacggagaaatccgcaagcagctcaacaaccgcctcgtccccgagttcgacttccttaacgatgacctaatccaactcatcatcgacaataaagattccttcgaaatcaaaacaaacaacaaatggcaccggttctcgctgaaaaccatgaacaaactcatgccagaaatgctggagagacctgtcgagcaaatgacccttctaaacgaaatgggtctggtcaagaaagacaagaaacgcttcgaaaacaacaaatatctcccatacaaagaaatcgcgaaagacattttcaaccccgtagctagtaaatccgtacgggaagcattaaagatcgtcaacgccgtactaaagaagtatgggcatatcgactacctggtcatcgaaatgccccgggacaaaaatctaaaagaggaacaagacaacatcaaagagttccagaacaagaacaagaaagctaaagacgcagctttcgaagcattcgtaaaaagcgtcggctctgagcaaagggtcaaggaagccctatcaaagaacagaaaacttcaaatgaaaatgcgactatggtaccagcaacaagaaatcgacccatacaacggtgaaacgatcgacgcaactgacctcattaacaaccccgacaagttcgaaatagaccacatcataccacagtccattagtttcgacgattccatcaacaacaagactctttgcttcgcctctatgaaccaagtaaaagggcaaaagaccccgtacgagttcatgctcgaaggccacggacaaggctacgacaaatttaaagcgacggtactcgataacaaaaacttcgaccgtaacaaacgaaagaactacctctttgaggagaacgtgtccgatatcgagacccgcaaacgattcctgagtcgcaacctcgtagacacacgatacagcagtcgcgtcgtcttaaactccctgcaggacttcttccacgaaaagtctgccgacacaaaggtcaccgtcatccgcgggaaattcacgtccaacatgagaaaacactggcacatcgataagacacgcgaaacctttcaccaccacgccatcgacgcgtctataatcgccgcgacgcctttcctacgaatgtggaagaaaggcggcacgatcttcccagtaaaagtgggcgaagaatcgatcgacatcgaaaccggcgagatcctagacgacaagaaattcgacaaagtaatgtacgaggaaccctacaacgggttcgtatcagaaataatgaacgcagacgacagaattaaatttagccaccaagtggacaaaaagatgaaccgcaaggtcagcgacgcaacaatctactcgacccgcaccggaaaactagcaaaagacaagaaagacgcagagtacatcgtagcaaaagtcaaagacatatattccgtagacggcttcaagaaattcaagaaagtatacgacaaagacaaaagcaagttcttactgtacaagtacgaccccaggacattcagcgaactcgaacgcataatcagcgactgcccagacaaagtggagaaagtccaaacaaacggtaaggtgaaagcggtcgacgtttcccccttcgaaatgtaccgaagataccacgggatgatcaagaaatactcgaagaaaggcaacggcccagcaataaaacaactaaaatatctggacaagaaactcggatcccatatcgacattaccccggcaaacgccaacggcaaacacgtaatactacaatccctaaaaccgtggagaaccgacgtgtacctgaatcacgaaacaggagaatacgagataatgggcatcaaatactccgacctaaaattcaacaaaaacgtcggctacggcatcaagaaagacaaataccttgaaatcaagaaaaacgaagaggtaagcgagaaatcagagttcatgttctctctctaccgcaaagaccgcgtaagaatccaaaacatgaaaaccggcgaaagcgtggaattgctgttctggagccgcaacttcagcaacaagaaatacgcagaactaaaaccgatcttcaaattcgtaacagaagacgacgactggcccgtctacggacacgccaaaacacaaatactaaaacgcctagtacctaaagactgcaaaatatggaaagtaaacaccaccatcctcggcgacccgtactacctggagaaagaaagcgataaccccaaagacattctagattga

SEQ ID NO: 6296 - RNA, 3390 nt, synthetic construct
  misc_feature 1..3390: note = Cas9 variant
  source 1..3390: mol_type = other RNA
atgacgaacggcaaaattctgggcctggacatcggcatcgcgtccgtaggtgtggggatcatagaagctaaaaccggcaaagtggtccacgcaaactcaaggctgttctcggcggcgaacgccgaaaacaacgcggagcgccgagggttcagggggtccagaagactgaacagacggaagaaacacagggtcaaaagagtacgagacctcttcgagaaatacggaatagtgacggacttccgcaacctgaatctcaacccatacgaactgagagtaaaaggactcactgagcaactaaccaacgaggaactattcgccgcattaagaacaatctcaaaacgccgcggcatctcctacctggacgacgcggaggacgacagcacgggcagcacagactacgccaagagcatcgacgagaaccgccggctgctcaaaaccaaaacaccaggccaaatccaactagaacgccttgaaaaatacggccaactacgagggaactttaccgtatacgacgagaacggagaggcacaccgccttataaacgtcttcagcacgagcgattacgagaaggaggcgcgcaagatcctagaaacccaagctgactacaacaagaaaataaccgcggagttcatagacgactacgtagaaatactgacgcaaaaacggaaatactaccacggccccgggaacgaaaaatcacggacagattatgggcgcttccgcacggacggcaccacgctcgaaaacatatttggcatattaatcggaaagtgcagcttctacccagacgaataccgggcctccaaagcctcgtacactgcccaggagtacaacttcctgaacgacctaaacaacctaaaggtcccaaccgagaccggcaaactaagcacggagcaaaaggaagcgttggtcgagttcgcgaagtcgacggcaaccctagggccggccaaactactcaaagaaatcgcaaaaatactcgactgcaaggtagacgaaataaaaggatacagggaagacgacaaaggcaagcccgaccttcacaccttcgaaccataccggaagctcaagttcaacctcgattccgtgaacatagacgacctatcacgggaagtacttgacaaacttgcggacatcctaaccctcaacactgaacgcgaggggatagaagacgcaataaaacgcaacctacccaaccaatttacagaggaacagatcagcgaaatcatcaacgtgcgaaaatcccaatcaacagccttcaacaaagggtggcacagcttctcagccaaactcatgaacgaattgatcccagaattatatgccacgagcgacgaacagatgacaatactcacccggctagaaaaattcaaagtaaagaagaaatcaagcaaaaacataaaaaccatcgacgaaaaggaaataacagacgaaatctacaatcccgtagtcgccaagtccgtccgccaaacgataaagataatcaacgcggccgtaaagaaatacggggacttcgacaaaatagtaatagaaatgccccgggacaaaaacgcggacgacgaaaagaagttcatcgacaagcgcaacaaggaaaacaagaaagagaaagacgacgcactcaagcgggctgcctacctgtacaacggcacggacaaacttccggacgaggtattccacgaaaacaaacaactcgaaacaaaaatccgactatggtaccaacaaggagaaagatgcctctactccggcaaacccataccaatccaggaattagtccacaactccaacaacttcgaaatcgaccacatactgccactgagcttatcattcgacgatagcctagccaacaaggtcctcgtgtacagctggaccaaccaggaaaaaggccagaggacaccgtaccaagtaatagactctatggatgcagcctggagcttccgcgaaatgaaggactacgtcctcaaacagaaaggcctcggcaagaagaaacgcgactatctgctaacgacagagaacatcgacaaaatcgaggtgaaaaagaaattcatcgagcgaaacctcgtagacacgcgatacgccagtcgagttgtgctaaacagtctccagagcgcactccgagagctggggaaagacaccaaggtttcagttgtgcgcggtcagttcacgagtcaactccgacgcaagtggaaaatcgataagtcacgcgagacgtaccatcaccacgccgtagatgccctcatcatagcagccagctcgcaattaaaactatgggagaaacaagacaaccctatgttcgtcgactacggaaacaatcaggtcgtggacaaacaaaccggcgaaatactaagcgtatcagatgacgagtacaaagagttggtcttccagcccccttaccagggattcgtaaacacaatatcgagcaagggcttcgaagacgaaatactcttcagctaccaagtagacagcaagtacaatcgcaaagtgagcgacgcaaccatctactccacaagaaaagccaaaatcggcaaagacaagaaagaggagacttacgtcctcggcaaaataaaggacatctactcacagaacggctttgacaccttcgtaaagaaatacaacaaagacaaaacacaattcctcatgtaccaaaaagaccctctaacctgggaaaatgtaatagaggtaatcctccgagattacccaactaccaagaaatccgaagacggcaaaaatgacgtcaaatgcaacccgttcgaagaataccgcagagaaaacggactaatctgcaaatatagcaagaaaggaaaaggtaccccgataaaaagcctaaagtactacgacaaaaagctcggaaactgcatagacatcacgccacaagagtccaaaaaccgtgtcgtcctccgccaaatcagcccctggcgagcagacatatacttcaaccccgaaaccttaaaatacgagctcatgggcctaaagtactcagacctcagcttcgagaagggcaccgggaaatatcacatctctcaggaaaaatatgacgccatcaaggagaaagaaggagtcgggaaggactccgagttcaaattcacgctgtacagaaacgacctaatcctcatcaaggacacgctcaacaactgcgaacgcatgctcagattcggcagcaagaacgacacaagtaaacactatgtcgaactcaaacccctcgaaaagggaactttcgactccgaagaagagattctacccgtcctcggaaaagtcgccaagtcgggccaattcataaaagggctcaacaagcccaacatcagcatatataaagtaagaacagacgtcctaggcaacaaatacttcgtcaagaaagagggcgacaagccaaaactagacttcaagaacaacaagaaatga

SEQ ID NO: 6297 - RNA, 3390 nt, synthetic construct
  misc_feature 1..3390: note = Cas9 variant
  source 1..3390: mol_type = other RNA
atgagcaacggcaaaatcctcggactagacatcggagtcgcgagcgtcggggtgggcatcatagacagcaagacaggcaacgtcatacacgcaaactccaggttatttagcgcagcgaacgccgagaacaacgccgaacgtcgcggattccggggcgccagacgcctgacgagacgtaaaaagcatcgagtaaaacgagtcagagacctcttcgaaaaatacgacataagcaccgacttccgcaacctaaacctcaacccctacgaactacgagtcaaagggctaaccgaacaactcacgaatgaagaactcttcgcggcactgcgcaccatagcaaaacgccgaggtatatcatatctggacgacgcggaagacgactcgacaggatccagtgactacgcaaagtccatcgatgaaaaccgcagactcctaaaaaccaaaacccccgggcaaatacaattggagaggctggaaaaatacggccagcttcgtggaaacttcaccgtctacgacgagaacggggaagcccaccgcctaataaacgtgttctcgaccagcgactacaaaaacgaagccaggaaaatcctcgaaacccaatcaaactacaataagcagatcaccgacgagttcatcgaggactatatcgagatcctaacacaaaagcgcaagtattatcacgggccaggaaacgaaaaatctcgtacggactacgggcgctttagaacggatggaacaacacttgaaaacatattcggaatactcattggtaaatgcagcttctaccccgaagagtacagggcctccaaagcgtcctacacggcccaagagttcaacttcctgaacgacctaaacaacctgaaagtaccaacggagaccggcaaactgtccacggaacaaaaagagtatctcgtcgatttcgcaaagaaaagtaaagcactgggcgcgtctaaactcctcaaagaaatcgccaaaatcgtcgactgcagtgttgacgacataaaggggtacagagtcgacaacaaagacaaaccagacctacacaccttcgaaccctaccgaaagttaaaattcaacctatctagcatcgacatcgacgaactgagccgagagacacttgacaagctggccgacatcctcactctaaatacagaacgggagggcatagaagacgcgataaaaaggaacctgccatcccaattcaccgaagaacagatctccgaaatagtccagatccgcaagaaccagtcgagcgccttcaacaagggctggcatagtttcagcgccaaacttatgaacgaactcataccagagctctacgtcaccagtgaagaacaaatgaccatcctgactaggctggagaagtttaaagtaaacaaaaagtccagcaagaacaccaagacaatagacgaaaaggagataaccgacgaaatatacaaccctgtggtagcaaagagcgtccgtcaaacaattaaaataatcaatgcggccgttaagaagtacggcgacttcgataagatcgttatcgaaatgccacgagacaaaaacgcggaagacgaaaagaaattcatcgacaagaaacaaaaagagaacaagaaagaaaaagacgacagcctaaaacgagccgccttcctatacaacgggacagacaacttaccggacggcgtcttccacggaaacaaagaactcaagacaaaaatacgcctctggtaccagcagggtgagcgatgcctctactcaggtaaattaatcagcatccatgatcttgtccacaacagtaacaaatttgaaatagaccacatcctacccctgtcgctcagcttcgacgacagcctggccaacaaagtactcgtatacgcatggaccaaccaagaaaaaggccaaaagacgccctaccaggtaatagactccatggacacagcttggtcattcagagagatgaaagactacgtcctcaaacagaagggactggggaaaaagaaatgcgagtacctcctaacaaccgaaaacatcgacaaaatcgaagtcaaaaagaaattcattgaacgaaacctcgtagacacacgctacgcttcccgcgtagtcctgaactcactccaaacagcattaaaagagctgggaaaagacaccaaagtcagcgtcgtgagagggcaattcacatcccagctgcgccgcaaatggaacatcgacaaatcgcgcgaaacttaccaccaccatgccgtcgacgccctaattatcgcagcatcaagccagctcaaactgtggcagaaacaagagaaccccatgttcgagtcctacggcgaaaaccaagtcgtcaacaaggagaccggcgagatcctatcaatttccgacgacaaatacaaagagctcgttttccaaccaccctaccaaggattcgtaaacaccatcagctcgaaaggatttgaagacgaaatattattttcctaccaggtggactccaaatttaacagaaaagtctcagacgcgacaatatacagcacccgcaaggccaagctcggcaaggacaagaaagacgagacctatgtcctgggcaaaataaaagacatctactcccaagatggcttcgacaccttcataaaaagatacaagaaagacaaaacacagtttctgatgtaccagaaagatcccctaacgtgggaaaatgtcatcgaggtcatactgcgggattaccccagtgagaaactctcagaggacggcaagaaaacggtaaaatgcaaccccttcgaagaataccgccgcgaaaacggcttgatctgcaaatacagcaaaaagggcaacggcacccccattaaatcactaaagtactatgataaaaagctcggcaactgcatcgacataacacccgagaaaagcaaaaaccgcgtagtcctccgccagatcagcccgtggcgagcggacatctactttaacctggagactctgaaatacgaactcatgggcttgaagtactcagacctaagtttcgaaaaaggaaccggtaagtatcacatatcacaggaaaaatacgacgccatccgtgaaaaagaaggcatagggaaaaagtcagagttcaaattcacattataccgaaacgacctcatcttaataaaggacacactaaacaactgcgaacggatgctgaggtttggatccaaaaacgacacatccaaacactacgtcgaactaaaaccgctagaaaaagggacgttcgactccgaggaagaaatcctaccagtcctggggaaggtcgcaaagagcggccagttcatcaaaggcctaaataagcccaatatatccatctacaaagtcagaactgacgtcctcggaaacaagttcttcataaagaaagaaggcgacaaaccaaaactcgactttaaaaacaacaacaaatga

SEQ ID NO: 6298 - RNA, 3390 nt, synthetic construct
  misc_feature 1..3390: note = Cas9 variant
  source 1..3390: mol_type = other RNA
atgtccaacggcaagattttaggactcgacattggcgtagcgagtgtaggggtcggcatcatcgacgccaaaacaggaaacgtaatccacgcaaacagccgcctcttcagcgcggcgaacgccgagaacaacgccgagcgaagaggcttcaggggagcgagacgactcacgagacgcaagaagcaccgcgtgaagcgcgtgcgagaccttttcgaaaaatacgatatatctaccgacttccgaaacctcaacctcaatccatacgagctccgcgtaaaaggcctcacagagcaactaaccaatgaggaactatttgcagccctcaggacaatagcgaaacgacgagggatatcctatctcgacgacgccgaagacgacagcaccggaagctccgactacgcgaagtccattgatgaaaaccgccgactcctaaagacaaagacaccgggtcaaatccagctcgagagactcgagaaatatggtcaactacgcggaaactttaccgtctatgacgagaatggcgaggcacaccgattaataaacgtattctcgacctccgactacaaaaacgaagcgcggaaaatcctagaaacacaatccaactacaacaaacaaatcacagacgagttcatagaagactacatcgaaatcctgacccaaaaacgaaaatactatcacggccccggaaacgaaaaatcccgtactgactacggacggttcaggaccgacggcaccaccctcgaaaacatcttcggcatactcatcggcaaatgcagcttctaccccgaggaatatcgcgcttcgaaagccagctacaccgcccaagagttcaacttcctaaacgacctcaacaacctgaaagtgccaaccgaaacgggcaaactcagcaccgaacagaaagaatacctggtcgacttcgccaaaaagtctaaagcgctgggcgcctccaagctactcaaagaaatcgcgaaaatagtcgactgctccgtggacgacatcaagggttaccgcgtagacaacaaggataagcccgatctccacaccttcgagccataccggaaacttaaattcaacctgtcaagcatcgacatagacgaactgtcacgagagaccctcgataaactcgccgacatactcacgctaaacacggaacgcgaaggtatcgaagacaccattaaacgaaacctcccgtcccaattcacagaggaacaaataagtgaaattgtacagatacggaaaaaccagtcatcggcattcaacaaagggtggcacagcttcagcgcaaaactaatgaacgagttgatcccggaactctacgtcacatcagaagaacagatgaccatcctgacaagactggagaaattcaaagttaacaagaaatcaagcaaaaacacaaaaacgatcgacgaaaaggaaatcactgacgaaatatacaaccccgtggtcgccaaatccgtccgacaaaccataaaaattataaacgccgcagtgaaaaagtatggcgacttcgacaaaattgttatcgaaatgccaagagacaagaacgccgaggacgaaaagaaattcatcgacaaaaaggagaaggaaaacaagaaagaaaaagacgactccctaaaacgtgctgcattcctctacaatggcactgacaacctaccagacggagtcttccacggcaacaaagaactcaagacgaagatacgactttggtaccagcagggcgaacgatgtctctacagcggcaaactaatctcgatccacgatctcgtccacaacagcaacaaattcgaaatcgaccacatcctccccctatcgctcagctttgacgacagcctagccaacaaagtactggtctacgcctggacaaaccaagaaaaaggccagaaaacaccataccaagtcatcgactccatggacgccgcctggtccttccgcgaaatgaaagactacgtactaaagcaaaaagggatcgggaaaaagaaacgcgaatacctcctcaccacggaaaacatcgacaaaatcgaagtgaaaaagaaattcatcgaaaggaacctagtagacacacggtacgcctcacgggtggtcctcaactcactgcagaccgcccttaaagagctcggcaaagacacgaaagtaagcgttgtccgcggccaatttacaagccaactgcggcgcaaatggaaaatagacaaaagccgcgagacatatcaccaccacgcagtagacgcactaataatagcggcaagcggacaactaaaactttggcagaaacacgaaaacttgatgttcgagaattacggggaaaaccaagtcgtcaacaaggagaccggagaaatactctccatcagcgacgacgaatacaaggagttagtattccaaccgccctaccaaggcttcgtcaacacaatctcctctaaaaccttcgaagacgagatcctgttctcctatcaagtggacagcaaattcaataggaaggtctcagacgcaaccatctactcgacacgcaaagccaaactgggcaaggacaaaaaggaagaaacctacgtcctgggcaaaatcaaagacatatacacacaggatggctttgacacattcataaaacgatacaagaaagacaaaacccaattccttatgtaccaaaaagaccccttaacatgggaaaatgtgatagaggtcatcctacgagactaccccagcgaaaaactgagcgaggacgggaagaaaactgtaaaatgcaacccttttgaggaataccgaagggagaacggcctcatctgcaaatactcgaagaaagggaacgggacccctattaaaagtctaaaatactacgataagaaactggggaactgcatcgacataacccccgaaaaatccaaaaaccgggtcgtacttcgccaaatctcaccctggcgggcagacatctacttcaacctagaaaccctgaaatatgaactcatggggctgaaatacagcgatctcagttttgaaaagggaacaggaaaataccacatctcccaagaaaagtacgacgccatacgtgaaaaagaaggaataggaaagaaaagtgagttcaaattcacgctctacaggaacgacctaattctaatcaaggacacactcaacaactgcgaacgtatgctgcggttcggatccaaaaacgacacatcaaaacactacgtcgagctcaaacccctagaaaaaggcacctttgactccgaagaagagattcttccagtcctcggcaaagtggcaaaaagcgggcaattcatcaagggacttaacaaacctaacataagcatatataaagtacgcaccgacgtcctgggcaataaattcttcataaagaaagaaggcgataaacccaaactcgactttaaaaacaacaacaaatga

SEQ ID NO: 6299 - RNA, 3393 nt, synthetic construct
  misc_feature 1..3393: note = Cas9 variant
  source 1..3393: mol_type = other RNA
atgaataaaatactcggccttgacctcggcaccaactcgattggctgggccctaatagaaaataacatcatcctcgggatgggttcaagagtattcccagaaggcgtcgtcaacctgggagagggcgaaggccgagaaacctccaaaaacgcgtcgcgcaccgaagcccgcggagtccgacgacaaatattccgccgtcgactacgaaagcgctacctcctcaaggaactcgccaaacacaatctgtgccccatcagcccaacgttaataaaagactggaatgggacagacatcttcaagaacgagctcataatccagtggttccagcttaacccatacgaactacgtgcgaaagccatacaggaggaaatcacactgatcgagctgggacgcatattctaccacatgatacaacgccgcggattcctatccaactcccgctcagctggggccgacgtcaaagaaacttcaaccatcttcaagggcgacgccaaaatcggaaaaatcggaatctccgacacactaaaatctatcgagcaaaacaagacccttggcagcttcctacactccatccagcctaaagaaaacgaacccttctcaggagagctagaacgaataagaaaccgatataccacacgccaaatgtacatcgacgagttcgagaccatctgggagttccaaaaacaataccactccgaactcaactcgaacctcaagacaattctgggaggacggaaaaaggataactacaaggaagacggcgtgctattccatcaacgccctctgcgaagccagaaacacctagttggcttctgctccttcgagccaaagaaaacaaaatgcaaactaagtgctataccattcgaactcttcagaatctatcaatgggtcaacaccctaagctacgacgtaaacggtgtacgacaaaagatcacccaggaggaacgaaagaaaataatagaccttctcctaagcaaagaaaaaccctccttcaaagagatccgcaaagcgatcgggaaactcgacggttcataccaattcaactacaaggacgacgacaaaatcgtaggatcacacacgatatccaacctgtccaacaagaaattcttcggaaacaaatggttcgacttctccgagaaagagcaggaaaacatctggcacatcctctccttcttcgacgaccgcgaaaaattaaaagaatatgctatcaaaaactggtccttcgacgaggaaagagcagtcaagatctctaaattcaatctcaaagacggctacagcaacctatcgcgcaaagcaatactgaacatactgccattccttcaaaaaggcttcatgtacgacgtcgctgtaggcttagcaggagtgaaaaataccctaagtgtaaactgggaggaacacgaacaatttgtcctggacaacgtccccgagattgtcagatccaacctcaaaggcggttatatcgagcccctcaagaacatgcttaaaaacgagttcaactgcaatgacaaacagcttgaaaaactataccaccactcgagtgcaatagaaacggagaacatccttgaccgtctgccagtgaatctccacgccgaccgcgaaatccagaaaatcaaaaatcccgtagtaataaccgccttattcgaaatcagaaaactcgtcaacgaagtaatcgacacctatggaaaacccaacgaaatcaaagtcgagcttgcaagggacctcaaagcctcaaagtcaaaccgcctcgaggcacgcaaacgacaaaaagacctagaaaaacaaaacgacagagtaaaactggaactcgaaaacctgaaccaacgctcaaaccacataaacatcttaaaatacaagctctgggaagaatgcaaccacacatgcccattcacaggccagatcatcacgatttcccaactgtttacaggcgaggtgcaaatcgaacacatcttcccctggtcacgctcactaaacgacagcttcaacaacaagaccctctgcttcgcagacgagaatcgcgccaaaggaaacaaaaccccctacgagctgtactctgagcagggagaccaaaaatgggaagccataaaactccaagcactatcatgctttaaaaccaaagccaactatcccaactgctataacaaattcaaacacttcgtaaagaagaaacacgacgaagattttatctcccggcaactcaacgatacacgctatatatcaaaagaagccaaaaactacctatctaaaatatgctcaaacgtcttggtcgctcccggccagatgaccgccacactacgacaccactggggactcaactccatcctaaacctcgaagacgacacaaaaacgcgagacgaccaccgccaccacgccatcgatgctctcgtaatggcctgcagcaccagatcccatctacaggagctcagcaagcgcaacaggtacaacaaaaactacgacctcaaggacttccctgacccgtggcaaaacttccgccaagacgcagaaaacgccgtagctcaaatccttgtctcacacaagaaatctaaatcgctgctgacagtgcgaacacacaaaacgatcaagaagggcgtagagcacaagaacattggcgtggcggcccggggacaactccataaggaaagcgtctacgggctacgcaaagcccccaactcgaataaagcattccacatacgcaaaccactcgaaagccttaccaccgaaaaacagcttgagaaaatcgtagatgactccatacggctcctaatcctaaagcgaatcaacatcatcggcgggttcatcaaaggcaaaatcccgaaagaaaccttcttcgtcgtagacgagaacggaatcaagcaaccccagatattcctccccaaccgtaacggtaatccagtacccatcaagaaggtccgcatccgggaaaacattggaggcgctgaaaagctcaaggagaacacaaaccaatacgtaaacccacgaagtaaccaccacgtaatcgtgtacgaggacagcaacggagggctcaaagatgatgtcgtcaccttttggaccgccgtcgagagaaaacgacaaggccaggacgtgttcaaactccctaacgacggcgagaaaatagtttccacactacaaatcaacgatatgttcctactcggcctcaacgacgacgacataataacactgacgtcaaaggaactcaagaaacacctcttcaaagtccaaacactctccagcagcttctacgagttccgactatccaccgacagtacacaaaacaaaaatacgaacagcacagtatttcgtaggattcaatccttcggtatgggaaaaacaggatggaaagccttcaaccccatcaaagtaaaactaaacagcatcggcgaagtgaaaatcatctga

SEQ ID NO: 6300 - RNA, 3393 nt, synthetic construct
  misc_feature 1..3393: note = Cas9 variant
  source 1..3393: mol_type = other RNA
atgaccaacgggaaaatcctaggcttggacatcggcatcgcctccgttggcgtcggaatcatagaagcaaaaacaggaaaggtcgtacacgcaaactcacgcctgttctcggccgcgaacgcagaaaacaacgcagaaagacggggcttccgcggatcccggaggctaaaccgcagaaagaaacacagggtgaaacgcgtccgcgacttattcgagaaatacggaatagtgacagactttcgcaacctgaacctcaacccctacgaattaagggtcaaaggcctaacagaacagctcaccaacgaagagttatttgccgcgctacgcacgataagcaaacgccgcggcatcagctacctagacgacgctgaagacgacagcacagggagcaccgactatgccaagagcatcgacgaaaaccggcgactcctaaagacaaaaacaccggggcaaatccagctagaacgcttagagaaatatggccaactgagagggaacttcaccgtatacgatgagaacggagaggcccaccgactaattaacgtcttcagtaccagcgactacgaaaaagaagctagaaaaatactggagacacaagcggattacaataagaaaatcaccgctgagttcatagatgactatgtcgaaatactcacccagaaaagaaaatactaccacggacccggcaacgaaaaatcacgcaccgactacggacgctttagaaccgatgggacaacacttgaaaatatattcggcatactcataggaaagtgcagcttctaccccgacgaataccgcgccagcaaagcaagctacacagctcaagaatacaacttcttaaacgacctgaacaatctcaaggtaccgacagaaaccggcaagctctcaacggaacaaaaggaggcactcgtcgagttcgcaaagtccaccgcaactctagggcccgccaaactcctcaaggaaatcgccaaaatactagactgcaaggtcgacgaaataaagggctatagggaagacgacaaaggaaagcccgacctacataccttcgaaccgtaccgcaaactgaaatttaacctggactccgtaaacatcgacgacctaagccgggaagtcctcgacaaactcgcagacatactcacgctaaacaccgaacgtgaagggatagaagacgcaatcaaacgaaacctccccaaccaattcaccgaggagcaaatatctgagataataaatgtacgaaagagccaaagcacagccttcaacaagggatggcactcttttagcgccaagttaatgaacgaactcattcccgagctgtatgccacaagcgacgaacagatgaccatactcacacgcctcgaaaaattcaaagttaagaagaaaagctccaaaaacatcaaaaccatcgacgagaaagagatcaccgacgaaatatacaacccggtcgtcgcgaaaagcgtccgccaaaccataaagatcataaacgccgccgtcaagaaatacggcgacttcgacaaaatcgttatcgaaatgccacgagacaagaacgccgacgatgagaagaaatttatagacaaacgcaacaaagaaaacaagaaagagaaagacgacgccctaaagagagccgcctacctatacaacggcacggacaaactacccgacgaagtcttccacggcaacaagcagctcgaaaccaaaatccggctttggtaccaacaaggcgaaaggtgcctctactccggaaagcccatccccatccaagaactcgtccacaactccaataacttcgaaatcgaccacatactgcccctcagcctcagcttcgacgactccctagccaataaagttttagtctactcatggacaaatcaagaaaagggacagcggaccccctaccaagtaatcgactccatggacgcggcctggtcattcagagagatgaaagactacgtactcaaacagaaaggcctaggtaagaagaaacgagactacctcctaactacagagaacatcgacaaaatagaagtcaagaagaaattcatcgaacgcaacctcgtggacacgcgctacgcgtcccgcgtagtactcaacagcctacaatcagcactcagagaactgggtaaagacacaaaagtcagcgtcgtccgcggccagttcacatcccagctgcggcggaaatggaaaatcgacaaatcccgcgaaacatatcatcaccatgcggtcgacgcccttataatcgcagctagctcgcagctcaagctgtgggaaaagcaagacaacccaatgttcgtcgactatggcaacaaccaggtcgttgacaaacaaaccggtgaaatactgagtgtgtcagataacgaatataaagaactcgttttccaaccgccataccaagggttcgtcaatactataagctcaaaaggattcgaggacgagatactcttcagttaccaggtggactcaaagtacaaccggaaagtgtccgatgccacgatctacagcacgcgcaaagcgaaaatcggaaaagataagaaggaggaaacctacgttctcgggaaaatcaaggacatatactcccaaaacggcttcgacactttcgttaagaaatacaacaaagacaaaacgcaatttctcatgtatcaaaaagaccccctgacctgggaaaacgtgattgaagtcattctaggcgattacccaaccacaaagaaatcagaagacggcaaaaacgatgtcaaatgcaacccgttcgaggaataccgtcgtgagaacggactgatttgtaaatactcaaagaaaggcaaaggcacgcccataaaatcactgaaatactacgacaagaaactcggaaattgcatcgatatcacccccgaagaaagtcgcaacaaagtcatactacagagtatcaacccgtggcgggccgacgtatatttcaacccagaaaccctgaaatacgagctcatgggcctcaaatacagcgaccttagcttcgaaaaaggcaccgggaactaccacatatctcaggaaaaatacgacgccatcaaagaaaaagaagggatcggcaagaaatcggagttcaaatttacgctataccgcaacgacctaatcctaataaaagacatcgcgagcggcgaacaggaaatctaccgcttcctctcccgcaccatgccaaatgtcaaccactatgtagaactcaaaccctatgataaggaaaaatttgacaacgtacaagagctagtcgaagccctaggagaagccgacaaggtaggccggtgcatcaagggcctcaataagccgaacatctcaatctacaaagtacggacggacgtgctaggaaataaatacttcgtcaagaaagaaggcgacaaacctaaactcgacttcaaaaacaacaagaaatga

SEQ ID NO: 6301 - RNA, 3393 nt, synthetic construct
  misc_feature 1..3393: note = Cas9 variant
  source 1..3393: mol_type = other RNA
atgaccaacggaaaaatactgggcttagacataggcatcgcatccgtcggcgtcggcataatcgaagcgaagaccggaaaggtcgtccacgcaaacagccgcctgttctccgcggccaacgcagaaaacaacgcagaaaggcgagggttcaggggaagcaggcgcctcaaccgccgtaagaaacatagggtcaaacgagtacgggacctgttcgagaaatacgaaatcgtcaccgatttccggaatctcaacctgaatccgtacgagctccgtgtgaaaggactgacagaacaattgaccaacgaagaactcttcgcggcactacggaccatatcaaagcgcagaggcatctcttacctggacgacgccgaagacgactccacaggctcaaccgactacgcaaaaagcatcgacgaaaaccgaagactactcaaaaccaaaacgccgggacaaatccagcttgaacggctagaaaaatacggccaactccgagggaacttcacagtatacgatgaaaacggcgaagctcaccggctcataaacgtattctccacatccgactacgaaaaggaagcgcgaaaaatcctagagacccaagcagactacaacaaaaagatcacggccgagttcatcgatgactacgtagaaatactgacccaaaagagaaaatactaccatggccccggcaacgaaaaatcccgaaccgactacggccgcttccgaaccgacggaacaaccctagagaacattttcggcatcctaatcggcaagtgctctttctacccagacgaatatcgcgccagcaaggcatcctataccgcacaagaatacaatttcctgaacgacctaaacaacctcaaagtcccgaccgagacgggcaaactctccacagagcaaaaggaggcactcgtagagttcgccaagtccacggcgaccctggggcccgctaaactgctaaaagaaatcgccaaaatcctcgactgcaaggtagacgaaatcaagggctaccgcgaggacgacaagggaaaaccggacctgcacacattcgaaccataccggaagctgaagttcaacctagacagcgtaaacatcgacgaccttagccgagaagtcctcgacaagctagcagacatcctgaccctcaacaccgaacgcgaaggaatcgaagacgccataagacataacctcccaaatcagttcaccgaaggacaaatcagcgaaataataaaagtgcgaaaatcccaatcaacagcattcaacaaaggatggcactccttcagcgccaaattaatgaacgaactcataccggagctctacgcaaccagcgacgaacaaatgacgatcctgaccagactagaaaaatttaaagtcaacaaaaagtcaagcaagaacacaaaaaccatagacgaaaaggaagtaaccgacgaaatctacaaccccgtcgtagccaaatcggtacgacaaacaatcaaaatcattaacgcagcggtgaaaaagtacggagactttgacaaaatagtaatagaaatgccacgagacaagaacgcagacgacgagaagaaattcatagacaaaagaaacaaagaaaacaagaaagaaaaagatgacgcacttaaacgagcagcttacctatacaacgggaccgacaaactacctgacgaagtcttccacggcaacaagcaactggaaacaaagatacgcctctggtaccaacaaggcgaacgatgcctgtatagcggcaagcccatcccaatacaagagctggtccacaatagcaacaacttcgaaatcgaccacatcctcccactcagcctatccttcgatgacagcctcgcgaacaaagttctcgtgtacgcatggaccaaccaagagaaaggacaaaagactccatatcaagtcatcgacagcatggacgcagcctggagcttccgagagatgaaggattacgtactaaaacaaaaaggcttaggcaagaaaaagcgagactacctgctcacaactgagaacatcgataagatagaagttaaaaagaaattcattgaaagaaatttagtagacacacggtacgcatcacgggtagtactgaactcactgcaaagcgccctgagggagctggggaaagacaccaaaataagtgtgatacggggacagttcacatcccagctcaggaggaagtggaaaatagacaaatcaagggaaacctaccaccaccacgcggtcgatgcgctcatcatagccgcgtcctctcagctgaaactgtgggaaaaacaagacaacccaatgttcgtagactacggaaacaaccaagttgtcgacaagcaaaccggagaaatcctcagcgtcagcgacgacgagtacaaagagctagtattccaaccgccttaccaaggattcgtaaatatgatcagctccaaaggattcgaagacgaaatcctgttctcctaccaagtcgacagcaaatataacagaaaggtctccgacgcgacaatttactcgacacggaaagccaagatcggaaaagacaagaaagaagaaacctatgtgctggggaaaataaaagacatctactcacagaacggattcgacaccttcatcaagaaatataataaggacaagacccaattcctgatgtaccagaaagacccactaacgtgggaaaacgtcatagaagtcatcctgcgagactaccccaccacaaagaaaagcgaggacggcaaaaacgacgtgaaatgcaatccgttcgaagaataccgacgcgagaatggactcgtatgcaagtacagtaagaagggaaaaggaacaccgatcaagagcctcaaatactacgacaagaaactgggcaactgtattgacatcactcccgaaggcagcaaaaacgaagtagtcctgcaatcactcaatccctggagagccgacgtatacttcaacccggaaaccctcaaatatgaactcctcggcctcaaatattctgacctctccttcgaaaagggcacaggcaagtaccacatcagccaagagaaatatgacgttatcaaagaaaaggaaggaataggcaagaaaagcgagttcaaattcacactctaccggaatgacctgatactaatcaaagacacggcgagcggcgagcaggaaatctaccgattcctctcccgaaccatgcccaacgtcaaacactatgcagagctaaaaccctacgacaaagagaaattcgacaacgtacaggaactggtagaagcactgggagaggcagacaaggtcggccggtgtatcaaaggtttgaacaaaagcaacctcagcatatacaaggtacggaccgacgttctcggcaacaaatacttcgtcaagaaggagggcgacaagcccaaactagacttcaaaaacaacaagaagtga

SEQ ID NO: 6302 - RNA, 3393 nt, synthetic construct
  misc_feature 1..3393: note = Cas9 variant
  source 1..3393: mol_type = other RNA
atgacaaatggaaagatcctagggctagacataggaatcgcatcggtaggagttgggataatcgaagcaaaaacgggcaaagtcgtacacgcaaacagccgcctattctcggccgcaaacgcggaaaacaacgcagaaagaagaggattccgcggctcgagacgactcaaccgaagaaagaagcacagagtaaaaagggtccgagacttattcgaaaaatacggaatagtgacagacttcagaaatctcaacctgaacccctacgaactccgagtaaagggccttaccgaacaactcaccaacgaagaactgtttgccgcccttcgtacaattagcaaacggcgcggaatatcatatctcgacgacgccgaggacgattcgacaggtagcacggactacgcgaagtccatcgacgaaaaccgccgccttctaaagaccaaaaccccagggcaaatccaactggaacgactcgagaaatacgggcaactccgaggaaacttcacggtctacgacgagaatggcgaagctcatcgtctgatcaacgtctttagcacctccgactacgaaaaagaagctagaaagatcctcgaaacacaagcagactacaacaaaaagatcacggctgagttcatcgatgactatgtggaaatcctaacacagaaaagaaaatactaccacggcccgggaaacgaaaagtcgcgaacagactacggacgattcaggacagacggcacaaccctcgaaaacatattcggaatacttatagggaagtgcaacttctaccccgacgaatatcgagcatccaaagcctcatatacagctcaagaatacaacttcctcaacgacctcaataacctcaaagtccccacagaaaccggaaaactctcaaccgagcaaaaagaatcgctcgtcgagttcgctaaaaacaccgccatcctgggacccgccaaactcctcaaagaaatcgcaaaaatcctcgactgcaaagtcgacgaaataaaaggatatcgggaagacgacaaaggcaagccggatctccataccttcgaaccctaccgaaaactgaaattcaacctcgactcggtaaacatcgactacctatcccgcgaagtactcgacaaactggcggacatcctcaccctcaacacagaacgcgaaggcatcgaagacgcgatcaagcgcaacctccccaaccaattcaccgaagaacaaatcagcgagatcattaatgtccgcaaatctcaaagcacagcctttaataaagggtggcattcattctctgcaaaactcatgaacgagttgatcccagaactctacgccacctccgacgaacaaatgacaatactaacccgtctcgagaaattcaaagtcaagaagaaatcaagcaaaaacatcaaaacaatcgacgaaaaagaaataacagacgaaatctacaaccccgtcgtcgccaaaagcgtgcgacaaacgatcaaaataataaacgccgcggtcaaaaagtacggagacttcgacaagatcgtaatcgagatgccccgagataaaaacgcagatgacgaaaagaaattcatcaataaacgcaacaaggaaaacaagaaagaaaaagacgacgccctaaagcgtgcggcctacctgtataacgggacagacaaactcccggacgaagtattccacggcaacaaacaactggaaaccaaaatccgactttggtaccaacaaggagaaaggtgcctatactcgggaaagccaataccgatacaagaattggttcacaacagcaacaacttcgagatagaccacatcctgcccctcagtctcagcttcgacgacagcctagcaaacaaagtcctagtgtactcatggaccaaccaagaaaagggacagaaaacaccataccaagtcatagacagtatggacgcagcgtggtcgtttcgggaaatgaaagaatacgtcttaaagcagaaaggcttaggaaagaagaaacgtgactacctgcttaccaccgagaacatcgacaaaatcgaggtgaaaaagaaattcatagaacgcaaccttgtagatacccgatacgcctcgcgggtagtactgaacagcctccaatccgcactacgcgaactcggcaaagacacgaaagtatcagtggttcgaggacaattcacaagccaactcaggcgaaaatggaagatcgacaagagccgcgaaacctaccaccaccacgccgtagacgccctaatcatcgccgcatcgagccagttaaagctctgggaaaaacaagacaaccccatgttcgtcgattacggcaataaccaagtcgttgacaagcagaccggcgaaatcctatccgtatctgacaacgagtacaaggagctcgtattccaaccaccctaccagggcttcgtaaacacaatcagttcaaagggcttcgaggacgaaatactcttcagctaccaggtcgactccaaatacaaccggaaggtcagcgacgctactatctactcgacacgaaaggcaaagatagggaaggataagaaagaagaaacatatgtcctaggaaaaattaaagacatatacagccaaaacggattcgacacattcgtcaagaaatataacaaggacaagacccagttcttgatgtaccaaaaagaccccctaacctgggagaacgtcatcgaggtgatcctgggagactaccccaccaccaaaaagagcgaggacggcaaaaacgacgtaaaatgtaaccccttcgaggaataccgaagagagaacggcctcatctgcaaatacagcaagaaaggcaaaggcacacccataaaaagcctcaaatactatgacaagaaactcggtaattgcatagacatcacacccgaagaatcacgtaacaaggtaatcctccagagcataaacccctggagagcagacgtatacttcaaccccgaaaccctcaaatacgagctaatgggcctcaaatacagcgacctcagcttcgaaaaaggaacgggtaactaccacatatcccaagagaagtacgatgcaatcaaagagaaggagggcataggcaagaaatcagagttcaaattcaccctatacagaaacgatttgatactcataaaagacatcgcgtccggcgaacaggaaatatatagatttctaagccgcacgatgcccaacgttaaccactacgtcgaactaaaaccctacgacaaagagaaattcgacaatgttcaggagctagtggaagccttaggggaggcagacaaggtaggccgctgcatcaaaagccttaacaaaccaaacatctccatttacaaagtccggaccgacgtactaggaaacaagtacttcgtcaaaaaggaaggcgacaaacccaaactcgacttcaagaataacaagaaatga

SEQ ID NO: 6303 - RNA, 3393 nt, synthetic construct
  misc_feature 1..3393: note = Cas9 variant
  source 1..3393: mol_type = other RNA
atgagcaacgggaaaatcttgggcctagacatcggtgtggcttcagtaggagtagggataatagacgcaaagacgggcaaagtgatacacgccagttcaagactcttttccgccgccaacgcggagaacaatgcggaaagacgcgggttccgaggcgcccgacgcctaacacgacgaaagaagcacagaatcaaacgggtacgagacctattcgaaaagtacgaaatcgtcaccgacttctcgaacctcaatctcaacccgtacgagcttcgagtaaaaggcctaactgaacagctgacaaatgaggaactctttgcggccctacgcacaatagcaaagcgccgcgggatcagctatctcgatgacgccgaggacgatagcaccggcagctccgattacgcaaagagcatagaagaaaaccggcgactcctcaaaaacatgacacccggccaaatacaactagagcgcctcgaaaaatacggacagctccgcggcaatttcacagtgtacgacgaaaacggcgaggcgcaccgcctcatcaacgtattcagcacctccgactacaagaacgaggccagaaaaatcctggaaacccaaagcaactacaacaaacaaatcactgacgagttcatagaagactacatcgaaatactaacgcaaaaacgcaaatactatcacggtcctggtaacgaaaaatcacgcacagactacggccgctaccgtacagacggcacaacgcttgaaaacatcttcggaatcttaatcggcaaatgcacattctaccctgacgaataccgcacaagcaaggcgagctacacagcacaagagtacaacttcctgaacgatctcaacaacctaaaagtgccaaccgaaaccggcaaattgagcacagaacagaaacactatctcgtggacttcgccaagagcagcaaggcgctgggcgtggcgaaactcctgaaagaaatcgcgaaaatagtcgaatgctccgtagacgacattaagggttaccgcgaagacaacaagggcaaaccagacctacataccttcgaaccctaccgtaaacttaaattcaatctgagcctaatagacatagacgaactgtccagggaaactctagacaaacttgccgacatacttacccttaacaccgagcgggaaggaatagaagacgcgatcaaacgcaacctcccaaaccagtttacagaagaacagattgtagagctcgtaaacgtccgcaaaaaccagtcatcagcgtttaacaagggctggcacagcttttccgtaaaactgatgaacgaactcatacccgaactatatgcctcatcagaggaacaaatgacaatcctgacgaggctcgaaaagttcaaagtcaataagaaaagcagtgagaacacgaagaccattaacgaaaaagaaataaccgacgagatctacaaccccgtggtagccaaatcagtgtcacaaaccgtaaaaataataaatgcagcagtcaagaaatatggagacttcgataaaatcgtgatagagatgccaagagacaagaacgccgacgatgaaaagaaattcatagacaagaagcagaaggagaacgcgaaagaggtcgaagacgccctaaaacgtgcagcctacctctacaacggcaccgacaaactaccagacggcgtcttccacggcaataagcaactcaaaaccaagataagactctggtaccaacaaggagaacgatgcctatattccgggaagcccatctccatacaggacctcgtccataatagcaacaacttcgaaatcgaccacatcctccccctgtcactctcgttcgacgacagcctggcaaacaaggtcctcgtgtatgcctggaccaaccaggagaaaggccagaagacaccttaccaagtaatcgacagcatggacgcagcttggagcttccgggagatgaaggactacgtcttgaaccaaaaagggatcggcaaaaagaaacgcgagtacctcctcaccacggaaaacatcgacaaaatagaagtcaagaagaaattcatcgagaggaacctagtagacacacggtacgcatcacgagtcgtattgaactccatccaggcagcgctcaaagaactggacaaagacacaaaagtgagcgtaatccgcggccaattcacgtcacaactcaggcggaaatggaaaatcgacaaatcacgcgagacgtaccaccatcatgctgtcgacgccctaattatcgccgccagctcccaactaaaattgtggcagaaacaagaaaacccgatgttcgtagactacggagaaaaccaagtcgtgaacaaagaaaccggcgagatcctctccgtctccgacgacgactacaaagaactcgtattccaaccaccctaccaaggcttcgtgaacaccatctccagcaaagccttcgaagatgagattctattcagctaccaagtcgactccaagtacaaccgcaaagtcagcgacgccaccatctactcaacccgaaaagcaaaactcggcaaagacaagaaagaggagacgtatgtcctgggaaaaatcaaagacatatacagccaagacggattcgacgccttcatcaaacggtacaagaaagacaaaacccaattcctcatgtaccaaaaagaccccgttacatgggagaacgtcatcgaagtcatactcagagactacccatcagaaaaacttagtgaggacggaaagaaaaacgtgaaatgcaaccctttcgaagaataccgccgcgagaacggccttatctgcaaatattccaagaaaggcaaaggcacacccatcaaatccttaaaatactacgacaagaaactcgggaattgcatagatatcacgccgaaagggagcaaaaacgaagtagtgctccaatcactgaacccctggcgagccgacctttacttcaacccggacaccctgaaatacgaactcatgggactaaaatactcagacctctccttcgaaaaaggaaccggaaaataccacatttcgcaagagagatacgacgaaataaaagtaaaagagggcatcggtaaaaacagcgagttcaaattcacactgtaccggaacgacctgatcctcatcaaagacacggaatcgggcgaggaggaactctaccggtttctttcaagaacaatgcctaacgtcaaacactacgtagagctcaaaccatacgacaaagaacggtacgatggaggccaagaactcatgaaagttttcgggaacgtcgccaacggcggacagtgcctcaaatcgctcaacaaaagcaacctctctatatataaagtacgcaccgatgtcctcggtaacaagttcttcataaagaaagagggcgacaaaccaaaactcgatttcaaaaacaacaagaaatga

SEQ ID NO: 6304 - RNA, 3393 nt, synthetic construct
  misc_feature 1..3393: note = Cas9 variant
  source 1..3393: mol_type = other RNA
atgacgaacggcaaaatcctcggcctcgacataggtatcgcgtcagtgggcgtgggcataatcgaagcgaaaaccggcaaagtagtccatgccaactcacggttattcagcgcagccaacgccgaaaacaacgcagaacgccgcgggttccgagggtcacggagactaaacagacgcaagaaacaccgcgtaaaacgcgtcagagacctcttcgagaaatacggcatagtgaccgatttcaggaacctgaacctgaacccgtacgagctgcgagtcaaagggctcacagaacaactgaaaaacgaagaactcttcgccgcactccgcacaatcagcaagcgaagaggaatatcgtacctcgacgatgcagaagacgacagcaccggttccacggactacgcgaaatcaatcgacgaaaaccggcgactactcaagaacaaaacgccaggacaaatacaactggaaagactcgaaaagtacggacaactgcggggcaacttcaccgtctacgatgaaaacggcgaagcacataggcttatcaacgtcttctcgacatccgactacgaaaaagaggcccggaaaatcctggagacacaagccgactataacaagaaaatcaccgcagagttcatcgacgactacgtcgaaatactcacccaaaaacgcaaatattaccatggacctgggaacgaaaaatcccgcacagactacggacggttccgaacagacggcaccacactggaaaacatcttcggcatcctcatcggaaaatgcaacttctacccagacgaataccgcgccagcaaagcgtcatacacagcccaagagtacaacttccttaacgacctaaacaacctcaaagtctcgaccgaaacagggaagctcagcactgaacagaaggagtcactcgtcgagttcgccaaaaacacagcaaccctgggcccagccaaattactaaaagaaatcgccaagatcctcgattgcaaagtcgacgaaatcaagggctaccgtgaagacgataagggcaagcccgacctccacacgttcgagccataccgaaaactgaaattcaacctagaaagcatcaacattgacgacctgagccgggaagtgatcgacaagctagccgatatcctcaccctgaacacagaacgagaaggtatagaagatgccatcaaaaggaaccttccaaaccagttcaccgaagaacaaatctccgagataataaaagtccggaaaagccaaagcacagcattcaacaaaggctggcacagcttctccgctaaactcatgaacgagctcataccagaactctacgccacgtccgacgaacagatgaccattctgacccgcctagagaaattcaaagtcaataagaaatccagcaaaaacaccaaaacgatcgacgagaaggaagtcacagacgaaatatacaatccggtagtagccaaatcggtccgccaaacgattaaaataatcaacgccgcagtcaaaaagtacggcgacttcgacaaaattgtaatcgagatgccccgagacaaaaacgcagacgacgagaagaaattcatcgacaagagaaataaagaaaacaagaaagagaaagacgacgccctgaaacgagcggcatacctctacaactctagcgacaagctaccggacgaagtattccacgggaataaacagctggaaacaaaaatacgcctatggtaccagcaaggtgaacgctgcttgtactccggcaaacctataagcatacaggaactcgtccataactcaaacaatttcgaaatcgaccacatcctgcccttaagcctaagtttcgacgacagcctcgcaaataaagtcctagtatacgcatggaccaaccaagaaaagggccagaaaaccccgtaccaagtcatagactcgatggacgcagcatggtcgttccgagagatgaaagactacgtgttgaaacaaaagggcctcggaaagaagaaacgagactacctcctcactacagaaaatatcgacaaaatagaagtcaagaagaaatttatagagcgcaacttagtagacacaagatacgcaagtcgggtcgtactgaacagtctacaatccgcactgcgcgaactaggcaaagacacaaaagtgtccgtggtcagaggacaattcacctcacaactccggaggaaatggaaaatcgacaaatcccgagaaacctaccaccatcacgccgtcgatgcccttataatcgcagcctcctcacaactcaagctatgggagaagcaggacaatccaatgttcgtcgactacggtaaaaaccaagtcgtcgataaacaaaccggagagatcctcagcgtgtccgacgatgagtacaaggagctagtcttccaaccaccctaccagggcttcgtcaatactatcagctccaaagggttcgaagacgaaatcctgtttagctatcaggtcgactccaaatacaaccggaaagtatcagacgcgacaatctacagcacccgaaaagccaagatcggcaaagacaaaaaggaggaaacatacgtactagggaaaataaaagacatctattcgcaaaacggtttcgacaccttcatcaagaagtacaacaaagacaaaacacaattcctcatgtaccaaaaagattccctaacatgggagaacgttatcgaagtaatcctgagggactacccaacgaccaaaaagtccgaagacgggaaaaacgacgtaaaatgcaaccccttcgaggaatacagaagggagaacggcctgatctgcaagtactcaaagaagggcaaaggcacaccaataaaaagcctaaagtactacgacaaaaagctagggaactgcatagatataacccccgaagagtcacgaaacaaagtcatcctgcagtccatcaatccctggcgagcggatgtctacttcaaccccgaaaccctaaagtacgaactgatgggtctaaagtacagcgacctctcctttgagaaaggcaccgggaactaccacatatctcaagaaaaatacgacgccatcaaagaaaaagagggaattggcaagaaatcggagttcaagttcacgttataccgaaacgacctcatcctaattaaagacatagcaagcggcgaacaagaaatataccgattcctctcccgcaccatgccaaacgtcaaccactacgtcgaactcaaaccgtacgacaaagaaaaattcgacaacgtccaggagctcgtggaagcactaggcgaggccgacaaagtcgggcgatgcatcaaaggtctgaacaagccgaacatcagcatctacaaggtaaggacagacgtactcgggaacaaatactttgtcaagaaaaagggcgataaaccgaagctcgacttcaagaacaacaagaaatga

SEQ ID NO: 6305 - RNA, 3393 nt, synthetic construct
  misc_feature 1..3393: note = Cas9 variant
  source 1..3393: mol_type = other RNA
atgacgaacggaaaaatcctcggcctcgacatcggaatcgcgtcagtcggagtcggcattatcgaagcgaagacaggcaaggtcgtgcacgcaaactcacgtctcttcagcgcagcgaacgccgagaacaacgctgagcggcgaggtttccgcggctcccgacgcctcaaccgccgcaaaaagcaccgggtaaaaagagtccgagacctattcgaaaagtacgggattgtgactgacttcagaaatctaaatttaaacccttatgaattacgggtaaaaggcctaaccgaacagctcactaacgaggaattgttcgccgcactgcggaccatctccaaaagaagaggcatctcatacctcgacgacgcggaagacgacagcacaggcagcaccgactacgcaaaaagcatagacgaaaaccggcgactcctcaagacaaagacccccgggcaaatccagctcgaacgcctcgaaaagtacggccaacttcgaggcaatttcaccgtctacgacgaaaacggagaagcacaccgactcataaacgtcttcagcacaagtgactacgagaaggaggcacgcaagattctcgaaacacaagcagactacaataaaaagatcacagcagagttcatagacgactacgtcgaaatactgacccagaaaaggaaatactatcacgggccaggcaacgagaaaagccgcacagactatggccgcttcagaaccgacggcacaacactcgaaaacatattcgggattctcatcggaaaatgcagcttttatcccgacgagtatagggcctccaaggccagctacactgcccaggagtataacttcctgaacgatttaaacaacctcaaagtcccaacggaaaccggaaaactgtccaccgagcaaaaggaagccctagtcgaatttgcaaaatctacggcgaccctcgggcccgccaagctactaaaagaaatcgcgaaaatcctagactgcaaggtcgacgaaataaaaggctaccgcgaagacgacaaaggcaaacccgacctgcacaccttcgagccatacagaaaactaaagttcaacctagacagtgtcaacatcgactacctatcccgggaagtcctagacaagctcgcgggcatcctcaccctcaacacggagcgagaaggcatcgaagatgcaatcaagcgcaacttgccaaaccaattcaccgaggaacaaatcagcgaaattatcaatgtccgtaaaagtcaatcgactgcgttcaacaaaggatggcacagcttcagcgccaagctaatgaacgagctcatccccgaactatacgcaacctcagacgaacaaatgaccatactcacaagactagaaaagttcaaagtcaaaaagaaatctagcaaaaacatcaaaacgatcgatgagaaagaaatcacagacgaaatctacaaccccgtggtagcaaagagcgtccgccaaacgatcaaaataatcaatgccgcagtaaagaaatacggcgacttcgacaagatagtaatagagatgcccagggacaaaaacgcagacgacgagaaaaagttcattaacaaacgcaacaaagaaaacaagaaggaaaaggacgacgccctaaaacgcgccgcgtacctctacaacggaaccgacaaacttcccgacgaagtcttccatgggaacaaacagctggaaaccaagatccgcctatggtaccaacagggggaaagatgcctatactccggaaagccgataccaattcaagagctagtccacaactcaaacaacttcgaaatagaccacatcctacccctctccctgtcattcgacgatagcctggcgaataaagtcctagtatacagctggaccaaccaggagaaaggccagaaaacgccctaccaagtaatcgacagcatggacgccgcatggtcattccgcgaaatgaaagaatacgttctaaagcagaagggactaggcaagaagaaaagggactatctactgacaacagaaaacatcgataagatagaagtgaaaaagaaattcatcgagcgcaacctggtagatacccggtatgcatctcgcgtcgtactaaattcactccaatccgcgctgagagagctcggcaaagacacgaaagtctccgtagtccgaggacaatttaccagccaactccgccgaaaatggaaaatagacaagtcaagggagacctatcaccaccatgcagtcgatgcactcatcatagcggcaagctcccaattaaaactctgggagaaacaggacaatccgatgttcgtagactacgggaacaaccaagtagtggacaaacagacaggagaaatcctcagcgtctcagacaacgaatacaaagaactggtttttcagccaccctaccaaggcttcgttaacacaatatccagtaagggtttcgaagacgagatactcttcagctaccaggtagactccaaatacaaccgaaaggtctcagacgccacaatctacagcacgcggaaagcaaaaatcggcaaagacaagaaagaggaaacctatgttctcggaaaaatcaaggacatctactcgcaaaacggcttcgacacgtttgtaaagaaatacaacaaagacaaaacccagttcctcatgtaccaaaaagacccgctcacttgggaaaatgtcatcgaggtaatactcggggactaccccaccacaaagaaaagcgaagacggcaaaaacgatgtcaagtgcaacccattcgaagaataccggagggaaaacggactaatctgcaagtacagcaagaaggggaaaggaacacccataaaatcgcttaaatactacgataagaaactcggtaactgcatcgacatcaccccagaggaaagccgcaacaaagtaatcctgcaaagcattaacccatggagagccgacgtttactttaaccccgagacgctcaaatacgaactgatggggctcaaatactccgacctgagcttcgaaaaaggaacaggcaactaccacatctcccaggaaaaatacgacgccataaaagaaaaagaaggcataggaaagaaatccgagttcaaattcacgctatacagaaacgatctcatcctaatcaaagacatcgcaagcggagaacaggaaatctaccgcttcctgtccaggactatgcctaacgtaaaccactatgtggaactcaaaccctacgacaaagaaaaattcgacaacgtccaggaactggtagaggcgctcggagaagccgacaaagtaggccgatgcataaaagggctgaacaaacccaatatcagcatctataaagtgcgcacggacgtactcggcaacaagtacttcgtaaagaaggagggcgacaaacccaaactagacttcaaaaacaacaaaaagtga

SEQ ID NO: 6306 - RNA, 3396 nt, synthetic construct
  misc_feature 1..3396: note = Cas9 variant
  source 1..3396: mol_type = other RNA
atggcccagcatgtatttggactcgacataggaatagcgtcagttggatgggcaatactcggcgaacaacgcatcatagacctcggtgtacgctgcttcgacaaagccgaaaccgcgaaagaaggcgaccccctcaacctcacgcgaagacaggccagactcctaagaagaaggctataccggagagcctggagactgacccaactatccagactcttaaaacgaaaaggtctcattgcggacgccaaactcttcgcgaaagcaccatcctacggcgactcggcatgggaactcagaagacagggactcgaccggctgctgaccccactagaatgggcccgagtcatctaccatcaatgcaaacaccgcggattccactggaccagcaaggccgaagaagccaaagccgattccgatgccgaaggcggccgcgtcaaacaaggcctagcccacacgaaagccctcatgcaagccaaaaattacaggagtgcagccgagatggtactagccgaatttccagacgcccagcgaaacaaacgaggccagtatgacaaagcactttcccgggtcctactcggcgaggagcttgcactactgttcgcaacgcaacgaaggctcggaaacccccacgcgtcggacttcttcgaaaaattaatactgggagacggagaccgcaagtccggtttgttctggcagcaaaaacccgcactctccggcgccgacctgttaaaaatgttaggcaaatgtaccttcgaaaaaggagaatacagggcaccaaaggccagcttctccgtagaacggcacgtatggctaacccgccttaacaacctccgcatagtcgtagacggcagatcaagacccctcaatgaagcggaacgacaagcggcattactcctcccctaccaaacagaaacaagcaaatacaaaacactgaaaaacgccttcatcaaggcaggcctatggggagacggcgtcagattcggaggcctagcatacccaagccaagcccaaatagatgctgagaagacaaaggacccggaggaccaattcctcgtcaagctaccagcctggcacgaactccgaaaagcattcaaagcggcagggcatgaagcactatggcaacaaataagcacccccgcactggacggagacccaaccctactcgaccagatcgctacggtcctctccgtgtacaaggacggcgccgaggtcgtccaacaattacgccaactagccttaccagaacccgcagccagcatcgctgtactggagaaaatctcattcgacaaattctccagcctaagcctaaaggcactccgaagaatcgtaccgcttatgcaatccggcctacggtacgacgaagcggtggcccaaatcccagaatacgggcaccacagccagcgcatcgaacccggagcagcgaagcacctatacctaccaccattttacgaagcacaacgaaaatacgcaggaaagggcgaccacataggatcaatgcaatttcgcgacgacgcagacatcccccgcaaccctgtcgtgcttcgggcactcaatcaagcacgaaaagtcgttaacgccctcatacgcgaatacggctcacccatagcagtcaacatcgaaatggcgcgcgatctatcacgcccgctcgacgaaagaaacaaagtcaagagggcccaagaggagttccgagacagaaacgacagagcccgaagcgaatttgaaagagacttcggctacaaacccaaagccgccgccttcgaaaaatggatgctctaccgggaacaactcggccagtgcgcatacagccaacaaccactagacatacaaagagttctggatgaccacaactacgcccaagtagatcacgccctcccctactcaagaagttacgacgactccaaaaacaataaagtgttagtcctgacacacgaaaaccaaaataaaggcaatcgaacagcattcgaataccttacatcctttccagacggcgaagacggcgaaagatggcgcacattcgttgcgtgggtccaaggtaacaaggcttacagaatggccaaacgtaacaggctactccgtaaaaactacggtgtagacgaaagtaaaggattcatcgaccggaacctaaatgacacacgttacatctgcaagttcttcaaaaactacgtagaagaacatctacaactagccgcgagagccgacggggacacggcgcggagatgtgtagtcgtaaacggacaactcacagcattcctaagagctcgctggggcctcacaaaggtcagaggagacagcgaccgacaccatgctctcgatgccgccgtagtagcagcatgcacacacggaatggtaaaggcactggccgactactcacgaagaaaagaaatttcattcctacaagagggattccccgatccagaaacaggggaaatcctcaaccccgccgctttcgaccgcgccaggcagcacttccccgaaccctggacgcacttcgcccacgagctaaaagccagactatttaccgacgacctagcagcactccgagaggacatgcaacggctcgggagctacacgaccgaagacctgggacgcctgagaaccctgttcgtctcccgagcaccccaacgcagatccggaggggccgtccataaagagaccatttacgcccaaccagaatctctaaaacaacaaggcggggtcatagagaaaattctactcacgtctctaaaactgcaagatttcgacaaacttctcaacccagaaagcaacgaccatttcgtagaaccgcacaggaacgaacgcctgtacgcggcaatacgccaacgcctagagcagttcgggggacgtgcagacaaagccttcgggccagacaacctattccacaaacccgacaaaaacaaccagccaaccggccctgtagtacgctcaattaagctagtcagaggaaaacaaacaggcatacccatcagaggcggcctggccaagaacgacagcatgctccgcgtcgacatcttcacaaaggcaggaaaattccacctggttccagtatacgtccaccacagagtcacgggtctccccaaccgagccatagtcgcattcaaagacgaggacgaatggacactgatcgacgaatccttcgccttcttgttttcagtctaccctaacgattacgtcaaagtgaccttaaagaaagaacaacaaagcggctactactcgggagccgacagaagcactggcgcaatgaacctctgggctcatgatcgagccgcatcagtcgggaaagacggcctcatccgcggcatcggagtcaaaacggctctcagcgtcgaaaaatttaacgtcgacgtactcgggcgaatctacctcgctccaccagaaacccgctcgggtcttgcatga

SEQ ID NO: 6307 - RNA, 3399 nt, synthetic construct
  misc_feature 1..3399: note = Cas9 variant
  source 1..3399: mol_type = other RNA
atggcgcaatacgtattcggacttgacatcggtatagcctcagtcggctgggcggtcctggatgcccaacgcatagtagacctaggcgtcagatgcttcgacaaagctgaaaccgcaaaagaaggagaccccctaaacctcactcggagacaggcccgattgctaagacgtagactctaccggagagcatggaggctcactcaattagccagactcttcaaaagagaaggcctgatagacgatgctaaactcttcgcgaaagccccatcatggaccgaaaacgcatgggaactccgactacggggactagaccatctgctcacacccctagagtgggcccgagtgatttaccacctctgcaaacacagaggattccactggaccagcaaagccgaggaagccaaagcggaatcagacgccgaaggagggagggtcaaacaagggctagcccacaccaaagccctcatgcaagtgaaaaactaccggtcaacagccgagatggtgctagccgagttcccaggggcccaaagaaacaagcgagggcaatacgacaaagcactgtcaagagtactactgggagaagaactggcgctactgtttgcgacacaacgacgactgggaaacccacacgcctcagagcacttcgaacaattaatattaggccacggggacagaaaatccggtctattctggcaacagaaacccgcactgagcggcgccgacctattgaaaatgctaggaaagtgcactttcgagaaaaccgaatacagagcaccaaaagcgtcattcagcgcagagagacacgtttggctaaccagactcaataacctacggatcgtagtagacggcagagcgagaccgctaaatgacgccgaacgccaggccgcactcctactaccctaccagacggaaacctttaaatacaagaccctaaaggccgcattcgtaaaggtaggactctggggcgacggggtgcgattcgggggactagcatatccgtcacaagcacaggcggaagccgaaaaggctaaagaccccgaagaccaattcctcgtgaaactgcccgcctggcacgagctccgcaaagccttcaaagccgcaggtcacgaagcactatggcagcaaataagcatgcccgcgctggaagaagacccaactctactagaccagatcgctaccgtcctctcagtctacaaggacggaactgaagtcgtccaacaactgcggcagttggccctacccgaacccgacgcatcgatcgccgtactagagaaaatacgcttcgacaagttctcctcgctaagcctcaaagcacttcggagaatagtccccctaatgcaaggaggactaagatacgacgaagccgtcgcccagatcccggaatacgggcaccacagccaacgtatcgaccccggagccacgcgccacctctatctaccacccttttacgaagcccaaaggaaatacgcagggaaaggcgaccgcataggatccatgcagttccgagaagacgccgacgtaccccgcaaccccgtggtcctcagagcactaaaccaagcccgaaaagttgtaaacgcactgatccgggaatacggttcaccagtagccgtcaacatcgaaatggcgcgcgaccttagcaggccactcgacgagcgaaataaagtcaaaagagcccaggaagagttccgagatcgaaacgacaaagccagaagtgagttcgaaagagacttcggctacaaaccaaaaggggccgtattcgaaaaatggatgctctaccgagaacaactgggccagtgcgcatactcgcaacagccgctggacatccaaagagtactagatgacccaaactacgcacaggtagaccacgccctcccctacagccgaagctatgacgacagcaaaaacaacaaagtactcgtactgacacgcgagaaccaaaacaaaggaaaccgaacacccttcgaatacctgacatcattcccgggcggagaagacggcgaacgctggagagccttcgtagcatgggtccaaggcaacaaggcttatcgaatggcaaaaaggaaccgcctgctccgtaaaaactacgggacagacgagtcaagagggtttatagacaggaacctcaacgatacccgatacatctgcaaatttttcaaaaactacgttgaggaacacctacagctagctgcgcgtacagatggggacaccgcacgccgatgcgtagtagtcaacggacaactgaccgccttcctccgtgcaagatggggcctggcgaaagtccgcggggactccgacagacaccacgcccttgacgcagccgtggtagcagcctgcacacacggaatggtcaaagccctagccgactactcacgaagaaaagaaatcgcgttcctgcaagaaggcttcccagacccagaaacgggagaaatcctaaacctcgcagcgttcgaccgagcgcgagaacacttcccggaaccatggccacacttcgcccacgaattaaaagcgagactcttcatagatgacctggtcgcgctccgagaagacatgcaacacctcggaagctacgcacaagacgatctagaccgcttacgcaccctattcgtctcacgagcaccacaacgacgcaacgggggagctgttcacaaaggcacaatctacgcgcaaccagaaaacctaaaacaacaaggaagcacaattgagaaaatcctactcacgggactcaaactccaagacttcgacaaactactaaaccccgaaagctccgaccacttcgtagaaccccaccgaaacgaacggctatacgccgcaatccgccgacgactagaagagttcggcggcaaagcggacaaagcctttggacccgataaacccttctacaaaccagacaagaatggccaacccacaggcccgatcgtgagatcaatcaaactcgtcagaggtaaacagaccggaatacccatacggggcggactcgcgaaaaacgactccatgctacgcgtagatgtcttcacaaaagccggcaaattccacctggtacccgtatacgtccaccaccgcgtcacgggtttgccagaccgggccatagtcgcttttaaagatgaagaagaatggaccctgatagacgaaagttacgccttcttattctccgtctacccaaacgatttcgtatgcgtgcaacaacggggaaaacccctaatcgaaggatactacgcaggcctagacagagcaaacggcaacatcaacgtatgggcgcacgacagagcagcaagcgtaggaaaggacggactcatccgcggaatcggcgtcaaaaccgcactatcattagaaaaactcaacgtagacgtgctagggaggatatatccagctccacctgagacccgacgtggtctagcatga

SEQ ID NO: 6308 - RNA, 3399 nt, synthetic construct
  misc_feature 1..3399: note = Cas9 variant
  source 1..3399: mol_type = other RNA
atgaagaaaatcctaggcgtcgacctcgggatcaccagcttcgggtacgcaatactccaggaaaccggaaaagacttgtaccgctgcctagataacagcgtcgttatgcgcaacaatccatatgacgagaaaagcggcgaatcctcacaatcgatcaggtcaacccagaaaagcatgcgcagactcatagaaaagcgcaagaaaagaatccgatgcgtagcacaaaccatggaaaggtatggcattcttgattactcggaaacaatgaaaataaacgaccccaaaaacaaccccatcaaaaaccgctggcaactccgagcagtcgacgcctggaaacgcccgctctcgccccaagaacttttcgcaatcttcgcacacatggcgaaacaccgcggatacaaatccatcgcgacggaagacctgatctacgagctggaactcgaactcggactcaatgatccagaaaaagagagcgaaaagaaagcagacgaaaggcgacaagtctacaacgcattacgccacttagaggagctacgaaagaaatacggcggcgagactatagcgcaaaccatccaccgcgcggtcgaagcaggagacctacgcagctacagaaaccacgatgactacgagaaaatgatccgccgggaagacatcgaagaggagatagaaaaagtcctactccgacaagccgagctaggcgccctagggctaccagaggagcaagtgtccgaattaatagacgaactgaaagcctgcatcaccgaccaagaaatgccaacaatagatgagagcctattcggaaaatgcacattctacaaagacgaactagccgcccctgcctacagctacctttacgacctctaccgactctacaagaaactcgccgacctaaacatagacgggtacgaagtcactcaagaggaccgagaaaaagtaatagaatgggtggaaaagaaaatcgcacaaggcaaaaacctcaaaaagatcacacacaaagatctacgaaagatactgggcctggcacccgaacaaaagatattcggagtggaagacgagagaatcgtcaagggcaagaaagaacccagaacattcgtcccattctttttcctggcggacatcgccaaattcaaagaactcttcgccagcatacagaaacacccagacgcactacagatattcagagagctagcagagatcctacagagaagcaaaacaccccaagaagccctggaccgcctcagggccctcatggcaggaaaaggaatagacacagacgaccgagaactcctcgagctattcaaaaacaaaagaagcgggactcgcgaactcagccacagatatatcctcgaagcattacctctcttcctagaagggtacgacgaaaaagaggtacaaagaatcctaggattcgatgaccgggaggactactcccgctacccaaaatcgctacgacacctccatctgcgcgagggaaacctatttgagaaagaggaaaatccgataaacaaccacgccgtcaagagcttagcgtcatgggcactaggacttatagccgacctatcctggcggtacggcccattcgacgaaataatcctcgaaacaacaagagacgcactcccagagaaaatccgcaaagaaatcgataaagccatgagggaacgcgaaaaagcactcgacaaaatcatcggaaaatacaaaaaggaatttccaagcatagacaaacgcctcgcccgcaaaatacaactctgggagagacaaaaaggactggacctttactccggcaaagtaatcaacctttcccaactactcgacggatccgccgacatagagcacatagtgcctcaatccctaggcggcctatccacagactacaatacaatcgtcacactgaaaagcgtcaacgcagccaagggcaacagactccctggcgactggctcgccggcaatccagactatcgggaacgaatagggatgctatcggaaaaagggctcatcgactggaagaaaagaaagaaccttctcgcgcagtccctcgacgagatctacacagagaacacccactccaaaggcatccgagccacctcatacctggaagcgctagtcgcacaggtcctgaaacgatactacccattccccgacccagagctccggaaaaacggcatcggcgtacgaatgatacccggcaaagtaacaagcaaaacccgcagccttctaggtataaaatccaaatcgcgagagacaaacttccaccacgcagaagacgcactcatactatccactctcacccgcggctggcagaaccgtctccaccgcatgctaagggacaactacggtaaatccgaagccgagctcaaagaactctggaaaaagtacatgccacacatcgaaggcctaacgcttgccgactacatagacgaggccttccgaaggttcatgagcaaaggggaagagagccttttctatagagacatgttcgatacaatcagatcaattagctactgggtagacaagaaaccactatcagcatcgagccacaaagaaacagtctacagcagccgccacgaagtcccaaccctccggaagaacatcctcgaagccttcgattcactaaatgtaatcaaagatcgacacaaactcactacagaagaatttatgaaacgatacgataaagaaatcaggcaaaagctctggttacacagaatagggaacacaaacgacgaatcgtaccgagccgtggaggaacgcgcaacccaaatcgcacagattctaacccggtaccagctcatggacgcacaaaacgacaaagaaatcgacgagaagttccaacaagccctcaaagaactgataacgtcccccattgaagttaccgggaaactactccgaaaaatgcgattcgtctacgacaaactcaacgccatgcagatagatcgaggactcgtcgaaacggacaagaacatgttaggcatacacatatcgaaagggcccaacgaaaaactcatcttccggcggatggacgtcaacaacgcacacgaactccaaaaagaaagatcaggcatactgtgctacctgaacgaaatgttattcatcttcaacaaaaaggggctcatccattacggatgtctaagaagctacctagaaaaaggccagggaagtaagtacatcgcgctattcaacccccgcttcccagctaaccccaaagcccaaccaagcaaattcacgtccgactccaagatcaagcaagtagggatcggctcggccaccggcatcataaaagcccatctcgacctcgacggtcacgtaagatcctacgaagtattcggcacactccccgaaggctccatcgagtggttcaaagaggagtcgggatacggccgagttgaagacgacccacatcactga

SEQ ID NO: 6309 - RNA, 3402 nt, synthetic construct
  misc_feature 1..3402: note = Cas9 variant
  source 1..3402: mol_type = other RNA
atggacttgaattaccgaataggactggacatcggaatcgcctccgtcggatgggcggtactggaaaacaactcaaaagacgaaccggtacgaatcgtagacctaggggtcaggctatttgaagcagcggaggtgcccaaaacaggcgcagcgcttgccgaaccgagaagagaggccaggacaacaaggcgcagactaaggcgaagaaaacaccgcctggaacggatgaagtggctcctacaagaatatggactaatacaaacagaagagttcatgaaacggtaccacagtgccggactccccgacgtataccggctccgttacgaggggctcgagcgcaaactaaaagacgaggaactagcccagatcctcatccacataggcaaacaccgagggttcaggagcaccaggaaggcagaactaaaagacaaaaacgacaaagagacaggcgcagtgctaagcgcgactagggaaaacgagaagctcatggaagaacacggataccggaccgcgggagagatgatatacaaagacgacaaattccgcaccggctgcacctggaaagaagagggctacagactgacgcccagaaacaaagagggagactacaaaaacaccatgctacgggccctgctagaagacgaagtgaaagtaatattcgattgccaaagaaagttcggcaaccaaaaggcatcagaggagctcgaaaaagcatacctcgccatcatgacctcacaacgcagcttcgacatgggaccaggtaaacagccagacggctccgcaagcccgtacgcaatggagggcttcggagaccgagtggggctctgcgcccttgaaccacgtgaaaagcaggaaccaagagctcccaaggccgcctacacatcggaactgttcgtcgcgctacaaaagatcaaccatctgcgaatcacagaaaagaacggaaaaggccgaggattaacctcggaggagcgcgaacgactgagcgatctattgcacaagaaaaaggagctgacgtacggcgcggtgaggaaagagctacagctagacctacgataccgattcaacaccttaaactactcatcaaagaagatgacagaagaagagaaaatcaaagacgccgaaaaagcaaaattcgtcagcatggtctcacactacgaatacaggaagcggatgagcgggatgctggaacaactgtcaccagaagaacaggccgacctaatggacgaagtcggcaaaatcctgacattatacaagaacgacgatacgaggtcccgagaatttcagaaactcggactggattcggaaataaccgaagaactactcgaactcaacccccgaggcttccaacacgtgagcttaaaagccatgaagaaactaatgccctacctgaaagagggacttacctatgacaaggcgtgcgccgaagcaggatacgacttccaagggagcgtgcagaaagagcgctcaaggctactcaaaggaaaagaaatcacagacatcataaacgacatcaacaacccagtcgtcaaacgatcggtgagccagaccgtaaaagtcataaacgccataatacaaaaatatgggagcccacaggcggtcaacatagaactggcccgcgagatgagccgaaactatgacgaaagacggaaaatggaaaagcaaatgaaagatcgacagagtgaaaatgaacgcgcgaagaaggagatccaagaactcggaaacgcgttccccacgggacaagacatcctcaaataccgactatggcacgaccaggacgggatctgcatgtacagtgcgaagaggatccctctggcagaactattcacaggagcatacgacatagaccacatcttaccatactccatcaccttcgatgactcgtacagaaacaaagtcctagtaacgtcagaagagaaccgacaaaaaggaaacagaataccctacgagtacttcgggagcgactcggagagatggagcaaattcgagacactcgtcaacagccgaatacgcgactaccgcaaacaacaaaacctgctcaaacagagcttcacggaggaagaaaggaaagagttcaaacaacgcaacctcaacgacacaaaatacataacaagagtaatatacaatatgatcagagaaaacctggcactagcaccgtacaactccccaggaaagaagaaacaagtcttcgcagtcaacggcggagtgaccgcctatctccgaaaaagatggggaatgtccgcaaaggatagatccatagacacccaccatgcacgagacgcagtagtcatcgcatgctgcacagacggaatgatacagaagatcagccgcaatatccagggccgagaactactgtacgcgcgcggattcaccgcagtcgacgtcgagactggcgagaagtttacaagagacgacttcacccgagaccaatgggacgagatattcggcgtccaagtaccaaaaccatgggagtacttcaacgaggaactcgacataagactgggggaaaacccagtagagttcattgaaacccactccgacgtaagccgaaagttagattacccagcatggttctacgaaaataacatcatacgacccgtcttcgtcagcagaatgccaaaccgaaaggtcacaggggcggcgcatgcagacaccatacggtcgccacgacactaccaagaaacaggtagcgtcctaacaaagaccgccctaatcgacctaaaactaaacaagaagacgggagaaatagaaaattactacaaaccagaatcagacacactactatacaacgccctcaaggaaaggctagaactgtacggaggagacggcaagaaggccttcgaagaacccttttataagcccaaagcagacggctcccgcgggaatctagtgcgcaaagtaaagacctacgacaagctaaccctcggggtctacgtcaacagccagcacggaatcgccgccaacgcaaacgggagcatggtgagggtagacgtcttccgcgtaagcggcaagtattatttcgtaccagtatacatagcagatgtagtgcgcaagcgactgccaatgaaagcggtcgtgcaggggaaacagtacatcgactggaaagagatggaagacaaggactttatattcagcctatacacacgggacctgatatcgttcaaaagcaagaacgggaagaaagtaacatgcgtagacggaaccagtaaagcggtcaacgaagaaatcgtctactactacggagcaaacatctcgacagcaagtttcagcggcaaaagccataacggcagcttcgagttcacctccctcggaatccaggggctagaatatcttaagaaataccaagttgacgtcctgggaaacgtaagcgaagtcaagcgtgagaaacgaatgggcttcaggtga

SEQ ID NO: 6310 - RNA, 3402 nt, synthetic construct
  misc_feature 1..3402: note = Cas9 variant
  source 1..3402: mol_type = other RNA
atgggaggctttgaagtcgatagaaaaatctcccttggcttggacatcggcgtcagttccgtcggttacagcgtaatcgacgtcgacaccggtaaagtccttgaactaggcagccgactcattaacggcaaaatcggtacggagaaccaagcgcgccgcgaaatgcgaggcacccgccgactcatcaaccgtaaaaagcagcgacgaaaagacaccgtaaaattatttaacgagttcaaactcatcgacagcaagaaagacgagcactacttcgaccacttcgccaacaactcagacccctacgaactacgcgtcaaaggcctgagcgaaaaactaagcctctccgaaatagccgacggtctctaccacattgtcaaacgccgaggcatatcctacgacctgaaggatgccgacgaggaatcagaaggcagcgaatacgaaaacgggctcaagataaacaactcagaattaaagaaccagacccccgctcagatccagctgaaacgcctcaacgaatacggggccatacgcggcaaggtagtcatcgatgaggagaaaatactccttaacgtattcccaaccaaagcatacctggacgaggcaaaaaggataatagagaagcaacgcgaattttatcccggaatactcaccgaagaatttgaggagaaatactgccaaatactcacccgaaagagagactacttcgttgggcccggcagcgagaaaagccgcaccgactatggcatctacaaagaagacggccggacacttaacaacctcttcgaggagctcataggccacgacaagatctacccagaggagctccgcgccagtggtgcttcattcacagctcaactcttcaacgtcctaaacgacctcaacaacttacacatcagctcatacgaagaccaaaaactgacgaccgaaaacaaggagcaaatcatatcggaactcaagtcaaccacgtcaaatgtaaacatgatgaaactaatccagaaaatcgccgggtgcgaggaatccgacatctcgggctaccgtacagacaaaaactataaaccagaaatcagtagcatgcgaatatatcggaaggtccacaagaagctactcgaatcagaaatagacataacaaactggccagacgacttcattaacaaactcagcttcatcctcaccctaaataccgaaaacggggaaatacgtaaccaactcaaaaaccgtctccagccagaatacgacttcctcacagatgaactaattcaaacgattatagataacaaagaatccttcgacataaagagtaacaacaaatggcacaggttctccatcaagacgatggagctgctcatacccgaaatgatcaaacggcccgtggaacaaatgacactcatcaacgagatgggcctaatcaaaaactccggcaagaaattctcaaactataaatacctcccgtacaagaaaatagcggaagatatatacaacccggtagcctcgaaatccgtgcgagaagcactaaaaatagtgaacgcgatcctcaaagaatatgggcacatagaatacatagtggtcgagatgccgagggacaaaaacgaggacgaagctaaagatcagatcgaaaagtttcagaaggccaatggacgcctcaaagatgccgccctcgaggaatttaccgaggccattggcgacaaatcaaccgtggacaagaaactaggagtacaccgaagcaaactactatttaagataaggctctggtaccaacaacgcgggatggacctatacgagggcaagcctatctcggccgttgacctcctcaacaacccagactccttccaaatagaccatataatcccccaatccgtcagcttcgatgacagtttcaacaacaaaaccctctgcaacagcggcctcaaccaaatcaaagacaagaaaacccctttcgaatacatgaacgaagggtacggacagggattcgacagcatgaaggccatggtaatgaaaaacccccgcattgaccacaacaaaaggaaaaactacctcttcagtgaaaatgtcagtgacatagagaccagaaaacgcttcataagccggaatctcgtggatacccgctacgcatcgagggtagtgctaaataacctccaagaatttttcaaagaaaaagaaagcgacacaaagatcagcatcatacgcggaaaattcacctccaatctacgcaagcactggaaaattaacaaaaacagagacacctaccaccaccacgccatcgatgccacgataatagcagcgacccccttcctaaacatctggaagaaaggctccagcatcttccccagcaacgtcgaaagcgaagacttcttcgacatcaaaaccggcaaaataatcggtaacgacgagttcaacaaatacgcatacgacgaaccctacaacggattctacaatgaactgcggaacgccacagacagaataaaattctcgcaccagatcgacaagaaaatgaaccgaaaagtatcagactcgacaatctactccactcgcgtagctaaaagccccaaaaacaagaaagaaagcgaatacatcgtggccaaaatcaaaaatatatacgacgcagacgaatacgcaaaattcaaacgaatctacgacaaagacaaaaccaaattcctcctaaacaaatacgacccacgctcattcaaccacctagaaaagatcatgaacacatatccagactcaatcgaacgaacgatgtcaaacaacaaagtgaaggtcgtacgcatctccccattcgaactctatcgccaagaccacggccccgtgaagaaatacagcaagaaaaacaacggccccgaaataaaacaactgaaatacctggacaagaaagtcggcagcagcattgacgtaaccccggacaacgcgaaaaataaacacgtaatccttaaatccctaaaaccctggcgaaccgacatctacctcaaccacgaaaccggcgagtacgaaatcatgggcataaaatactccgacctgaaattcaacaaaggcgaagggtacgggatcaaaaaggccaaatacctagaaataaaacaccgggaaaaggtaagcgacgactccgagttcatgttcacattgtacaagaaaaacaggatcaaagtcgaaaacatggagacagatgaaagcgtcgagatgcttttctggtctcgaacaatggactctcaaaaaggctatgcagagctcaaaccaatatacaaatacaagaccgaagacgacaattggccgatttacggaaacgctaagaaacagattatcaagaagctcatccccaaaaactgtaaaatatggaaggtaaacaccgacgtactgggaaatccattctacgtagagaaggaaggcgagtaccccaaggacgtcctagactga

SEQ ID NO: 6311 - RNA, 3405 nt, synthetic construct
  misc_feature 1..3405: note = Cas9 variant
  source 1..3405: mol_type = other RNA
atgaacggcctagtccttggactggacataggaatcgcatccgtcggagtaggcatcctggagaaaaacagcggcaaaatcgtgcatgcctcatcgcggatcttcccggcggcaaccgcggacaacaacgtagaaaggcgaaagaacagacaagcacgacgactccatcgccgaaagaaacatcgcggcgcacgtttaaaagacttgttcgagtactatggactcctaacagacttcagcaaagtaagcataaatttaaacccataccgactccgagtcgacggcctagaccagcaactgaccaacgaagaactcttcatcgccctcaaaaacatcgtaaagaggcgtggcattagctatctagacgacgcatctgaagacggagggacagtgagctcagactatggaaaagcagtggaagaaaaccgcaaactcctggctgaacagacacccgggcaaatccaactagaacgctttgaaaagtacggccaacttcgaggagacttcacggtcgtcgaaaactctgaaaaatgccgcctgatcaacgtcttcagcacgagcgcgtacaagaaagaggcggagcgtatactgcgaaaacaacaagagtttaacaaccaaataaccgacgagttcatcgaagattacctcaaaatcctgacggggaagcgaaaatattaccacggaccagggaacgagaaaagccggaccgactacggccgcttccgcaccgacggagcgaccctagacaacatattcggtatactcataggaaaatgcacgttctaccccaatgagtaccgagcgagcaaggcctcttacaccgcacaagagttcaacctgctcaacgacctaaacaacctcacggtcccaaccgaaaccaagaagctctccgaagaacagaagaaaaccatcatcgaatacgcgaaatcagccaaaacactcggagcctccacactgctaaaatacatcgccaaaatgatcgacgcctccgtcgaccaaatccgtggctaccgagtcgacgtcaacaacaaaccagaaatgcacaccttcgaagtgtaccgaaagatgcagagccttgagaccatatccgtcggcgaactatcccgcaacatcctagacgaactcgcgcatatactaacactcaacaccgagagagagggcatagaggaagccataaatacaaaactacgcgatagtttctcgcaagaccaagttttagagctcgtccaatttcgaaagaacaactccagcctgttcagcaaaggctggcacaacttcagcctaaaactaatgatggagctcatccccgagctctacgagacgtccgaggaacagatgacgatcctaacgcgactcggtaagcagaaaagcaaggagacctcgaaaagaaccaaatatatcgacgaaaaagaggtcaccgaagaaatttacaaccccgtagtcgcaaagagcgtccggcaagcgataaaaatcatcaatgaagcaaccaagaaacacggcatcttcgacaacatcgtaatcgaaatggccagagaaaacaacgaagaagacgcgaagaaagactacataaaacggcagaaagccaaccaagacgagaaatacgccgcaatggagaaagcagcattccaatacaacggcaaaaaggagctccccgacaacatcttccacggacacaaggagcttgccacaaagatacgcctctggcaccaacagggagaaaaatgcctatatacaggcaagagcataccgatcagcgacctaatacacaaccagtataaatacgagatagaccacatcctgccactatccctatcctttgacgactccctgtcgaacaaggtactcgtcctcgccactgcaaaccaagaaaaagggcaaaggacacctttccaagcactagacagcatggacgacgcctggagttacagagagttcaaaagctacgtgaaggaatccaaactcctcgggaataaaaagaaagaatacctcctcacagaagaggatatcagcaagatcgaggtaaaacagaaattcatagagcgcaacctagtggacacacggtactcctcccgcgtcgtcctcaacgccctccaggacttctacaaaaatcacaacttcgacacgacgatcagcgtagtccgcggccaattcacgtctcagctccgccgcaagtgggggctagagaaaagccgagaaacataccaccaccacgcagtcgacgccctaatcatcgccgcaagctcccaactgcgattatggaagaagcagaacaaccccctgatagcatacaaagaggggcaattcgtcgactcacagacaggcgaaataatctcgctaaccgacgacgaatacaaggaactggtatttaaggccccatacgaccacttcgtagacaccctctcctcaaagactttcgaagactcaatcttattttcataccaagtagactccaagttcaaccgaaagatctccgacgcaaccatatacgccacgagaaaagccaaactagacaaagaaaagaaagaatacacgtacacgctcggtaaaataaaagacatctactccctcggcaccaaaactcccagcaagacggggttctacaagttccttgacctctataacaaagacaaatcgcagttcctgatgtttcagaaagaccgaaaaacctgggacgaggtaatcgagaagatcatggaacaataccgccccttcaaagagtatgacaaagccggcaaactcgtagacttcaatccattcgaaaaatacagacaagaaaacggaccgatacgcaaatatagcaagaaaggaaacggaccagaaatcaaatccctgaaatactacgacatcctgctaggcaaacacaaaaacatcacgcccgaaggaagccgtaacaccgtcgcactcctgtccctgaacccatggcggacagacgtatattacaacatggagacaaagaaatacgagttcctgggcctcaaatacgccgatctcccattcgaagaagggggtgcctacgggatctccaccgaaacatacaacgaacttcgggaaaaagaagggattggcaaaaactcagagttcaaattcactctctacaaaaacgatctcatactgattaaagacacagaaacgaactgccaacagttcttccgattctggagccggaccggaaaagacaaccctaagagcttcgaaaaacacaaaatcgaacttaagccttacgaaaaggccaagttcgaaaagggcgaagaactagaagtactaggcaaagtcccaccgtccagcaaccaattccagaaaaacatgcaaatcgagaacctatcaatctacaaagtcaaaaccgatgtacttgggaacaaacactttataaagaaagagggagacaagccaaaacttaagttctga

SEQ ID NO: 6312 - RNA, 3405 nt, synthetic construct
  misc_feature 1..3405: note = Cas9 variant
  source 1..3405: mol_type = other RNA
atgaacggccttgtcctaggcctagacatagggatcgcctccgtgggcgtcggcatcctcgaaaagaactcaggcaaaataatacacgcaaacagccgactgttcccagcggccaccgcagacaacaacgtagaacgcagaaagaaccggcaggcgcgacgcctaaataggagaaagaaacaccgcggcgtacgcttccaagacctcttcgaagactacggactcctcacggacttctcgaaagtgagcataaacctcaacccatacagactccgagtcgacggtctgaaccaacagctcaccaacgaagaactcttcattgcactgaaaaacatagtcaaaagacgagggataagctacctcgacgacgccagtgaggacggaggagccgtctccagcgattacgggaaagcagtggaagagaacagaaagctacttgccgaacagacgccgggccaaatccaactcgaacggttcgaaaaatacggccaggtacgcggtgacttcacggtagtggaaaacggagaaaagctgagactaataaatgtttttagcaccagtgcatacaaaaaggaagcggaacgcatcctcaggaagcaacaagagttcaacaaccagataacggacgagttcatagaagactacttaaaaatcctcaccggcaaacgaaaatactatcacggaccaggcaacgagaaaagccgaaccgactacggaagattccgcaccgacggcacgaccctcgacaatatattcggaatcctaattggcaaatgcacattctatcccgaagaataccgcgcaagtaaagcgtcatacacagcgcaggagttcaacctcctaaatgacctcaacaacctaaccgtcccaacagaaacaaagaaactaagcgaggagcaaaagaaagtaatcgtagaatacgccaaagaagcaaaaaccctcggcgcttccacgctcctaaaatacatagccaaaatgatcgacgcgagcgtcgatcaaatccgtggttacagagtcgatgttaacaacaaaccagaaatgcacacattcgaggtgtaccggaaaatgcaatcactagagactatttcggtcggcgaactaagcagaaacgtcctagacgaactcgcccacatactgaccctaaacacggagagagagggtatggaagaagccataaacaccaagctaaaggacagcttcagccaagaccaagtcctcgaactggtccaatttcggaaaaacaactcctccctcttctcgaaagggtggcacaacttcagcttgaaactgatgatggagctcatccccgaactctacgaaacctcagaggagcaaatgactatactaacgcgactaggcaaacaaaagagcaaagagactagcaaacgcacgaagtacatcgatgagaaagaactcacagaagagatatataatcccgtagtcgcaaaaagcgttcggcaagccataaaaatcatcaacgaggcgaccaaaaagcatggaatattcgacaacatcgtaatcgaaatggcacgcgaaaacaatgaagaagacgcgaagaaagactacattaaaagacaaaaagcgaaccaggacgagaaaaacgcagccatggaaaaagcagccttccagtacaacggaaagaaagaactcccagacaacatattccacggccacaaagaactcgccacaaaaatccgcctctggcaccagcaaggcgaaaaatgcctgtataccggaaaaaccatcccaatctccgacctcatacacaatcagtacaaatacgagatcgaccacatactacccctaagtttgtccttcgacgacagtctaagcaacaaagtgctagttctcgctactgccaaccaggagaagggccaacgcactccgttccaagcactggatagcatggatgacgcctggtcataccgggagttcaaaagttacgtaaaggagtccaaactactcggcaacaaaaagaaagagtatctcctgacagaagaagatatctcaaaaattgaagtcaaacaaaaattcatcgaaagaaacctcatagacacccgatacagctcacgcgtagtacttaacgccctacaagacttctacaaagcacacaagttcgacacaaccatttccgtggtccgcggccagttcacatcccagctgcgccgaaagtggggattggaaaaatctcgcgaaacctatcaccaccacgcggtagacgcactaataatagcagcaagttcacaactaaggctgtggaagaaacaaaacaacagcctcatatcctacaaagaaggccaattcgtcgacagtgagacaggcgagatcatatcactaaccgacgacgaatacaaagaactcgttttcaaagcaccgtacgaccacttcgtcgacaccctgcgatcgaagaagttcgaagactcgatactcttctcctaccaagtcgactccaagttcaaccgtaagatcagcgacgccaccatatacgcaacacgaaaagcaaaattagacaaagaaaagaaggaatacacctacacacttggcaagattaaagatatctattccctaggcacgaaagccccctcaaaaaccggcttctacaagttccttgacctgtacaacaaagacaaatcacagttcctaatgttccagaaagaccgcaagacctgggacgaagtcatcgagaaaatcatggaacaataccggccattcaaggaatacgacaagaccggaaaactggtcgacttcaaccccttcgaaaagtaccgccaagaaaacgggcctatacgaaaatacagcaagaaaggcaatggacccgaaataaagagcttaaaatactacgacatcctactcggtaaacacaaaaacataacacccgaagggtcaagaaacacggtcgccctgctctccctgaacccatggcgcacagacgtctactataacatggaaacaaagaaatacgaatttctgggactaaaatacgcagacctaccctttgaagaagggggcgcatacggcatcagcaccgaaacatacaacgaactccgggagaaagaaggcatcggcaaaaactccgagttcaaattcacactatacaaaaacgacctaatcctgataaaagacactgagaccaactgtcaacagatcttccgcttttggtctaggacgggaaaagacaaccccaagagcttcgaaaaacacaaaatcgagttaaaaccctacgaaaaagcacggttcgaaaaaggagaggaactcaaggtcctcggcaaggttcctccaagctccaatcagctacaaaagaacatgcagatcgaaaacctgtccatttacaaagtcaaaacagacgtcctgggaaacaagcactttataaagaaagagggggatgaacccaaactcaagttctga

SEQ ID NO: 6313 - RNA, 3405 nt, synthetic construct
  misc_feature 1..3405: note = Cas9 variant
  source 1..3405: mol_type = other RNA
atgaacggcctcgtactcggcctagacatcggcattgcctcagttggcgtcggaatcttggagaaaaacagcggcaaaatcatccacgagaacagccgcctcttccccgctgcaacagcagacaacaacgtcgaacgaaggaaaaaccgacaggcccgcaggctcaaccgacgtaagaaacaccgtggcgtaaggttccaagatttattcgaggactacggacttctaaccgacttctcaaaagtctcaataaacctaaacccataccgcctccgcgtagacggtctgaaccagcaactgaccaacgaggaactatttattgccctcaaaaacatcgttaagagacgcggcatctcctacctagacgacgcaagcgaagacggcggtacagtcccgagcgattacgggaaagccgttaaggagaaccgcaaattactcgcagagaaaacaccaggacaaatccagctcgaacgattcgaaaaatacggacaactgcggggagatttcacagtcgaagagaacggggaaaagtgccgcctgataaacgtcttcagcacgtcagcctacaagaaagaagccgagcgaatactacgcaaacagcaagagttcaacaaccagatcaccaacgagttcatcgaagattatttaaaaatactaacaggtaaacgcaaatactaccacggcccagggaacgaaaagagccgaaccgactacggccgctttaggaccgatgggacaacactcgacaacatcttcggcatcctgataggaaagtgcacattctacccggaagaataccgagtgagcaaagcctcgtatacagcccaggagttcaacattcttaacgacctcaacaacctcaccgtcccaacagaaaccaagaaactcagcgaagaacaaaagaaagacattgtcgaatacgccaaggaaacaaaaaccctaggagcctccacactgctaaaatacatcgcgaaaatgatagacgcatcagtagatcaaatccgcggatacagagtcgacgtcaataacaaaccggaaatgcacaccttcgaagtataccgaaaaatgcaatcgctcgagaccatatccgtgggcgagctaagccgaaacgtcctagacgaacttgcgcacatactgaccctaaataccgagagagaaggaatagaagaggcaataaacaccaaactaatgggcgtcttctcccaggaccaagtcctggagctagtgcagttcaggaaaaacaattcctccctattctcaaagggctggcacaacttcagtctgaagctcatgatggaactaataccggaactgtacgagacgtctgaggagcagatgaccatcctaacccgcctaggaaagcagaagtctaaagaaacctccaagagaaccaagtacatcgacgaaaaggaagtgaccgaggaaatatacaaccccgtcgtcgcaaagtccgtcagacaggcgatcaaaatcatcaacgaggccacaaagaaatatgggatattcgacaacatcgttatagaaatggcccgcgaaaacaacgaagaggacgccaagaaagattacatcaaacgccaaaaagccaaccaagacgagaaaaacgcggcaatggagaaagccgccttccaatacaacggtaagaaagaactccccgactccatattccacggccacaaagagctcgccaccaaaatacggctatggcatcaacaaggggaaaaatgcctctacacaggcaaaaacatccccataagcgacctcatccacaatcagtacaaatatgagatagaccacatactcccgctatcactgagctttgacgactctctctcaaacaaagtcctagtcctggccaccgcaaaccaagaaaaaggccagcgcacgcccttccaagccctagacagcatggacgatgcctggtcctaccgtgagttcaaatcctacgtcaaggattcgaagctcctatcgaacaaaaagaaggactacctcctgaccgaagaagacatcagcaaaatagaagtaaaacaaaaattcatagaacgaaacctagtcgacacccggtacagctcacgcgtagtcctcaacgccctccaagatttctacaaggctcacaagttcgacacaacaatctccgtggtccgtggacagttcaccagccaactcagaagaaaatggggactagaaaagtcgcgcgaaacgtaccaccaccacgccgtagacgccctaatcatagcagcaagttcacaactacgtctttggaagaagcaaaacaatccgctgatcacatacaaagaggggcagtttgtagactccgaaactggagaaatcatctcgctgaccgacgacgaatacaaggagctagtcttcaaagcgccatatgaccacttcgtggacaccctccgcagcaaaacgttcgaagactcgatactcttctcctaccaggtcgacagcaaattcaaccgcaaaataagcgacgccacgatatacgcaacgaggaaggcaaaattagacaaagaaaagaaagaatatacctacacccttgggaaaataaaagacatatactccctcgggaccaaaaccccaagcaaaacgggcttctacaaattcctagacctctacaacaaggataaaagccaattcctcatgtttcaaaaagaccgcaagacctgggacgaagtcatagagaaaatcatggaacagtatagacccttcaaagaatacgacaaaacaggcaagctagtagacttcaaccctttcgaaaaataccgccaggaaaacggccccatctgcaagtacagcaagaaaggaaacggcccagagataaaaagcctgaagtattacgacatcctcctgggaaaacacaaaaatataacacccgaaggaagccggaacaccgtcgcacttctcagcctaaacccatggcgcacggatgtctactataatatggaaaccaagaaatacgagttccttgggctaaaatacgccgacctgccattcgaaaaaggcggggcctacgggatcagcaccgaaacatacaacaaactcagggaaaaagaggggatcggtaagaacagcgagttcaagttcactctctacaaaaacgacctaatcctaatcaaagacactgaaacgaactgccagcagatcttccgtttctggtcccggaccggaaaagacaatcccaaatctttcgaaaaacataaaatcgaactgaaaccgtacgaaaaagcgcgattcgagaaaggcgaagaactcgaagtactaggcaaagttccgccaagctcaaatcaattccaaaagaacatgcaaatcgagaacctctcgatttacaaagtcaagaccgacgtactgggcaagaaacacatcatcaagaaagaaggcgacgagccaaaactcaaattctga

SEQ ID NO: 6314 - RNA, 3405 nt, synthetic construct
  misc_feature 1..3405: note = Cas9 variant
  source 1..3405: mol_type = other RNA
atgaagtacatcgaatcagtcagcataggctttgacatcggagtcggctcggtcggctacgcagtaatcaactccaagaccaagcaaatactcgaatctggcgtttcgatcttccccgccgcagtagcccaaaagaatgtcgaacgcagggaaagccgccaatcgcgacgactacgccggcgccgcgtgaaccgcttaaatgacctcaaaaaactactcaagaaaaacggcttcataccatccccgaataaaaacccatatgaaatccgggtaagggggctagaacaccaactctcgcgagacgagatcgcgatagcagtcctacacatagccaaacgacgcggcatctcttactcccttgacgacgttgttgacgaaaacgtaaccgacttcaaggggaaaatcgcaaaaaaccaagaagccctcaaaaataaaacgccgggcgaaatacaatacgaacgactcctcaaatacggcaaggtaagaggcacggtcacaaactacgtagaatatgacgaacaacccgaatacttcctaaacgtcttccccaatagtgcatacgtcgatgaggctaaacgaatcctaacgtgccagaaacaatactaccccgaaatcaccgacgacctcatcgagaacatcgtcaaaatcattagccgcaagagagcatactacataggaccaggaaacgagaagtcacgcacagactacggaatatacaggactaatggagagaccctagagaacatattcgaaattcttataggtaaggacagcgtcaatcccgacgagctaagagcccccgccaacagccttacagcgcaagtatacaatcttctcaacgacttaacaaacatccgttacaacggcagcgagcgactcacccccgaacagaaacaggacatcctttcagaactgctaaccaccgagaaaactgtccagatgctcaacgtgatcgccaaaaaagtcaacgtgaaaaaagaggaaatctccggattccgaaccaagaaggatgacaaacccgatttccacactctcgaagtgtaccggaaagtccgaaaacacatgctgaacaagggaatcgacatcaacgagtggccaaccgaatgcttcgacgaactcgccttcatctttaatctcaacacagaaataggcgaaatacgaaaccgcatctctgagaaagtggtcccgaaatacgacttcatcacaaaccagatcgtagacgacctcctagaggaccccaaaatctttgccataagtacctcgcaaaagtggcaccgcttctcgatcaaaacaatgaacgtcctaatccccgagctcctcaacgggtacaacgaacagatgaccatcctcaccagaatgggactcctcgaggactctaaaaacgactactccaacatagacaaaatcgacatcaaaaacgtcacagaaaacatatacaacccagtcgttcgaaagtccatcaaaaagtgcctcaaaatattcaacgagctgtacaagaagtaccccaacatctcagacgtagtcatcgagctaccaagagaagacaacccggaagacgcccgtaaactcataaaaaaaatgcaaaaagaaaacttagtcgaaaaagacacgtccctagaagctttccgaaaggaggcaaatttgagcgagaacgggctcatcgactttctccgcaaaggtaaaaaccgcgctctaaagatccgcctatggtaccaacaagaaggcaaatgcctatacacgggcgaaccaattctagccgaagacctgtgcaaaaacgaagccaactacgacatcgaccacataatccccatctcagtctcttttgacgactccatcaataataaggtactctgtagctctcacttcaacagattcgaaaaggaaaaaaaaaccccatttgagtacttctcaaacaagagctcacacctcggccgctattccaacttcgacgaattccgcgccagcgtgaacgccaacaaacgcatttcagacgtaaaacgaaaaaaccttctatcaaaagagctcctttccgacctcgacacaagaaagaaattcatcgcccgaaacctggtcgacactaggtacgccagcagggtggtttttaacgagctcacccaattcttcgcctccaaaaaggctgacaccaaagtcgccgtcatccgaggcaaattcacctcacaactccgccgcgcgtggcaactcaacaagagccgagacacataccaccatcatgcagtagacgcagccctaataggcgtcacgccattcctcaaaatctggagatccggcaaaaccatctaccccagaaagatgaccgaagcccagacggacttcgaactaaacgaaatcactacaaatgacgaattcaaagagagctactatcagctaccctgcccccaattccttgactacctaacccaaatgcaagagaacctcaaaataaactttgaggtcgataagaaaatgaaccggaaaatcagcgacgcgatgatctactccagccgaaagaaaaagctcagtaaggataaaaaagaaaaagagtactctctaggcaccataaacgacatttacagcgacgccggctacagcaaattcaaaaacatatataaaaaagacaaggaaaaattcctaatgtaccacctcgaccacaaatctttcgaaatactggaggacataatatcacaataccccgacaaagaggaatatattgactcggagggcaaagtcaagcaacgtgctgtcagccccttcgaaatctaccgacgcaaatacggatatatccgcaaatacagcaaaaagaacaacggcccaataatcaaaaacatgaaatactataacgaaaacctcccaaagatctacatagacatcacccccaaacaatccatagacaagaaagtctacctaacaaacatctcgccctggcgcaccgacgtctattacaaccgctcacaaaactcctaccacatcatgggcataaaatactcggacctccgttacatagacggcaaatacggaatcccgaaaaacgtatacgaaaagatcaaattacgagaaaaaatccccagtgaatccgagttctgcttctccctatacaaaaacgacagagtcaaaatcattgaccccaacaaaaatgaggaaatcgagttacggttcaactcgcgcacacttcccagcgtcctcaactatgtcgaattcaagccactcttccaggagtcatacaacagcctgacgctgttgcccgttttcagcaaaaccacctccgaagggcgcatcataaaaaaattcaccagagaagacaacatagtatacaaagtgaacaccgatgaactaggtaacccctactacattctaaaagaatcccaaaaccccaaaaatataatagacaattcaaataaaacagagtga

SEQ ID NO: 6315 - RNA, 3405 nt, synthetic construct
  misc_feature 1..3405: note = Cas9 variant
  source 1..3405: mol_type = other RNA
atgaacggcctggttctaggtctcgacatcggaatagcctcggaaggcgtgggcatcctagagaaaaacagcggaaaaataatccacgcaaacagccggctgttccccgccgccaccgcagacaacaacgtcgaacgacggaaaaacagacaggcaagacgactcaaccgcagaaagaaacaccgcggcgtacgcttccaggacctattcgaagactacggcctcctgaccgacttcagcaaagtcagcataaacctcaacccatataggctccgcgttgacggacttaaccaacaactcacaaacgaagaactattcatagcactcaaaaacatcgttaaacgccgcggaatatcgtatctagacgacgccagcgaagacggcggcgccgtaagtagcgattacggcaaagcagtcgaagagaaccgaaaactcttagcagagcaaacacccgggcagatccaactcgaacgatttgaaaagtacgggcaagtgcgcggcgacttcacggtggtagaaaacggggaaaaactgcggctgatcaacgttttctcaacatcagcctacaagaaagaggcagagcgaatcctgagaaaacaacaagagtttaacaatcaaataaccgacgagttcatagaagactacctcaaaatactgaccggaaaaagaaaatactaccacgggcccggcaacgaaaagagcagaacggactacgggaggttcaggacagatggaaccaccttggacaacatcttcggaatcctcatcgggaaatgcaccttctaccccgaagaataccgcgccagcaaagcctcatacaccgctcaagagttcaacctactaaacgatctgaacaacctcacagtacccacggaaaccaaaaagctaagtgaagaacaaaagaaagtaatagtagaatacgcgaaagaggctaaaaccctcggcgcaagcacgctgttaaagtacatagcgaaaatgattgatgcctcagtagaccaaatacgcggctacagagtagacgtcaacaacaagccagaaatgcatacatttgaagtctaccgcaaaatgcaatcccttgaaaccatctccgtaggagaactgagtcgaaacgttctagacgaactagcccacatactgacccttaacaccgaacgcgaaggaatggaggaggccatcaacacaaagctaaaggactcgttcagccaagaccaggtactcgagctagtccagttccggaaaaacaactcatcgctattcagcaaaggctggcacaatttttcactgaaactcatgatggaactgataccagaactctacgagacttcagaggagcaaatgacgatcctaacacgactcggcaaacagaagtcaaaagaaacaagtaaacgcaccaaatacatcgacgagaaagaactaaccgaagaaatatacaacccagtcgtagccaaaagcgtacgtcaagccattaaaatcatcaatgaggccacaaagaaacatggcattttcgacaacatcgtcatagagatggctagggaaaacaatgaagaagacgccaagaaagactacataaaacgccaaaaagccaaccaagacgagaaaaacgccgcaatggaaaaagcggctttccaatacaacggaaagaaagaactgcccgacaacatattccacggccacaaagaactcgccacaaaaatacggctatggcaccagcagggagaaaaatgcctctacacgggcaagactatccccatctccgacctcatatacaaccaatacaaatacgaaatcgaccacatcctccccctctctctcagctttgacgactccctctccaacaaagtcctcgccctagcaacagcgaatcaggaaaaaggccaacgaacgccattccaagctctcgactccatggacgatgcctggtcataccgagagttcaagagctacgtgaaagacctcaaaagcctaagcaataaaaagaaagactacctcctgacagaggaagacatatcgaaaatcgaggttaaacaaaaattcatcgagagaaacctagtcgatacccgctacagctcccgcgtcgtcctaaacgccctacaagacttctataaaagccaccagttcgacaccacgattagcgtcgtccgcggccagttcacaagccaacttcgccgcaaatggggcctggagaaaagccgagaaacttaccaccaccacgccgtggacgcgctgataatcgccgcatcctcacaactgcgactgtggaaaaagcagaacaacccactcatcacctacaaggaaggacagttcgtagactcccaaaccggggaaatcatatcactgaccgacgacgaatacaaagagctagtatttaaagccccctacgaccacttcgtcgacaccctatcatcaaaaaccttcgaagactccatccttttcagctaccaagtagacagcaagttcaatcgcaagatcagcgacgccacaatatacgcaacaagaaaggccaaactagacaaagaaaagaaagaatacacctacacgctgggcaaaatcaaagacatatattccctaggcacaaaaacgccctcaaaaaccggtttctacaaattcctcgacctgtacaacaaggacaagtcccaatttctcatgttccaaaaagaccgcaaaacgtgggacgaagtcattgaaaagatcatggagcaataccggccattcaaagagtacgacaaaaccggaaaactcgttgacttcaacccattcgaaaagtaccgacaagaaaatgagccaatccgaaaatacagcaagaaaggcaacggccccgaaatcaaatccctcaagtattacgacatcctcctcggcaaacacaaaaatatcacccccgaaggctcccgaaatacagtagctctgctcagcctcaacccatggcgaacagacgtatactacaacatggaaaccaaaaagtacgaatttctcggactcaaatacgcggacctaccattcgaagaaggaggagcatatggtatcagcacggaaacgtacaacgagctccgagaaaaggaaggaataggaaagaacagcgagttcaaattcaccctctataaaaacgacctcatcctaatcaaagatacggaaaccaactgccagcagattttccggttctggagccggactggcaaagacaacccaaaatccttcgaaaaacacaaaatagaactaaaaccctacgaaaaagcgcggttcgagaaaggagaggaactcgaagtcctaggtaaagtcccgccctcgtccaaccaactccagaaaaacatgcagatcgaaaacctgtcaatctacaaggtcaagactgacgtactcggaaacaagcacttcatcaagaaagagggagacaaacccaaactcaaattctga

SEQ ID NO: 6316 - RNA, 3408 nt, synthetic construct
  misc_feature 1..3408: note = Cas9 variant
  source 1..3408: mol_type = other RNA
atgtcagacttagtgctcggtctagacatcgggatcggatccgtaggagtaggcatcttaaacaaagtaaccggagaaataatacacaaaaacagcagaatcttccccgcggcccaagcagagaacaacctagagcgccggaccaaccgccaaggacgccgcctcacacgccggaagaaacaccgccgcgtccgcctcaaccacctcttcgaagaatccggtctcataacagacttcaccaaagtgtccatcaatctgaacccataccaactgcgggtcaaaggactaaccgccgagctctcgaacgaagaactattcatcgcactcaaaaacatggtaaagcacagagggatctcgtacctggacgacgcctcggacgacgggaacagctcagtaggcgactacgcccagatagtaaaggaaaacagcaaacaactcgagacaaaaacccccggacagatccaactcgaacggtatcaaaagtacgggcaactcaggggagacttcacagtagaagaagacggacgcaaacaccgcttaattaacgtgttcccgacaagcgcctaccacgccgaggccctccgcatactacaaacccaacaagagttcaatcctcaaataactgacgagttcatcaattcctacctcgaaatacttaccggaaagcgaaaatattaccacggtccaggtaacgagaaaagtagaaccgactacggaaaatacaccacaaagaaagacgcccaagggcaatacatcacgttaaataacatcttcggtatcctgataggcaaatgcaccttctaccccgaagaataccgggcagctaaagcatcatacaccgcgcaagagttcaacctcctgaacgacctaaacaacctgaccgttccaacagaaacgaagaaattaagcgaagaacaaaaataccaaataatcacgtacgtaaagaacgagaaagcgatgggccctgcgaaactcttcaaatacattgcaaagctcctcgcctgcgacatagcggacatcaaaggctacaggatcgacaaatccgacaaagccgagatacacaccttcgaagcataccgcaaaatgaaaacgctggaaaccatcgacatcgaacagatcgagcgcgaaaaactagataaactagcctacgtacttacgctcaacacagagagagagggcatacaagaggcgctagaccacgagttcgcagacggcacattttcgcaagaacaagtcgatgaattagtgcaattccgcaaagccaacagctccatcttcggaaagggctggcattccttctcggtaaaactaatgatggaactaatccccgaactatacgccaccagcgaggagcaaatgaccatactcacgcgcctaggcaaacagaaaactacctcctcttcaaacaagacaaagtacatagacgagaaacaactcacggaagaaatatacaaccccgtagtagcaaaaagcgtacgacaagccataaaaatagtaaacgcagccattaaaaagtacggagacttcgataacatagtaatcgaaatggcaagggaaacgaacgaagacgacgaaaagaaagccatccagaaaatacaaaaggctaacaaagcagaaaaagatgccgcgatgaggaaagcggcaaaccaatacaacggaaaggcagagctaccccactccgtcttccacggccacaaacaactcgcaaccaaaatacgcctctggcaccaacaaggagagcgctgcctctacacaggcaaaacaatctcaatacacgacctgatcaataatccaaaccaattcgagattgaccacatacttcccctaagcataactttcgacgactctctggcaaacaaagtactggtctacgccacagccaaccaggaaaaaggccaacggacaccataccaggcactcgactccatggacgacgcgtggagctttcgtgagctaaaagcattcgtcagagagtccaaagcccttagcaacaaaaagaaagaatatctcttaacggaagaggacatctccaagttcgatgtacggaagaaattcatagagagaaaccttgtcgacacgcgatacgcctcgcgcgtggtcctcaacgccctgcaagaacacttcaaagcccacaagatcgacacaaaagtaagcgtcgtaagaggacaattcacaagccagctgagaaggcactggggcatagacaagacccgcgacacgtaccaccaccacgccgtcgacgctctcataatagccgcatccagccagctaaacctatggaagaaacagaaaaataccctcgtctcctactcagaggaccaactacttgacatagagaccggcgagctaatctcagacgacgagtacaaagaatccgtcttcaaagccccataccaacacttcgtggatacgctaaaaagtaaagagtttgaagacagcatactgttcagctaccaagtagatagtaaattcaacaggaaaatatcagacgctacgatctatgcgacgcgacaagcgaaggtaggcaaggacaagaaagatgaaacatacgtactaggaaaaatcaaagacatatacgcactcggaactaaaacgccgtcaaaaacgggcttctacaaattcctggacctctacaacaaagacaaatcacaattcctcgtataccaaaaagaccggaaaacgtgggacgaagtgatcgagaagatcatggaacaataccgccccttcaaggagagtgacaaaaacggcaaagaggtcgacttcaacccgttcgaaaaatacagaatcgaaaacggcccgataagaaaatactcccgcaagggcaacggcccagaaatcaaatcactcaagtactacgcaagcaaactgggaaaccacatcgacatcacccccaaagacagtaacaacaaagtcgtcctccaatccgtctccccatggcgcgctgacgtctacttcaacaaaacaactggcagctacgaaatactgggcctcaaatacgcggacctccaattcgaaaaaggcaccggcacatacagaatctccgaagagaaatataacgacataaagaagaaagagggagtcgactccgacagcgagttcaaattcaccctctacaaaaacgacctattacttatcaaagacaccgagaccaaagaacagagactgttcaggtttctctccagatccatgcccaacaagaaacactacgttgaactaaaaccctacagcaaagacaaattcgagaaaaacgaatcgctgatagaaattctaggcagcgccgacaaatccggacggtgtatcaaaggactcgccaagtccaacctttcaatcttcaaagtcagaacagacgtactcggaaaccaacacatcatcaagaacgaaggcgacaagcccaagctagatttctga

SEQ ID NO: 6317 - RNA, 3408 nt, synthetic construct
  misc_feature 1..3408: note = Cas9 variant
  source 1..3408: mol_type = other RNA
atgggcgtcatattcctatacgagaacatcgtaaaaccattcccaagcagatacgacaaggctataatgaaacgtctaaaggggcgccaaaccatggggtacatcctgtccctagatataggcatagcctcatgtggctactcagtcctagaaacagacgccctcggagtcccctacaagatcaaaacactaaacagcattatcttcacacgcgccgaaaaccccaaaaccggagcatcactagcagaaccacgaaggaaatatcgcggcgcccgccgtcggaaacgacgaacttccttccgaaagcacagaacgcgacaactattcatcacaagcggcctcctctccaaacaagacatagctagatacctaaaccagcaagaaccccacgatgacatatgggaactccgagtcaaaggcctagacgaaccactcacgaacctgcaactgttccaagtcctctactacttcgtgacacaccgagggttcaaatccaaccgaaaagccgaactcaaggacaaagacatagggcccgtcctgaactccatcaacgcgttcaaggaggaaatgcaatcacacgactaccgcaccatcggagagctatacgccaatgacccacgatttcgcgaccgaaaacacaacaaagactacaccaacggattcctaggcaccatacagcgttcctggctggtcgacgaaatcaaaatgctcctgaccaaccaacagtcattcggcaacacccagctgacatccgagttcatcgaactatacctcaacatattcacctcccaacggaacttcgacgacggccccgcatcaggaccctacagcggcgacctcatagacaaaatggtcgggccagatacgttcaaccggtcacgcaaacgggcaccccgagccacatacacattccagtatttcagctttctgtccaaattaaacagtctccggattgccccaagtatttccgcacctttcgaaacccttacagtcgaccaacgcgctctcataactaagaggctctggggacccgatgtcaaaagcgcagacctcaaattcaaacagatcaggatggtactctcacttcctgagacagcccgcttcaacctcgttaactacggcaacacgccagagaaagcgctcgaaatagaggacaaaaccaccttcatctcgatcaaaccccttagagaaatagaaaaagccctcacaggaaccaccctccccgtcagccacgaccaactagacgccatcgccaggatcctgacagtctacaaaagtgactccaatcgaaagacagctttccacaaccaaacagtgctgtcagacgaagttatcgaacaacttctgccgctcaatttttccaaattcggccacctatccgtcgagacaatgcaagagatcatcccctatctagaacaaggcatggtttactcggatgcagcaacggccgcagggtacgacttccggaataatcaaatcgacatggaatacattcgcgataacgtaacaaacccggtcgtacgcagggcagtttcagtcgcgaacaagctcgtaaaagctgtcgtacgccgatacggaaaaccggactcaatacacatagagctagcccgagatttatcccagaacttccaggaacgtcgccaagacgaagtcaggcaacagaagaacgcccgggacaacgagaaaatagccaagcgcctagaagaactgggcatacctgtcaacggagtcaacatcacgaagatgaagttatacgacgaacaacacggcattgacctatacgacctttcgaccaacgcatccatggccgtaaccgacatcttcagcgacgacaggtacgaaatcgaccacatcatcccatactccgtgagtttcgacgacagttacactaacaaagttctcgtatccgccaaagcaaaccgagaaaagagagaccgtattccaatggaggtgttcggtaacgacagcgaacgacggagacaattcgaaaaccgcgtcaacacaaacatcacaaacctaagaaagaaacgcaacctactgaaagaaaccttctcagatgaagacaaggccaagtggaaaagccgaaacataaacgacacccgctacctcaaccgaatcctaatgaactacctcagccaaaacgtcgagttcaccgacgtgctgtcagacgccaaacacgtaatcgccctgaacggagccgtcacagccaagatacgctcacgctggggaatcacaaaagtcagagcagccggggacctccaccacgctgtagacgccgtagttataggctgcgtcaccgacgccctcatccaagccgtcacccgctacgcaaagtaccaagagcgccgcgacaataaagccgcagcagaacaagacctagccgaaaacaacccagaagaactggatgctaaacaattccgaaaagtcttcaatgactaccccctcccctggcccgagttcagagaagaactaatgggacgcgtatcatctgacccaagtcaaattatggccggacgtcagtggtcccactatactgccgaagaaatctccgagctcaaacaaccgttcgtagtccgggtaccaaaccacagaatcgtcggcccagccaccctagacacggtatacggccaacccaacccagatgacgggctcatcacacagcgagtccgaataacggacctaaagccacagaaaaacaaggacggggaagacattatcaaggcgggcgcaaacgtctacgaactagccgccgatggcggcaacaaactcgtatacgaaagcatactggatgcgctccaagtcgcgggcggagacgggaagaaagccttccctacaggccgacttctagtacgttcccccatacaagacatcccggtcgagcgagtacgggtcacctcaaaagcaacgctagtcgtaccagtcggacccaaatcagtcgccgcaaacggatccatggtgagaatagacgtatacaaaacacccaagaaatacgtatttgtcccaatatatgtccgagacaccgtcaaagcagaactccccgaccgcgcagtcgcaccagtcaaaccttactcacaatggtaccaactacaaccaaaagaccaattcctcttcagccttttcgcgaacgatctgatacggttcaagcacccaagaggcgtctccaccaaggagatcctcaccgacggcagccaagaaaaaggcaagagaacagacgtagtcggctactttaccggagccgacatcgcaacagcaagcatcgccatcgaagggccagacaggtctttctcagcccgcggaatcggcttcgcttccctcaaaaatgtcgaaaaactaaccgtaaattacttcggcgaactccactccgtacacgagacacaaccaatgcaattccgcggccaacgaggatga

SEQ ID NO: 6318 - RNA, 3411 nt, synthetic construct
  misc_feature 1..3411: note = Cas9 variant
  source 1..3411: mol_type = other RNA
atgaacggtctagtgctcggcctagacattggcatcgcctccgtaggggtaggcatcctcgaaaaagataccggaaagataatccacgcatcctcccgactattccccgcagcaaccgctgacaacaacgtagaaagacgcagcaaccgacagggccggaggctcaaccgccgaaagaaacacagatcggtcagactccaggacctcttcgaatcatacgggctgttaacggacttctcaaagctaagcattaacctgaacccctaccaactacgagtacagggaatggagaaccaattaacaaacgaggaactctttattgccctgaaaaacatcgtgaagcgacgcggaatcagctacctagacgacgcctcagaagacggcggcaccgtctcgagtgactacggcaaagcggtcgaagagaaccgaagactcctaacggagaaaacgccagggcaaatacagctggagcgattcgaaaagtatggacaactacggggagacttcacagtagaagagaacggcgagaagagacggttgataaacgtcttctccacctccgcgtataggaaagaagccgaacgcattctgcggaaacaacaagagttcaataacaagatcacggacgagttcatagaagattacctcaccatactaacaggcaaaagaaagtactaccacgggcccgggaacgaaaaatctcggaccgactacgggagattcagaacggacggcacgacactggacaacatcttcggcatcttaataggcaaatgcacattctacccagaagaataccgagccagtaaagctagctacacggcccaagagttcaacctactcaacgacctaaacaacctcacagtacccacggaaaccaagaaactatccgaagaacagaagaaaacaataatcgaatacgcaaaaagcgccaaaaccctaggtgcaagcacactcctcaaatacatcgcgaagatgatcgacgcctcggtcgaccaaatacgcggctatcgcgtcgacgtcaacaacaaacccgaaatgcacaccttcgaggtataccggaaaatgcagtcactagaaaccatcaaagtagaagaactcccgcgaaaggtactggatgaactagcacacatacttacactaaacaccgaacgtgaaggaatcgaggaagccatcaatagtaaactcaaagacaccttcaacagagaccaggtcctggaactggtccaattccgcaagaacaacagttccctcttctccaaaggatggcacaacttcagcctcaagctcatgatggaactgatccccgaactatacgagaccagcgaagaacagatgaccatcctaacacgccttggaaaacaacggagcaaggaaaccagcaaacgcaccaaatatatcgacgaaaaagaactcaccgaagaaatctacaaccccgtcgtagcgaaatcagtgcgacaagccatcaagatcatcaacgaggccaccaaaaagtacgggatctttgacaacatcgtaatagaaatggctcgcgaaaacaatgaggaagacgccaagaaaaactacatcaaacaacagaaagcaaaccaggacgagaaaaacgcagcaatggaaaaggcagccttccaatataacggaaagaaagaactcccagacaatatattccacgggcacatggaactagcgacaaaaataagactctggcaccaacaaggggagaagtgtctctatacaggcaagaacatacaaatctcagacctgatacacaaccagtacaaatatgaaatcgaccacatactgcccttatccctgtccttcgacgacagcctcagcaacaaagtactggtgctagccaccgcaaaccaggaaaaaggacagcgcactcccttccaagcgctcgatagcatggacgacgcctggtcataccgcgagttcaagtcctacgtgaaagagtccaagctacttggcaataagaagaaagactatctgctaactgaagaagacatcagcaaaatcgaagtaaaacagaaattcatcgagaaaaacctcgtagacacccggtactcctcccgcgtagttctaaacgccctccaagacttttataagaaacaccaattcgacaccacaattagcgtagtccggggccagtttacgtctcaactcagacgcaaatggaaactcgaaaagagccgcgacacataccaccaccacgcggtagacgcactaataatcgccgccagctcccaactgcgtctgtggaagaaacacaacaatcccctaatcagctacaaggacggccaattcgtagattcagaaaccggcgaaatcgtaagcctgtccaacgaggaatacaaagagctcgtctttaaggcaccttacgaccacttcgttgacacgctaagatccaaaaagttcgaagactcaatccttttcagctaccaggtagacagcaaatacaaccgcaaaatcagcgatgcgacaatctacgctacccggaaggcgaaactagataaggacaagaaagagtacacatacacactgggcaaaataaaagacatctacgccctagggaccaaaacaccctcgaaaacaggcttctacaaattcctcgacctctacaaaaccgacaaaagccagttcctgatgtaccagaaggaccggaaaacatgggacgaggtaatagagaaaatcatcgaacaataccgcccattcaaagaatacgacaaaaacggcaaagaagtagacttcaacccatttgaaaaataccgaatcgaaaacggcccgatccgtaaatactctagaaaaggaaacggcagcgtaatcaagagcatgaaatactacgataacctcctagggaaattcgtcgacatcaccccctcggaaagcaaaaacccagtagcactcctatcactcaacccgtggcgaacagacgtatactacaacccagaaacccgaaaatacgaatttctaggactaaaatacgccgacttgtgcttcgggaagggcggtagctacggcatatcagaagtaaagtacaacaagatccgggagaaagagggcattgggaaagaatccgagttcaaattcaccctatacaaaaacgacctaatcttaatcaaggacaccgaaaccaactgccaacagttcttccgcttctggtccagaacgggcaaagacaacccaaaatccttcgaaaaacacaaaatcgaactaaaaccgtacgaaaaagccaaattcgaaaagggggaggaactcgaggtactgggcaaggtgccaccaagcagcaaccaattccagaagaacatgcaaatagaaaacctctcaatctacaaagtgaaaacagacgttctagggaacaaacacttcataaagaaagagggggacgagccaaaactaaaatttaaaaagtga

SEQ ID NO: 6319 - RNA, 3411 nt, synthetic construct
  misc_feature 1..3411: note = Cas9 variant
  source 1..3411: mol_type = other RNA
atgaacgggctagtcttaggactggacatcggaatagcctccgtcggcgtcgggatcctcaagaaagacaccggggagattatccacaccaacagccgactattctcagccgctaccgccgactccaacatagaaaggagacgtcatcggggagggaaaaggctcaccagacggaagaaacaccgcagcatccgtttacacgaccttttcgaggatagcgggctcctcaccgacttctcgaaagtaagcataaacttgaacccgtatcagttacgcgtacagggtctagacaaccagctaactaatgaggaactattcatcgcactcaaaaacatcgtgaaacgccgaggaatatcctacctagacgacgcatccgaagacgggggcaccgtaagctccgactatggcaaagcggtcgaagaaaaccgcaaactcctagccgagcagacaccaggacagatacagctagaccgcttcgaaaagtatggccaagtccgcggcgatttcacagttgtagagaacggcgaaaaacgaagactaataaacgtgtttacaacatccgcttactctaaagaagccgaacgcatcctgcgaaaacaacaagagttcaacaagaaaataaccgacgagttcatagaaaattacctaaccatcctcaccggaaaacgcaaatactaccacggccccgggaacgaaaaatcacgaaccgactacggccgctatacgaccaagaaagacccagaggggaaatacatcaccctagacaacatctttggcatactgatcggaaaatgcacgttctatccggacgaataccgggcgtctaaagcctcatacacagcacaagagttcaacttacttaacgacctaaacaacctcaccgtccccacagaaaccaagaaactgagcgaagaacaaaagaaaaccataatcaaatacgccaaaactgcaaaaacactgggcgccagcacactgctcaaatacatcgcaaaactcattggggcatcagtcgaccaaatacacggataccgcatcgaccccaacaagaaacctgaaatgcacaccttcgaaacctacagaaaaatgcagtccctagaaacaatcagcgtagaagaaataccacgcaaagtactagacgagctcgcccacatacttaccctcaacaccgaaagagaaggaatcgaagaagcaataaacgccaccctcaaagataccttctcccaagaccaagtactggagctagttcaatttcgcaaaaacaacagtagcctattcagcaaaggctggcacaacttctctctgaaacttatgatggaactgatccccgaactgtacgaaacctcggaagaacaaatgactatcctcactcgcctaggaaaacagaaaagcaaagaaacgtccaaacgcaccaaatacatcgacgaaaaagagttaacagaggaaatttacaacccagtagtagcgaaatcggtccgacaagccatcaagattatcaacgaagcgaccaaaaagtacggtatattcgacaacatcgttatagaaatggcacgcgaaaacaacgaggaagacgccaagaaaggatacaacgaacgccaaaaagcaaacctagacgaaaagaaatcggcaatggagaaagcagccttccaatacaacggcaagaaagagctaccagacaacgttttccacgggcacaaagagctggccaccaagatccgtctctggcaccaacaaggggagaaatgcctatacacggggaagaacatccccatcagtgatctcatacaaaaccaatataaatacgagatcgaccacatactccccctcagcctgagcttcgacgactcactatccaacaaggttctggtccttgcaacggccaaccaagaaaaaggccagagaacccccttccaagccttagattccatggacgacgcatggagctaccgagagttcaagtcctatgtcaaagacctaaagctactctcaaacaagaagaaggactacctactgaccgaggaggacatatcaaagattgaggtcaaacagaagttcatcgaacgcaacctggtcgataccagatacagctcgcgcgtcgtactcaacgccctccaagacttctacaaagaacaccaatttgacaccaccatctccgtcgtccggggccaattcacgtcacaactcagacgcaagtggggcctcgaaaaatcgcgcgaaacctaccaccaccacgcagtagacgccctaatcatcgcagcctcatcacaactacgtctctggaagaaacaaaacaaccccctaatcagttacaaagaaggtcaattcgtagaccaagagactggggaaatcattagcctaagtgacgacgaatacaaagaactggtcttcaaagcaccgtacgaccacttcgtggacacactaaaatccaagaagtttgaggacagcatcctcttctcctaccaagtcgactccaaatacaaccgaaaaatatccgacgcgactatatacgccactagaaaggcgaaactagacaaagaaaagaaggaatacacgtacaccctcgggaagataaaagacatatacgcattggggtcagagaaactcaagacaggattctacaaatttctacacctctacaagaaagacaaaagccagttcctcatgtaccagaaagacagaaaaacctgggacgaagtcatagagaaaatcctggaacagtaccgtccatttaaagaaaaagacaaaaacggaaaagaagtagacttcaaccctttcgaaaaataccggatcgaaaacggccccatccacaaatactcccggaaaggaaacggcccggtgataaaatcactaaagtattacgacaaaaatataccggaatccttcatcaacatcacaccctccaactccaaaaataaagtcatcctaagacagctcaacccgtggcgaacagacgtctacttcaaccaccaaacagaaaagtacgagctgttaggcctcaaatacgcccatctgcaattcgagaagaaaaccggcaactatagcataaccatcgacaaatacaacgagatcaaggaaaaagagggagtcagcgaacaaagcgagtttaaatttactctgcacaagaacgacctactcctcataaaagacacagagaccaaggagcaacaactgtttcgcttcctcagcagaaccaagcccaacgtcaagcactacgtcgagctcaaaccctacagcagagacgagttcgaaaagaacgaacgcctcatagaaatactaggcagcgtcgacaaaagcgggagattcgtaaaagggttgggcaaaagtaacctatccatatacaaggtccgcacagacgtactcggtaaccaacacatcataaagaaagaaggcgaggaacctaaacttaaattctga

SEQ ID NO: 6320 - RNA, 3411 nt, synthetic construct
  misc_feature 1..3411: note = Cas9 variant
  source 1..3411: mol_type = other RNA
atgaacggactcgtcttaggcctcgatatcggcatcgccagcgtcggagtgggcatcctggagaaagacacgggcaaaataatccacgcctcatcccgcctattccccgccgccaccgcggacaacaacgtcgaaaggcgcagcaacaggcaggggcgccgactgaaccggcgaaagaagcaccgcagcgtccgactccaggacctgttcgaggggtacgggctgctgacagacttcagcaaagtatccatgaacttaaacccctaccagctcagggtgcagggcatggaaaatcaactgaccaacgaagaattatttgtcgcacttaaaaacatcgtcaagcgaaggggaatatcataccttgacgatgccagcgaggatggcggcacagtctccagcgactacggaaaagccgtcgaagaaaaccgcaaactactggccgagaaaacacccggacagatacaactggaacggttcgaaaagtacggacaactcaggggagacttcaccgtagaagaaaacggggaaaaacaccgactaataaacgtcttcagcaccagcgcataccggaaggaagcagaacgtatcctcagaaagcaacaagagttcaatagcaaaatcacggacgaatttatagaggattacttgataatcctcacgggtaagcgcaagtactaccacgggcccggcaatgagaaaagccgcacagactacggccgattccgaaccgacggcacaaccctggacaacatattcgggatcctgataggaaagtgcacattctacaccgaagaatatagagcgagtaaggcctcgtacacggcgcaagagttcaatctgctcaacgacctaaacaaccttacagtaccaacagaaaccaaaaagctatccgaagaacaaaagaaacttatcatcgaatatgccaaaagcgccaaaacccttggcgcatcaaccctactgaaatacatcgcgaaaatgatcgacgccagcgttgatcaaattagaggctatcgggtcgatgtcaacaacaagccagagatgcacaccttcgaggtatacaggaagatgcagagcctcgagaccattaaagttgaggaacttccccgaaaagtactcgacgagctagcccatatactgacgctaaacaccgaacgtgaggggatcgaagaggcaataaactctaaactcaaagacatctttaaccgagaccaagtactcgaactcgtccaattccgcaaaaacaacagcagcctcttctctaaaggttggcataacttctccatcaaattgatgatggaactaatcccagagctgtacgagacctccgaagaacaaatgaccatcttaacccgactcggaaagcaacgatcaaaggagacgagcaaacgaacaaaatacatcgatgagaaggagctgacagaggaaatttacaacccggtagtagcgaaaagtgtacggcaagcgatcaaaataatcaacgaggcaacgaaaaagtacggaatcttcgacaacatagtgatagaaatggcccgagaaaacaacgaggaagacgcaaagaaagactatatcaaacgacagaaagcaaaccaagacgaaaagaacgctgcgatggaaaaagcagcattccaatacaacggcaagaaagagctgccagacaacattttccacggtcataaagaactgacaaccaaaatccgcctatggcaccaacagggagagaagtgtctatacacaggcaagaacataccaatcagcgacctcatacacaaccaatacaaatacgagatcgaccacatcctccccttaagcctcagcttcgacgactcattatccaacaaggttttagtactagccaccgcgaaccaggaaaagggacagcggacgcccttccaggcactagacagcatggatgacgcctggagctaccgagagttcaaatcctacgtaaaggacagcaaactgctcagcaacaaaaagaaagactacctgctcactgaagaagacatatcaaaaatagaagtcaaacaaaaattcatcgaacggaacctagtagacacccgatactcttcccgcgtggtcttgaacgccctccaggacttctacaaatcccaccaactggacacgacaataagcgtagtcagaggacaattcaccagccagctacgacgaaaatgggggatcgagaagagtcgcgagacttaccaccaccacgccgtagacgccctgatcatagccgcctccagccaactccgactatggaagaaacactccaacccgttgatagcatacaaagaagggcaattcgtcgacagcgaaacgggagagatagtatcactaagcgatgaggaatacaaagagcttgtcttcaaagccccatacgaccacttcgtagataccctgcgctccaagaaatttgaggactccatactgttcagctaccaggtagactcgaaatacaaccgtaaaatctccgacgccaccatctacgccacgcggaaagcgaaactagacaaagaaaagaaagagtacacatacaccctaggtaaaatcaaagacatctacgccctcggcaccaagaccccctccaaaaccggcttctacaaattcctcgacctatacaaaacggacaagagccaattcctcatgtaccaaaaagacaggaagacctgggacgaagtcatcgagaaaatcatagaacagtacagacccttcaaagaatacgacaaaaacggcaaagaagtagacttcaaccccttcgaaaaatacagaataggcaacggcccaatacgcaagtattccaagaaaggaaacggccccgagatcaaaagtctgaaatactacgacatcctccttggaaaacacaagaacataacccccgacggcagccgcaatacggtggccctcctctccctaaatccatggagaacagacgtgtactacaactccgaaaccaaaaagtacgagttcctcggactaaaatacgcagacctctgcttcgaggaagggggcgcatacgggatctcagaagtgaagtacaagaaaataagggaaaaagagggaatcggcaaaaacagcgagttcaagttcacgctgtacaaaaatgacttaatccttatcaaggacacagaaaccaattgccaacagttcttccgcttctggtcccgcacaggaaaagacaaccctaagtcattcgaaaaacacaaaatcgagttaaaaccatacgaaaaggccaagttcgagaaaggcgaggaactcaaagtcctgggcaaagttccgccctcgtccaaccaatttcagaaaaacatgcaaatagaaaacctctccatatacaaagtaaaaacggacatcctcggcaacaagcacttcatcaagaaagagggagacgaacccaaactgaaattcaagaaatga

SEQ ID NO: 6321 - RNA, 3420 nt, synthetic construct
  misc_feature 1..3420: note = Cas9 variant
  source 1..3420: mol_type = other RNA
atgtccgacctcgtcctcggactagacatcggtatcggatcggtgggcgtcggaatcctaaacaaagtaacaggtgagataatacacaaaaacagccgcatcttcccggccgctcaagcagaaaacaacctagaacgacgcactaaccgccaagggcgacggctcacacgtaggaagaaacacagacgcgtcagactaaaccatcttttcgaagagtccggactaatcaccgacttcactaaggtcagcataaatctcaacccataccaactacgcgtcaaaggtctaaccgccgagctctcaaacgaagaactattcatcgcactcaaaaacatggtgaaacaccgaggaatatcatacctagatgacgcctccgacgacggcaactcgtcagtcggcgactacgcccaaatcgtcaaagaaaactcaaaacaactcgaaaccaagaccccaggccagatccaactcgaaagataccaaaaatacggacaactccgaggcgacttcacagtcgaagaagacggacgaaaacacagactgatcaacgtcttcccgacgagcgcctatcacgcagaagcgctccgcatactacaaacacaacaagagtttaacccccagatcactgacgagttcataaactcatatctggaaatcctcaccggcaaacgcaaatactatcacggccccggcaacgaaaaatcccgaactgactacgggaaatacaccacaaagaaagacgcacagggacaatacatcaccctgaacaacatcttcggaatattgatcggcaaatgcaccttctaccccgaagaataccgcgctgcaaaggccagctacacagcccaagagttcaacctcctaaacgaccttaataacctcaccgtaccaacagaaaccaaaaagctaagcgaagaacaaaaataccagatcattacctacgtcaagaacgaaaaagccatgggaccggctaaactcttcaaatacatcgccaaacttctctcctgtgacgtagccgacataaaagggtacaggatcgacaagagcgacaaggccgagatccacaccttcgaagcataccgaaaaatgaaaaccctagaaacattggacgtaaagaaaatggcgagagaggaactggacaaacttgcctacgttctaaccctcaacacggagcgcgagggaatacaggaagccctagaccacgagttcgccgacgggactttcagccaggaacaagtcgacgagctagtccaattccgcaaggccaactcatccatcttcggcaagggatggcactccttctcggtcaaactcatgatggagctgataccagaattatacgccacatccgaggagcagatgacaatcttaacacggctaggcaaacagaaaacaaccagttctagtaacaaaaccaaatatatcgacgaaaaacaactaaccgaagaaatctacaaccccgtcgtagcgaagtcggtacgccaagccatcaagatagttaacgccgccattaagaaatacggtgacttcgacaacatcgtaatagaaatggccagggagactaacgaagacgacgaaaagaaagccatccagaaaattcaaaaagccaacaaagccgaaaaagacgccgccatgcgcaaagccgcgaaccaatataacggaaaagccgaactaccacactcagtcttccacggacataaacaactcgctaccaaaatacgactgtggcatcaacaaggcgaacgatgcctatatacaggaaaaaccatatccatccacgacctaatcaacaaccccaaccaattcgaaatcgaccacatcctaccactttcgatcactttcgacgactccctagcgaacaaggtcctagtctatgccacagcaaaccaagagaagggacaacgcacgccataccaagccctcgactccatggacgacgcgtggtcattccgcgaattaaaagcgttcgtacgcgaatccaaggccctcagcaataagaaaaaggaatacctcctaaccgaagaggacatctcaaaattcgacgtgcgaaagaaattcatcgagcgtaacctcgtagacaccagatacgcctccagagtggtgctcaacgccctccaagaacacttccgcacacataaaattgacaccaaagtctccgtcgtccgcggccaattcacctcccaactacggcgacactggggaatcgagaaaacccgcgacacctaccaccatcacgcagtcgacgccctgataatcgcagcctccagtcagctaaacctatggaaaaagcagaagaacaccctagtctcatattcggaagatcaactcctcgacatcgaaacaggggaactgatctctgacgacgaatacaaagagtccgtcttcaaagccccttaccagcacttcgtagacacccttaaatcaaaagagttcgaggacagcatactcttctcttaccaggttgactcaaaattcaatcgaaagatctcagacgccactatatacgcaacgcgcaaagccaagctagacaaggagaaaaaggagtacacctacacgttaggcaaaatcaaggacatatacgccctcggcaccaaaactccctcaaaaaccggattctacaaatttctggacctgtataagaaagacaaaagccaattccttatgtaccagaaagaccgacgaacatgggacgaagtgatcgagaaaatcctcgaacagtaccgccccttcaaagaaaaagacaaaaacggtaaagaggtcgacttcaacccgttcgagaaataccggatcgaaaacggcccgatccgaaaatactcaagaaaaggcaacggcccagaaataaaaagccttaagtactacgacaacttgctagggcggttcgtggacatcactccctcagaatctaagaacccggtagccctgctgtccctaaacccatggcgaactgacgtctattacaacacagaaacccgcaaatacgagttcctaggtctcaaatacgccgacctctgcttcgaaaaaggcgggtcatacggcatcagcaaagtgaaatacaacaagatcagggagaaagagggtatcggcaaaaactccgagttcaaatttaccctatacaagaacgacctgatactcattaaagatacggaaacaaaccgccagcagatcttcagattctggtcccgcactggaaaggacaacccaaagtccttcgagaaacacaaactcgaacttaaaccctacgagaagacacgcttcgaaaagggagaggaactcaaagttctagggaaagtacccccatcctcaaaccgcctacagaagaacatgcaaatcgagaacctgagcatctacaaagtccgcaccgatgtcctcggcaaccaacacatcatcaaaaacgaaggggacaagccgaagttagacttctga

SEQ ID NO: 6322 - RNA, 3420 nt, synthetic construct
  misc_feature 1..3420: note = Cas9 variant
  source 1..3420: mol_type = other RNA
atgaactactacaacggattcatcataaccgagaacgcaatggccagcaaacacgaaaacttaggagctctaaccttcggactagacatcggcatagcctccgtcggctgggctgtcttaggcgaaaaccgcataatcgacctcggagtacggtgcttcgacaaagcagaaaccgccaaagaaggagagagcctcaatctagccagacgtacagcacgcttactgagaagaagactccggcgccgtgcctggcgactgacaaaacttgcccgactgctcaaacgagagggactcatagccgacactaacgtgttccaaaagccattcaacctgaaagacgcaaacgaaaaaggcctatctttctggcaactgcgcgtggatgctctagacagaaaactaagcgcagaggaatgggcccgagtcatctaccacctgtgcaagcaccgcggattccactggatctctagggcggaagaaaaggccgcggaaggggacagcaaaagcgagggaggaaaagtcaaacaaggcctcgccggcacaaagaaactgatgcaggaaaagaattaccgcacggcagcagaaatggtcctaacagagttccccgaagcccaacgcaacaaacaaggtgactactcaaaagccctctcacgtatcctgctaggcgacgaaatgacgcaactattcaagcaccagcgagagctaggcaacccgcatgcgaccgagaagttagaggcggcaatcctcgggaacggagaccacaagagcggcctgttctgggcccaaaaccccgcgctggccggtaacgacctgctcaaaatgctggggcactgcacattcgaaaaagctgaatacagagtccccaaagctagcttcacagccgaaaggcacgtctggctgacacggctaaacaacctgcgaatcgtcgtggacggcacaacacgtcccctcaacgaggccgaacgccacctagccctgctaatgccctaccaacaggcaggagatctaacctacaaacagttacgcacagcgctcacaaaagccggatacctaccagaatcattcagatacacaggcctagcatacgccagcggccaaaaagcagacgagaaggccaaagacccagaatcagcgccgctcgtcaaactgccggcatggcacgaacttcgaaaaaccttggaaaagaaagaactcgcctcagagtggcagaaaataagctcggacgcgctcgacggaaaaccccaactgctcgaccaaattgcttgggtacttagcgtctacaaggacgacaccgaggtcgaagcggaactctgcaaattaaacctacccaacgcggagaaaatgatagacgcactactagacatccgcttcgacaagttctcaaatctcagcctaaaagcactccgccaaatcgtacccctcatggaacaaggacaacgatacgacgaagcagtagcaaacatacctgaatacggtcaccactcacaactccacgaagtcggcgcgggcgaacataagtatttaccacccttctacaaagagcgcgacaaaaccggtagaatggtattcaatgacgacatggacataccccgcaacccagtagtactaagggccctaaaccaagcgaggaaagtcgtaaacgccctcattaaagaatacggatcaccacacgaagtacacatagaaatggctagagacctttcaaggcccctcgacgagagacgcgacgtggaaaaacttcaaaaagaatttagagatcgtaacgaaaaagacaaggccctattcgcccaggatttcaacatcgtcggtgccgtcaaaggaaaagagttcgagaaataccaactgtaccgggagcaacagggcaagtgcgcatattcaatcgagccaatggacatccataggcttttcgaacaaggatacgtcgaaatagaccacgcgttgccgtattcaagatccttcgacgactcaaagaataacagagtcctcgtcctagccaaagaaaacagagacaaaggtaacagaaccccattcgaatacctcggaggcaaagataactcagagcgatggcgccaattcgtcgccttcgttgaaggcaacaagtcctaccgcttggcgaaacgaagtcgcctactacggaaggacttcgggaaagacgaagctaaaggattccgcgaacgcaacctcaacgatacccgctacatctgccgattctttaaaaactacgtagaacaatacctccaactccacgaagactccgacgccaagcgctgcgtcgtactaagcggccaaatgaccagcttcctacgagcgaggtggggcttagtaaaagtacgaggcgacagtgatcgccaccacgccctcgacggcgccatcgtcgcagcctgcagccacagcatggtcaaacgtctcagcgactacagtagaagaaaagagctagaacaagtgcgcgccggcttcgtggacgtcgacaccggcgaaatcgtcaatccagccatgttccaacaagttcaagaacacttccccaacccgtggccacactttcgagatgaggtgaaactcagactgaatgtagacgacccagcactcctgcactccgaaatgaaccgcttcggaacctactcccccgaagctctaaaagccctccgccccctcttcatctcacgagctccgcaaagacgtaacagcggagccgcgcacaaagacacaatctacgcgcagccagagagacttgtcgcccaaggcggcgtaacccagaaagtccccttaacctccctcacactaaaagacctagacaaactaatagacccacacagaaacgaaaaactttacagtgcaatccgtattcgactcgagcaacacggaggcaagggggacaaagccttcccggccagcaacccactaaggaaacccgacagcgaaggcaacccgacaggtccaatagtaagaggcgtgaccatggtcatcgacaaattgtcaggcatccccattcgaggagggatagcaaagaacgatagcatggtcagagtcgatgtattcacgaaagccgggaaattccacctcgtcccagtgtacgtccaccacgccgtcgcgaaagtactacccaaccgcgccgtagtggcatacaaagacgaaacagaatggacacttatcgacgacggattcgacttttgcttctcaatgtacccaaacgacctcctgcggatcaaactacgcaatgcatcgcatctaggatactacgcctcgtgcaaccgaagcacaggggcgataaacctgtggtcgcacgaccgcaaccaacaggtcggcaaagatgggatgattgagtcaataggcgtcaaaaccgccttaaacgttgaaaaactcaacatcgacgtactaggaaaccgctaccctgcaccaccagaaaaacggcgcgacctcgcatga

SEQ ID NO: 6323 - RNA, 3423 nt, synthetic construct
  misc_feature 1..3423: note = Cas9 variant
  source 1..3423: mol_type = other RNA
atgaaaaatatgacgaaagtcaacgtcggccttgatgtgggtatctcatccgcaggctggagtgtaatcaacgccgaaaccaaccaaatactcgaatccggagtgcgcctcttcagtggctctgacgcggacgaaaacgtgaatcggcggaaccaacggcaaggccgaagactgttccgacgccgcaagctccgcatacaagaagcgaagaaatacctcgaaaacgtgttccagcttaaagatatagaacccaaagacgaatggaacccctacgaaatacgtgtccgagccctcaacgagaaagtgagcaaagaagaactctcaattgcactgcttaacatcgtcaagcaccgaggcataagctacgaactggaagacgtaaccgacgaagaaggtacaaacacacagagcttccaatctggcctggactacaatcggcggctgctaaagaccaaaactgttggagaaatccaatacgaccgattgcaaaagtacggccaagtacgaggacagatccaaaccgaggacggactactaataaacatctttcccacaaagaactacgtcgaagaagtcgaaaggatccttgaaacccaaaagaaataccacccagagatcgacgacgtatttatagagaaaatcatctcattcgtaaccagaaaacgcgaatacttcgtaggtccgggcaacgaaaagagccgcacggactacggaatataccgagaaaacggcgaaacgctcgacaacttgtttgagatcctcatcggcaaagacaaattctaccccgaagaataccgtgccgcgggcagctcctataccgcccagatcttcaacctgctcaacgaccttaacaacctcaggatccccacgactgaagatcaccacctgaccaaagcacagaaagaggaaatcatcaccgagctgaaaaacacatcccgcctgagcgggggaatgttgaaactcatcagcaaagttaccaaagcccccaaagaagagatttccgggtaccgcaaggacgagaaggacaaaccggaccttcacagcctggcatactacaggaaacagaaaaacatgctcgagaaagaaggtatccaaatagcagacttctcagaagaactcctagacgaactagccaccatgatgacactaaataccgagcccggagagatccggaagcaacttaacaaaatcacgaaccagtacgacatactgacgccggaggtgatagaagtcctagtcaagaaccacaccgccttcgtggctaccagcaaccacaaatggcatcgattcagcctaaagctgatgaaagagttcatcccagaactcctagaaacgtccaaggaacagtcgaccatactctgcgaacgaggattcatccaaaaccgggccagctacctggacgagaaccaccacttcaactacgctgaactgagagagaacctgtacaacccagtagtccgcaagtccacgtgcgaaatgctcaaagtattcaccgccatccaagaaaaataccccaacatacaaaacgtaatagtagaactcccacgagaaaccaacgaagatgagcaaaagcgtaaaataaagaaaataaacgacaataacgccaagcgtaaaaaggaaatactaaaagaagcacaagcacaaagcgggctcagcgaggaagcactggaagaaaaactcctcaagaccaaaggcctctacctaaaactgatgctgtggtacgagcaggaaggcaaatgcgtctatagcggacaagagatccccctatcagacctactacaaaacaaagggggctacgaggtcgatcacatcattcccatatccatatccttcgacgaccgtctctgcaacaaggttctggtccgacaacagctcaatagccagaaaagcaatcaaaccccattcgaatacatgaccacacacaccgacggacacctatccttccacgaattgaaagaactggtcggcaagaacaaaagattctccaaagaaaaacgagaactcctactcgccgaaatatacagcaacgacatcgaaaccaggaaacgcttcatcaacagaaatctagtggatacatcctacaccgcacgcatcgtactaaacgcgctccagcagtataaaaaggaaaaccaactatccatgaacgtaagcgtcgtgagaggcgcgatgacgaacatcctccgcaagaaagtaaaactggacaaaacacgagagacgtttcatcaccatgcaatagacgcaagcctcatggccgtcataccaaatatagagtttttcaaagaacgcaaagaatggctacctaagtccgcgaatgaagaagtcgtcgaagtcgaggtctcggaggaggaaacgatgccggaaaaggagttcaaggtaaaaatgcgtctcccagaatcattcatccaagatgtccagatcctccagcgaaacagcttcgcaaaggaagaagtatccggcccccagacacgagaacgcaacctgaaaatcaagttctcccaccaagtagaccagaaaatgaaccgaaaagtcgcagacgacacaatttacggaacacgccaagcacaactgggcaaagacaagaaagaagagacctacgtaatcggcaaaataaaggatatttacaactacgatgaatacgtacgcttcaagaaacgatacgacaaaaacaaagaatcattcctcatgtaccaccacgacccccaaaccttcgaaaaattggaagaaatactcgcccaataccccgagtacatagaggacgaaaaaggcaaaaagaagaaagtatcacccttcgctctttaccgcgaagaaaacggacccgtaaccaaatacgcaaagaaaaacaacggacccgtcatcaaacaactgaaatactacgactccaaactcaatcgaaaaatcgacatatcccataaatactcaaccaaaaacagacaggtcgtactccaatccctaaaaccgtacagaacagacgtctaccggaaccaagacaccggagaatacaccctcgtcggcatagaccaaaatgacggcaaattcgtcaacggacactacggcatacccaaaagccgatacgaagaaatcaaagcaaataataaactcagcgaacacgatgagttcgtcttttcactatacaaaaacagcatggttaaagtgatagacgaaaacggagaatccatcgtcgtgagatacctctccaggtcaatgcccaaccggaaaaacaatgcagaaataaaacccgtggagaaatatcaattcgaagatggcgaagtggtaccagtctacggcaaatgcaggaaacagatgcagacagtattcgtgaagaaaggctggacactactaaaaggcaatacggacatcctcggcaacacatacttcgtcgaaaaagaaagcgaaaacccgaagaaaatgatcgacgacaaatga

SEQ ID NO: 6324 - RNA, 3423 nt, synthetic construct
  misc_feature 1..3423: note = Cas9 variant
  source 1..3423: mol_type = other RNA
atgcgcgagaacggatcagacgaacgccgacgcaacatggacgaaaagatggactaccggatcgggctagatatagggatcgcaagcgtaggctgggcggtactacaaaacaactccgacgacgaacccgtccggatcgtagacctcggggtccggatcttcgacacagctgagataccgaaaacaggagagtccctggccggacccagacgcgccgccagaacgacccggcgccgcctaagacggcgcaaacatcgcctcgaccgcataaaatggctattcgagaaccaaggcctcatcaacatagacgactttctgaaacggtacaacatggcaggcttgccagacgtgtatcaactacgatacgaagcactagacagaaagctgacggacgaagaactggcgcaggtactcctacacatagcaaaacaccgaggattcaggagcactcgcaaggcagagaccgcagccaaagagaacggagccgtcctaaaagcaacagacgaaaaccagaagcgcatgcaagagaaaggatataggacagtcggcgagatgatctacctagatgaagccttccgaaccggatgcagctggagtgagaaaggatacatactcacgcctagaaacaaagcggaaaactatcaacacacaatgctgcgagccatgctcgtagaggaggtcaaggaaatcttctcctcacaacgacgactaggaaacgaaaaagccacggaggagctagaagaaaaatatctcgaaatcatgacctctcagaggagcttcgacctcggaccgggaatgcagccagacggcaaaccatccccatatgcaatggaaggattctccgaccgagtgggaaagtgcacattcctaggcgaccagggagaacttagaggagccaaaggcacatacactgcagaatacttcgtagcgctgcagaaaataaaccacacgaagctcgtcaaccaagacggggaaaccagaaacttcaccgaagaggagagacgcgcactaacactattgctctttacccaaaaggaagtaaaatacgccgcagtccgcaaaaagctgggtctccccgaagacatcctcttctacaacctaaactacaaaaaggcagcaacaaaggaggaacaacaaaaagaaaaccaaaacaccgaaaaagcaaagttcatcggaatgccctactaccacgactacaagaaatgcctggaggaaagagtgaaatacctaacagagaacgaggttagagacctcttcgatgagatcggaatgatactcacgtgctacaaaaacgatgactcgcgcacggaacgactagccaagttaggtctagtccccatcgaaatggaaggactactcgcctacacaccaacaaaattccaacacctctcaatgaaagcaatgcgaaacataatccccttcctcgagaaaggcatgacctacgacaaggcgtgcgaagaagccggctacgacttcaaagcagactcaaaagggaccaagcaaaaactcctaaccggggaaaacgttaaccaaacaataaacgaaataacaaacccagtggtaaaaagaagcgtaagtcaaacggtaaaggtaataaacgccatcataagaacctacgggtcaccgcaagcaataaacatcgaattagctcgcgagatgtcgaagacattcgaagagaggcgcaagatcaagggcgatatggaaaaacgacaaaagaacaacgaagatgtgaagaagcaaatccaggagctagggaaactatcccccacaggccaggacatcctaaaataccggctatggcaagaacaacaagggatatgcatgtactcaggcaagaccatacccttagaagaactattcaaacccggatacgacatcgaccacatcctaccttacagcataacattcgatgactccttccggaacaaggtcctcgtcaccagccaagaaaacagacaaaaaggcaaccgcaccccttatgaatacatgggcaacgacgaacaacggtggaacgagttcgaaacgagagtcaagacaaccatccgcgactacaagaaacaacaaaaactgctaaagaaacacttcagcgaagaggagaggagcgagttcaaagaacgcaacctaaccgacaccaaatacataacgacagtcatctacaacatgataagacaaaacttggagatggctcccctaaacagaccagaaaagaagaaacaagtacgcgccgtaaacggggccataacggcatacctccgcaaacgttgggggctaccacagaaaaaccgcgagaccgacacacaccacgcaatggacgcggtcgtgatcgcgtgctgcacagacgggatgatccagaaaatcagcaggtacacaaaagtacgagaacgctgctacagcaaaggcacagagttcgtagacgccgaaacaggagaaatcttccgtccagaagactactcaagggccgaatgggacgaaatcttcggagtccacatcccaaaaccatgggaaacgttcagagcagagctggacgtcagaatgggcgacgacccaaaaggcttcctggacacacacagcgacgtggctctcgaactagactacccggaatacatctacgaaaacctcaggccaatatttgtcagccgaatgcccaaccataaggtgacgggcgcagcccatgcagacactataagatcaccccgccacttcaaagacgagggcatagtcctaacaaaaaccgccctaaccgacctcaagctcgacaaggatggagaaatcgacgggtactataacccccaatccgacctgctcctctacgaggcgctcaagaagcaactcctgctctacggaaacgatgctaaaaaggcatttgcacaagacttccacaaaccaaaagcagacggaacggaaggaccggtagtgcgaaaggtaaagatacaaaagaagcaaacaatgggcgtcttcgtcgacagcggtaacggaatcgcggaaaacggcggcatggtccgcatcgacgtattccgggtaaacgggaagtactacttcgtcccggtttacacggctgatgtcgtcaagaaagttctgccaaaccgggcgagcacggcacacaaaccgtacggcgaatggaaagtcatggaagacaaagacttcctcttctcactctactcgcgagacctaatccacattaaaagcaagaaagacatcccaataaaaatggtaaacggaggaatggaggggataaaagaaacatacgcctattacataggcgccgatatctccgcagctaacatccaaggcatcgcacatgactcacgctataaatttcgaggactgggcatccaaagcctcgacgtgctagaaaagtgccagatagatgtcctcggacacgtcagcgtagtacgcagtgagaaaagaatgggattctcatga

SEQ ID NO: 6325 - RNA, 3423 nt, synthetic construct
  misc_feature 1..3423: note = Cas9 variant
  source 1..3423: mol_type = other RNA
atgaatgggctagtcctcgggctcgatataggtatagcgtccgtcggagttgggatcctcgagaaaaacagcggtaaaatagtccacgcgtcgtcccgtatcttcccggccgcgacggcagacaacaacgtcgaacgccgaaagaacagacaagcccggcggctcaaccgccgtaaaaagcatcgcggggtccggttccaagacctattcgaagactacggactcctcaccgacttctcaaaggtcagcatcaaccttaacccctaccgactccgcgtcgatggcctgaaccaacagctcactaacgaagagttattcatagcactcaaaaacatagtcaaacgccgcggaatcagctacctagatgacgcctctgaagacgggggcacggtatcgagcgactacggaaaggccgtggaggaaaaccgaaaactcctcgcggaaaagacacccgggcagatacaactggaacgattcgaaaaatacggccaactccgaggggactttaccgtcgttgaaaacggagaaaaatgccgtctgataaatgtatttagcacctccgcctacaagaaagaggctgagcgaatacttcgcaaacagcaagacttcaacaatcaaatcacagacgagttcatagaagactacctcaaaatcctcaccggcaaacgaaagtactaccacgggccaggcaatgaaaagagccgcaccgactacggccgctacacgacccacaaagatagcaagggtgagtacgtcacgctagacaacatattcggcgtactaataggaaaatgcacgttttaccccaacgagtacagggcgtccaaagcctcctacacagcccaggagttcaacctactcaatgacctaaacaacctaacggtacccacagagaccaagaaactttccgaagaacagaagaaaacgataatcgaatacgcgaaatccgccaaaaccctgggagccagcacactccttaaatacatcgcaaaaatgatcgacacttcggtcgatcaaatacgcggataccgggtagacgttaacaacaaacccgagatccacacattcgaagtataccgaaaaatgcaaagcctcgagaccataagcgtcggagaactcagccgcaacgtactagacgagctagcacacatcctaacactcaacaccgaacgcgagggtatagaggaggccataaacacaaagctgaaagactccttctcccaggaccaagtcctggaactcgtccaattcaggaaaaacaacagctctctcttcagcaaagggtggcacaactttagcctaaaactaatgatggaactcataccggaattgtacgaaacctcagaggagcagatgaccatactgacccggctgggtaagcagaaaagcaaagaaacgtcaaaacgaacaaaatacattgatgagaaggagctaactgaggaaatctacaaccccgtcgtcgctaaatcagtcagacaagccatcaagataatcaacgaggcaaccaagaagcacggtatattcgacaacatagttattgagatggcccgagaaaacaacgaagaggatgcaaagaaagactacatcaaacggcaaaaagccaaccaagacgagaaatacgcagccatggagaaagctgccttccaatacaacggcaagaaagaactgccagacaatatatttcacgggcataaagagctcgcaaccaaaatcaggctatggcatcaacaaggagagaaatgcctgtacacaggcaagtccataccaatatctgacctcatccataaccaatacaaatatgagatagaccacatccttcccctcagcctgagcttcgacgattcactgagcaataaagtcctagtactggccactgccaaccaggaaaagggacagcgaacccccttccaagctctcgacagcatggacgacgcctggtcctaccgcgagttcaagagctacgtaaaagaatcaaagctactaggaaacaaaaagaaggaatacctcctcaccgaagaagacatctccaaaattgaagtcaagcagaaattcatcgaacgtaacctcgtcgacacccgctattcatctcgcgttgtgctgaacgcactccaagacttctacaaaaaccacaacttcgatacaacaatcagcgtggtccggggccagtttacgagccaactccgacgtaaatggggcctcgaaaagtcccgcgaaacgtaccaccaccacgcggttgacgccctgatcatcgccgcgtcgtcgcaacttcggctctggaagaaacaaaacaatccgctcatcgcatacaaagagggccaattcgtggactcgcaaaccggagaaatcatctccctcaccgacgacgaatacaaagaactcgtcttcaaggccccatacgaccatttcgtagacacactctcctcgaaaaccttcgaagactccatcctattctcctaccaagtcgacagcaagttcaaccgcaaaataagcgacgccaccatctacgccacacgcaaagccaaactggacaaggagaagaaagagtacacatacacgctaggaaaaataaaagacatctacagcctaggaactaaaactccatctaaaacgggattctacaaattcctagacctctacaacaaagacaaatcccaattcctcatgttccagaaggaccgaaagacatgggacgaagttatcgagaaaatcatggaacaatacagaccctttaaggaatacgacaaggcaggaaagctagtcgatttcaaccccttcgaaaagtacaggcaagaaaacggccccatccgaaagtacagtaagaagggtaacggtccggaaataaaaagcctaaagtactacgatatactcctaggcaaacacaaaaacataactccagaagggtcccgaaatactgtcgccctactctcactcaacccatggcgcactgacgtgtactacaacatggaaacaaagaaatacgagttcctaggcctgaaatacgccgaccttccattcgaagaagggggagcctacggcatctctaccgaaacctacaacgaacttcgcgaaaaagaaggaatcggaaagaactcagagttcaagttcaccctatacaaaaacgacctgatcctaatcaaggacacagaaacaaactgccaacaattcttccgcttctggagccgcacaggcaaggacaaccccaaatccttcgaaaaacacaagatcgaactgaagccctacgaaaaggccaaattcgagaaaggcgaagaactcgaagttctcggaaaagtgcccccatcatccaatcaattccagaaaaacatgcaaatcgaaaacctgtcgatctacaaagtgaaaaccgacgtcctagggaacaaacacttcataaagaaagaaggagacaaacctaaactcaaattctga

SEQ ID NO: 6326 - RNA, 3423 nt, synthetic construct
  misc_feature 1..3423: note = Cas9 variant
  source 1..3423: mol_type = other RNA
atgaacggtcttgtcctcggcctcgatattggaatcgcaagtgtaggggtcggcattctcaagaaagacatcggcgaaataatacacacgaactcccgcctcttcagcgccgcaaccgcggactcgaacatagaacgacgcgggcacagaggcggcaaacgcctcacgagaagaaagaaacacagatccatccggctccacgacctattcgaggatttcgggctactcacagacttctccaaagtatcaataaacctgaacccctatcagcttcgcgttcagggcctcgacaaccaactgacaaacgaggaactattcatagccctcaaaaacatcgtaaaaaggcgagggatctcatacctagacgatgccagcgaagacggcggaaccgtcagcagcgactacggaaaagccgttgaagaaaaccgcaaactcctcgccgagcaaacccccggccagattcaactagaccgcttcgaaaagtacggccaggtgcggggtgatttcaacgtcgtagaaaacggggaaaagagacgcctgatcaacgtattcaccacctcggcctactcgaaagaagcagagcgcatcctacgcaagcagcaggagttcaacaagaaaataacagacgagttcatcgaagactatctcaccatcctaaccggaaaacgaaaatactatcacggccccgggaacgagaaaagccgaacagattacggccggtacaccacaaagaaagacccagaaggtaaatacatcacgctagacaatatattcggaatactcatcggcaaatgcacgttctaccccgacgaataccgagcatcgaaagcatcctacacggcccaagagttcaacctcctcaacgacctcaacaatctgactgtccccacagaaaccaagaaactaagcgaagaacaaaagaagacaatcatcaaatacgccaaaaccgcgaagacccttggagcctccaccctcctcaaatacatagcgaaacttataggcgcctccgtcgaccaaatccacggttaccgaatcgatccaaacaagaaacccgagatgcacacgttcgaaacctatcgcaaaatgcaaagcctcgaaaccatctccgtcgaagaactccctcggaaagtactcgacgaacttgctcatatactgaccctcaacaccgaacgcgaaggtatcgaagaagccatcaacgctaccctcaaagacacattctcccaggaccaggtgctcgaactcgtgcaatttcggaaaaacaacagcagcttgttcagcaaaggatggcactcattttcactcaagctcatgatggaacttatccccgagttgtacgaaaccagcgaggaacagatgaccattctcacgcgactaggcaaacagaagtccaaggaaacatccaaacgcacgaagtacatcgacgagaaagaactcactgaagaaatctacaaccccgtagtggcaaaatccgtaaggcaagcaatcaaaataatcaatgaggccaccaagaaatacggcatattcgacaacattgtaatcgagatggcacgcgaaaacaatgaggaggatgccaagaaagagtatatcaaacgacagaaagccaacctcgacgagaaaaacgccgccatggaaaaagcggcattccaatacaatggaaagaaagaactgccagacaacgtatttcacggccacaaagagctcgcgaccaagatccgcctctggcaccaacagggagaaaagtgcctgtacaccggtaagaacatcccaatatccgacctaatccaaaaccaatacaaatacgaaatcgaccacatactaccgctctcacttagcttcgacgacagcctcagcaacaaagtcctcgtactcgcgacggcgaaccaagaaaaagggcaacgaaccccattccaagcactagacagcatggatgacgcatggtcctaccgcgagttcaagtcctacgtcaaagactcgaaactactcggaaacaagaagaaagaatacctactcaccgaagaagacatcagcaaaatagaagtaaaacaaaaattcatcgaacgcaacctcgtagacaccagatacagctcacgggtcgtcctgaacgcactacaagacttctacaaagaacaccaattcgacaccacaatctcagtcgttagaggacaattcacatcccaactgcggagaaaatggggactggaaaaatcacgagaaacatatcaccaccacgcagtcgacgcgctcataatagcggcaagcagccagctgcgcctgtggaagaaacaaaacaaccccctcatctcatacactgaaggacaattcgttgatcaagtcacgggcgaaataataagtttaagcgacgacgaatacaaagagctagtgttcaaagcaccctacgaccacttcgtagacacattaaagtcgaagaaattcgaagactccatactgttctcgtaccaggtcgactctaaatataaccgaaaaattagcgacgccacgatctacgccacacgaaaagccaagctcgacaaggagaacaaggagtacacctataccctcggcaaaatcaaagacatatacgcgcttggaacgaagtccccatcaaaaaccggtttctacaaattcctagacctgtacaacaaagacaaatcccaattcctaatgttccagaaagaccgaaagacatgggacgaagtgatcgagaaaataatagaacaataccgcccatttaaagaatacgacgaaaacgggaaggaagtcgacttcaacccatttgagaaataccgcattgaaaacggaccaatccgaaaatactcgaagaaaggaaacggcccagagatcaaatccctgaaatactacgacaacctgctaggcaagttcgttgacatcacccctagcgagtccaagaacccggtagctctcctatcactgaacccctggcgcacagatgtctactacaacacggagaccagcaagtacgagttcctaggcctaaaatacgcagacctctgctttgaaaagggcggagcctacggaatctccgaagtaaaatacaacaaaatcagggaaaaagaggggatcgggaaagagtccgagttcaagttcaccctctacaaaaacgacctcatacttatcaaagacaccgaaaccaattgccagcaaatattccgattctggagtcgaactggcaaagacaaccccaagtccttcgaaaaacacaagatagaactcaaaccatatgaaaaagccagattcgagaagggagaggaactcgaagtcctagggaaagtaccaccctcatcgaaccaactacagaaaaacatgcaaatagaaaacctgtcgatatacaaagtcaaaaccgacgtcctcggaaacaaacacttcataaagaaagagggcgaggaacccaaactcaaattctga

SEQ ID NO: 6327 - RNA, 3423 nt, synthetic construct
  misc_feature 1..3423: note = Cas9 variant
  source 1..3423: mol_type = other RNA
atggaagaaaatttccagtaccgcataggactcgacataggaatcacaagcgtcggatgggcagtactacaaaacaacagccaggacgagcccgtaaggatcaccgacctgggcgtaagaatattcgacgtcgcggaaaatcccaagaacggcgatgcgctagcagcacccagaagagatgcgcggacgacgagacgcagacttcgcagacggaggcatagattggaacggatcaaattcctgctccaggaaaacgggctaatagaaatggacagcttcatggaacgatactacaaaggcaacctgccggacgtttaccaactccgctacgaaggattagatcggaaattaaaggatgaagaactggctcaagtcttaatccacatagcaaagcacagaggcttcagaagcacaagaaaagcggaaaccaagggcaaagagggaggcgcggtcctaaaagcgacaaccgaaaaccaaaagatcatgcaagaaaaaggataccgcacggtcggagaaatgctatacttagatgaagccttccacacagaatgcctatggaacgagaaaggctacgtactaacaccgcgtaacagaccagacgactacaaacacaccatactacgctcgatgctagtagaggaagtccacgcgatattcgccgctcaaagagccctggggaacgaaaaggccactgaagaactagaaaacgcgtacgttgagatcatgacatcacaacgatcattcgacatgggtccaggactccaaccggacggaaaacccagcccctacgctatggagggctttggagaccgagtaggaaaatgcacgttcgagaaagacgagtaccgcgcaccaaaagcaacctacacagccgaactcttcgtcgccctacaaaagatcaatcatacaaaactcatcgacgagttcgggactggacgcttcttcacggaagaagagaggaaaaccatcatcgacctactcctaagcggcaaagaactaaaatacggcacaatccgaaagaaactgaacatcgaccccagcctcaaattcaacagcttgaactactcggcgaagaaagaaggcgaaacagaggaggagcgggtgagagacaccgaaaaggcaaagttcgccagtatgttctggacctacgagtactcaaaatgcctcaaggacaggaacgaggagatgacagtcggccagaaggcggacctcctcgaccggataggcgaaatactaacagcatataagaacgacgactcaaggagcagtagactcgaggacctaggcctaagtcgcgaagaaatagacggcctcttagaactcagcccggcgaaataccaacgagtctccttaaaggcaatgcgaaaaatgcagccatacctagaggacggcctcatctacgacaaggcctgcgaggcagcgggctacgacttcagagcgctcaacgacgggaacaagaaacacctactgaaaggcgaggaaatcaatgcgatagtaaatgacataaccaacccagtcgtaaaaagaagcgtatcccaaaccatcaaagtcataaacgcgatcatacagaaatacggcagcccacaggcagtcaacatcgagctagcacgagaaatgagcaaaaacttccaagataggaccaacctagaaaaagaaatgaagaaaagacaacaggaaaatgagcgggccaagcaacaaataatagaactcgggaagcaaaaccccacaggacaagacatcctcaaatacagactgtggaacgaccaagggggctactgcctctactcaggcaagaaaataccactcgaagaattgttcggtggcggatacgatatcgaccacatactcccgtattccatcaccttcgacgattcctaccgcaataaagtcctcgtaacggcccaagaaaaccgacaaaagggaaacagaacaccctacgaatacttcggcgcagacgagaaacactgggaggactacgaggccagagtaagactactcgtcagggactacaagaaacaacagaaactgctaaagaaaaacttcaccgaggaagagagaaaagagttcaaagagagaaacctaaacgacacaaaatacatcacaagagtggtgtataacatgatccggcaaaacctagaactcgagccgttcaaccacccagaaaagaagaaacaggtctgggcggtcaacggagcggttaccagttacctacgcaaaaggtggggcctcatgcagaaagaccgcagcaccgaccgacatcatgcgatggatgcagtcgtcatagcgtgctgcaccgacggcatgatccacaaaatcagccgctacatgcaaggcagggaactcgcctacagcaggaacttcaaattcccagacgaagaaaccggcgaaatactgaaccgcgacaactttacccgcgaacaatgggacgagaaatttggagtcaaagtaccgctaccatggaactccttcagggacgaactggacatacgactacttaacgaagaccccaagaactttcttctgacacacgcggacgtccagagggagttagattaccctggctggatgtatggcgaagaagaaagcccaatagaagaaggccgctacataaactacataaggccactgttcgtcagcaggatgccaaaccacaaggtcaccggaagcgcgcacgacgccacaataagatccgcaagagattacgaaactaggggagtcgtaatcaccaaagtaccactaacagacctaaagctgaacaaagacaacgaaatagaaggctactacgacaaagactcagaccggctactctaccaagcactcgtccgccagctactgctccacgggaacgacggcaaaaaggcgttcgcagaagacttccacaaaccgaaagccgacggaacggaaggacccgtggtgcgcaaagtgaaaatagagaagaaacaaacatcaggggtaatggtccgcgggggcaccggtatagcagcaaacggggaaatggtccgaatagacgtattcagagaaaacggaaaatactacttcgtcccggtctacaccgccgacgtggtgcgaaaagtcctcccgaacagggccgcaatgaatggcaaaatcgcaagtgactggaaaaccatggaagacaacaacttcgtcttctccctatacagccgggacctaatccacgtgaaaaggaaaaaggccataccgaccatcctgtctagtggcgcaactttcgaacaggaagagttctacgcctacttcacaggagccgacatcagcacagtcagcatcgccggaataagtaacgacaactccttcaaattccggggcctgggcatccagggcctggaaatatttgaaaaatgccaggtcgacatcctcggcaacataagcgtcgtccggcacgagaaccgtcaaggcttccactga

SEQ ID NO: 6328 - RNA, 3426 nt, synthetic construct
  misc_feature 1..3426: note = Cas9 variant
  source 1..3426: mol_type = other RNA
atgtactccatcggactcgacataggaatagcgtccgtaggctactcggtgatcgagaccaatagcggcagaatcgtcgaactaggggcacgcatattcgaagcacggaacagcgacaacaacaaagaccgacgtgacttccggggaggcagaagactcatacgacgccgcaaaacgcgactagacgacgccaagcgctacttagacgaccaaggattcaaaaacgacaagagcctaatcaatgtatgcccctacagcctccgagtcaaaggcttgacagaggaactctccaagagcgaaatccgcaaagtcatactccacatcctcaaaaagcggggagtgtcctacctaagctcggaagacttagacacctccagcgtcgacaacaaagacagctttaagcaagccgttaccaaaaacctgagacaactggacgacaagacgccgggccaaatccaatacgaacgcctccaggagtcggggcgcgtgagaaccggaataaaccaaaacgggcaataccaactgaacgtcttcgacgtcgcctcctacgcaaaagaactcaaacttatactcgaaacacaacagcaataccatcaagaaatcgacgaccacttcctcgacttcttcacgaaagacggataccgtgaagacgcgggactcatataccgtaaacgaccgtattacgacggcccagggaatgcagcacaaaacagttcgtacggccgctgggccaactaccaagtcgacggcaaaccagccgaaaacattttcgaccaactaataggcaaagacttcacgggaaaaattcgagcaagcaacctcggaccaagtgcccagaaattcaacctactaaatgatctaaacaatctaagaattaccacccgcgaggaagaaaaacttaccttcgaagaaaaacaggaaatcctcgaggtcctcgaaaatgaccgcccaaaaaccttcggccccagaaacatagccaaaatgttaaaagtagatatggacgacatcaaagggtggcgcctcaactccagcgacaaaccggaaatccacacaatgaaggagtacaacgacatgcgcctcgtcttggaagccgggggtttcgacataaaagccatagaccttgaccacatagaagagatagccagcctcatcaccctaaacaccgagagggaagcattcgagctcagcttatcaaacgaaatagacaacaacctgaaacaatttctggtagagaacttcaacgccctccgcaagtgcaaacccaacaactcctggcacagcttcagcaaggaaaaccttcaaagactgatcaccgagctggagcatacatctgatgaacaaaacacaatcctggagcgactgggcctgaaattcgacctaagaagcaagtacagcgaccgagacaccctgccaatccacgaagtcctcgaagaaatatacaaccccaccgtcagtaaaagcgtccgacagacgttccgagtactgaacgccctcgttaagaaatacggcaaagaaaacatcgactacgtaaccattgagatgccccgagacaaaaatgaagacgaccaaaagaagaccatccgggaaatccaaaaagttaacaaaaaccgcaaggacaagtcgaaagagtacttcctcaaaaagtccggttggtccgaagagaagttcgaagaaaagttaagaaccagcaggagattcgcaagcaaactatactacttttacgaacaagacggactgtgcgcatatacaggccagcagattcaaccagaagatctactaactgagcgagtagaggtcgaccacataattccgctatcggtgtcattggacgacagcatcaacaataaggtactcgtgacctcagaggcaaaccaaaagaaaggccaacgttcaccgtacgatgccttcatgtcgggagacttcagcaaataccgcacatacgacgaatacaaagcctgggtgctatccaacaaatacaagaaatacaaaaaggcgctactcctcgaggaacgaaacatcttcgatcccgaactcgccaaaaagttccgtcagcgtaaccttaacgacaccagatacgcaagccgcatcgtgctcaacgccgttcagagctttttctacaaaaccgatacaaaaacacgggtcgtaaacggagcgttcactcacaccctacgcaaaaagtggaacctggccgacaaggaccgcgaaacacaccaccaccacgccatagacgcaaccctagtcgcggtaacaccattcgtgaaagcagagaggtacgaatattacaaagacagcgagggcaaagccagcatggtggacactgtgacgggaacaatcatcccatactccgaatacaaaaagaaaaacctatacgaccgatcaaactacctcctcatgttcggcaatgaatccaccataaaccaagaaaaagaggacaaatcagccgaatttatcagaaacctcataccggccaagatctaccccgagatcaagttctcccaccaagtagaccgtaaatccaaccgaaggctctctgacgcgacgatctacagtacccggtcatacacggtagagaaaggacgaggtaagaacaaacgtgaggtcatcgagcgagacatcatcggcaagattaaggatatatacaccgccgacggatacgcagaatatgtcaagtacaaagacagcctcctggtcaaagaaatcgacgaaaagacgttcgagaaactagaagccataatcgaagagttcagcgatacggtagaagtcaccgaccaacaagggaaagtcaagaaagtctccaaaagccccttcctccaatactgcgaaaaatacgacgtcccaggcgtaacaaaatacagcaagaaaaacaacggccccgtaatccgcagcctgaaataccgctatacgaaactgcggtcccacatcgatatttcccccaaaaacagcaaaaacaccgttgccctactcacacttgcgccgtggcggacggacgtctactactcacaggaaaccgcatcataccatctgcttggcctcaaatacatagacctatcgttccgagacggcggatatggggtatcccgtaaacggtacgaagaaatcaaaaagaatgaacgaatccccgaggacggcgagttcaaattctcgctgtacaaaaaggattacatagaaatagagttcgataagaaaatactcccaggactgtaccaaagtcgagacgtgtcggcacgcaacaaattctcgatgaaacccatcgacaaagcacaatggacaagcaaagaagatgtcctaatgttcgggaatgtcaaagcgtcaggcgtctttgagaaaaccctcaagaaaaactacgtcctgagaaaataccacgtcgacgtcctagggaacaaattcgaagtcaaagacgaaatcctaaaagacatactagaatga

SEQ ID NO: 6329 - RNA, 3429 nt, synthetic construct
  misc_feature 1..3429: note = Cas9 variant
  source 1..3429: mol_type = other RNA
atgtattcagtaggcctcgacatcggaatcgcgagctgtgggtactctataatcaacgacgttaacgggaacatcgtcgaactaggcaccctcctcttcaaaagccgcaactcagacaacaacgaggaacgacgcacaaacaggggcagccgacgcctaataaataggagaagaacgcgactagacgacggaaagaaactcctagcagagaaggggttcaagcaagattccaaattgaagcacgtgtgcccgtatgaactccgcgtgaaaggcttgcacgagaagctcacccagggggaaatctacaaagtcgtcctccacatcctgaagaaacgaggaatctcatacctggatgaaagcgatgagaactcatctggcattgatggcgcaagctacaaagaccaagtaaatctcaatctaaacctacaaaaagagctaacaccaggacaaatccagctaaaacgcctgaaagaaaacggacgaatcaaatccggagtcacctttgagaacggctaccaacttaacgtcttctcagtctccgcctacgccaacgagctcaacaaaatactcacaaaacaaagcgagtactacagcgaaatcgaccagatctggatcgaccggttcacgaaaaatggctaccgcaaagaagctggactcgtctataggaaacgcccatactacgatggccccggaaacgaaaagaataactccatatacggccggtgggcgaacttcaaagaagacggccaccccaaagaaaacatattcgaccaactgatcggccttgacagtgtcgactcgacccaagtccgagcctccgcaagtacactaacagcacaaaaatacaacctgctaaacgacttaaacaacctaacgatcatagaggacgaccgaaaatttaccaccgacgagaaagtatccatcatcaactatcttatgacacaagacataacccggttcggacccaaagaactcgcaaaattttaccaactcgaggtagatcaaatccgcggctggcgcatagacaacaaaggcaaccctgagatccactcactcaaagtctaccgcgactggaagaaaatcttcaacacctcctccatagacctaaccagcatccaaacctgggtcgtcgacgaacttgcgaacgtaatcacactcaacactgaaatccccagtaccctcgccaccctgaagataaagatccccgacattgaccaacaaatactcaacttcgtcgaaaacaacttttacgaactaaagaagaaaaccagcaaaaacagctggcactccttctccctcaaaaccctaaacatcctaataccggaactcctaaacacctcggaagaacagaacacaatcctcgagcgcctcaacttaaaattcgacctcaagaacaaatacgcggagaagaatcagatccccgtcaaggaactactcgaacaaatatacaatcccaccgtgaccaaaagcgtacaccaatcaatcaaactcttcaacgaaatcattgaaaaatacggcaaaaacaatatctcctacgttactatcgaaatgcctagagacaaaaatgaccaagaccagaaagacactatcaaacgcattaataaactcaactccgaacgcaaaaacgacagcgaaaaatacttcctcgaaagatccggatgggacaccatacgcttcgaatcagccctcaagaagccccgttttgcagaaaagctactgttctactacgagcaaaaaggaaagtgtgcctactcaggacaggacatcttagcagagtcgcttctcaacgagagctgcgaagtcgaccatatcataccgctaagcatatccttcgacgactcaatccacaacaaagtactcgtaacggcatccagcaaccaggagaaaggacaacgaaccccttatatggccttcatagacggcgcgaaacttggacaatcatgggacgatttcgtggcctgggtaaactcatgcgggttccaccggaagaaagtccaaaatctactctatgaggagaacatattcaaccccgacgtgcagcgaggattcgtgtctcgcaacttgaacgacacacgctacgccagccgcatcgtactaaacgccatccaatccttcttctacaaacaaaaagacctcaccaaggtcaaggtcgtcaacggatcgttcacccacaccctacgtaagaaatggggctcctcactcgacaaaaaccgagacacctaccaccaccacgccgtagacgctaccctatgcgccgtcacccccttcatcaacatcgtcaagtacgagttcttcgaagaagacggaatcaaatatatggtcgacctaaccaccggagaaaaagtagcgtacagcgactacaaaaagatgaaattctacgacaaacgagcgtacgtccccatctgggacggcttcatcaaacagctcacacccgcgaacctctaccccaagatcaaattctcgcaccaagtggacagtaagtggaaccgaaaaatctcagacgctacaatctactccacccgtaaaatagtcgaaacgaaaataaacaagaaaggcgtggccaaagaaaccgtcaaagacattgtcatagacaaaataaaagacatctatacgccggagggctggcgtaaattcaaagagaaacaggacaaactcctaatgaaaaactttgacgagaagacgtacaacaaactcatcaaaattgcaaaagaatacccggaaaagaaagaagtccaaaccagcaacggcaaagtaagcctagttgaagtaagccccttcaagatgtactgtgaggagcaaaacgtgcccgcaatacgaaagtatagcaagaaaggcaacggtccctacattcgatccttgaaattctacgataaggaactaggcaaacacataaacatcaccaaggactcctacggcaacgacattgagcggaccatccgaaacaagaagatcatcctcaaaaaccaaaactcctggcgcaccgacgtctattacaattcggtcaacaactgctacgagctactcggcatcaagtactgccacctcaaattctaccggggaaaatacggaatcccaaaatccatatacgacgaactcaagaaagaggacgaaatatcatcagagtcagtcttcaaattttccctataccggcatgaccgcgtacgcttcgaaaaagatggggaatatatcgaagcactattcggatccaaaaacgaaagcaacaaaaactacctcgagctgagccccatcgacaaaaacaaatggctgagcaaagaaaatgtcaaattcttcggcgaggtcgccgcctcaggacgcttcataaaaggcctcaaaccaggcatcaaggtaataaagcaatccaccgattacatgggccacgtctacgcaatacaccaggaaaagctcaaattcgtcctctcggacgcttga

SEQ ID NO: 6330 - RNA, 3435 nt, synthetic construct
  misc_feature 1..3435: note = Cas9 variant
  source 1..3435: mol_type = other RNA
atgacaagtaaacaagaaaaacatggagcactcaccttcggcctagacataggcatcgccagcgtgggctgggccgtcctaggcgaatcacggatcgtagacctgggcgttcgctgcttcgacaaggcagaaaccgcgaaagaaggagaaagcctgaacctaacacggcgaatggcgcgcctactgcgacgccgcttacgaaggcgcgcgtggagactcacaaaactagcaagactcctaaaaagggaagggctcatagccgacgccaatctctttaaacacaaaattgaaaagaacacgcccgtacccaagtccagttggcagctcagggtagacggcctcgataggcagctgaacgcagaagagtgggccagagtaatataccacctgtgtaaacaccgggggtttcactggatatcacgcgcagaagaaaaggccgcagagggcgacagtaaaggagagggagggaaagtaaaacaggggctagctgggacgaaaaagttaatgcaggaaaagagctatcgaacagcagcggaaatggtgctggcagagttcccagacgcacaaagaaacaaacaaggcgactacagtaaagccctaagcagaatactactaggagacgaacttaaagcactgttcgaacaccagcgcaaactgggaaacccggtagcaaccgaaaaattagaagccgcaatactcggcaacggggataagaaatgcggtctattctgggcccaaaaccccgctctagcaggcaacaaactcctagaaatgctaggccgctgcaccttcgagaaaaccggcggcgacgacggcaaaggcgaataccgcgcacccaaggcatccttcagtgccgaacgccacgtctggctaacgcacctcaacaacctgagaatagtagtcgacggcaccaccaggccgctaaacgaagcagagcgaagagtcgccctgccgatgccataccaacaggccggcgacctcagctacaaacagcttggcggggcgctcatcaaagaaggcttcctacagaaagacggattcaaattcgcaggcttaccataccccacgaaacaggcctctgaagaaaaggccaaagaccccgaaacatcggtcctgtgcaaactaccagcctggcacacccttaggaagactttagaaaagcacggactagaatccgaatggcaaaaactctcaaccgatgcgctggacgggaaaccccagcttctcgacaacatagcatgggtcttgtccgtgtacaaggacgacgatgaagtgaaaaccgaactgggaaaactcaacctgccgaacacagaaaagatgatagacgccttactcgacatccggttcgataaattcagcaacctaagcctcaaggcactaagtaaaatcgtgccattcatggagcagggccaaagatacgacgaggcagtagccaacatacccgaatacggacaccacagccaactgcacaaagtcggagccggagagcacaaatacctcccacccttctacaaagaacgcgacaagacaggccggatggtgttcaacgacgacatggacatcccacgcaacccggtagttctacgggcactgaaccaagcacggaaggtagtgaatgcgcttattaaagagtacggcagcccacacgaagtccatatcgagatggctcgcgacctctcacgcccgctagacgaaaggcgagacatcgaaaaattacaaaaagagttcggcgagcgcaataaaaaggacaaagaactgttcgcacaagacttcaacatagttggcaccgtcaaagggaaacaattcgaaaaataccaactataccgcgagcaacaaggcaaatgcatctaccccagcatggatgaaaaacaaggaatatgctgttacagtctaaaaccactggacttacaccgggtactctacgaagaagggtacgcagagatagaccacgccctgccatacagccggagcttcgacgacagtaagaacaaccgcgtattggtgctcgccaaggagaaccgggacaagggaaaccgaacccccttcgaatacctgggggacaaggacaactcagagccatggcgccaattcgtagcgttcgtagaaggcaacaaggcataccggctagccaaacggagcagactactacgaaaagactttggcgacaaagaagccaaggagttccgagaacgcaatctcaacgacacgcgctacatctgcaagttctttaaaaactacgtggaacaatacctccaactgcatgaagacagtgaagccaaaagatgcgtcgttctcagtggacagatgaccagcttcctcagggccagatggggactcgtcaaagtaaggggagactcagacagacaccacgcactagacgcagcggtcgtagcagcctgcagccacggcatggtaaagcgcttgtcagattactcgaggcgaaaagaactcgaacaagtaagagaaggctttgtcgacgtcgacaccggcgaaatcgtaaatcccgccatgttccagcaagttcaagaacattttcccaacccgtggccacacttccgcgatgaagtcaaactacggctatcaatagatgacccaacattactgcgctcagaaatggagaaattcgggacatacaccccagaaagtctcgaagccctacgacctctctttgtttcgagagcaccccagcgtagaaactcaggcgccgcccacaaggacacaatatacgcccaaccaaagaggctagtagcccaaggcggcgtcacacagaaagtcgctctaagctcactgaccttaaaagacctcgacaaactgatcgacccacaccgaaacgagcgattatacgccgccatcagagccagattggaacagcacggcggaaaaggcgataaagccttccccgcctccaacccactacgcaagcccgacagcgaaggaaaccccacaggacccatagtgcgcggggtaacaatggtaatcgacaaactaagtggtatccccatcagaggagggatagccaaaaatgactcaatggtacgcgtcgacgttttcacgaaggcaaacaaattccacctcgtaccagtatacgtacaccacagcgtgctgggcctaccgaaccaagccatagtaggcgggaaggaagaaagcgaatggacgcaaatagacgacagcttcgactggcacttcagcatctacccgaatgacctcatacgcgttaccctgaaacaagaaggccgcttcggatactatgcaggatgtgaccgatccacggccgcaatacatttatgggcccacgaccgcaaccaacaggttggtaaggacggattgatccgttccattggagtgaagaccgcactcagtatcgaaaaattcaacgtggatgtgttaggaaacagataccccgcaccaccagagaagcgcagagatctagcctga

SEQ ID NO: 6331 - RNA, 3435 nt, synthetic construct
  misc_feature 1..3435: note = Cas9 variant
  source 1..3435: mol_type = other RNA
atgacgtcaaaacaggaaaacttaggcgcactaaccttcggacttgacatagggatagcctcagtgggctgggcagtgttaggagagaacagaattatcgacctcggtgtccgctgcttcgacaaagccgaaaccgcgaaagagggagagtcacttaacctaactagaagaatggcccgcctcctaaggcggcgcctccgccgacgagcatggcgactcacgaaactagcaaggctccttaaaagagaagggctcatagcagacgcaaacctattcaaacacaaaattgagaaaaatacaccggtgcccaaaagcagctggcagttgcgcgtagacgggctcgacagacaattaaacgcagaagaatgggctcgcgtcatataccacctttgcaaacacaggggatttcactggatcagccgcgcagaagaaaaagcggccgaaggcgacagcaaaggggaaggtggcaaggtcaagcaaggactggcaggaacgaagaaattgatgcaggaaaagtcataccgcaccgccgcagaaatggtacttgccgagttccctgacgcccaaagaaataaacaaggggactactccaaagcactcagccgaatattactcggagacgaactgaaagcactgttcgaacatcaaaggaaactaggaaaccccgtcgcaacagagaaactcgaagcagcaatactcggaaacggggacaagaaatgcggcctattctgggcacaaaaccccgcactcgcgggcaacaaactactagaaatgctcggcagatgcaccttcgagaaaaccggaggagacgacggaaaaggagaataccgtgcgccaaaggcatcattctcggccgaaaggcacgtctggctaacccacctaaacaacctcagaatagtggtagacggaacgacacgaccgctaaacgaagcagaacgccgcgttgcgctccctatgccataccaacaagcaggcgacctaagctataagcagctaggaggagccctcatcaaagaaggcttcctacaaaaagacggcttcaagtttgcggggttgccctaccccacaaagcaagccagcgaagaaaaggcgaaagaccccgaaacatcagtattatgcaaacttccagcgtggcacaccctaagaaagacactcgaaaaacacggcctagaaagcgaatggcaaaaactctcaacagacgcattagacggtaaaccacaactactagacaacatcgcctgggtcctaagtgtatacaaagatgacgacgaagtgaaaacagaactcgggaaactcaaccttcctaacacggaaaagatgatcgacgcattattagacatcagattcgacaaattcagcaacttatcgctaaaggccctctcgaaaattgtacctttcatggaacaaggacaaaggtacgacgaagccgtcgctaacatacccgaatacggccaccacagccaactgcacaaggtcggcgcgggagaacacaaatacctgcccccgttctacaaagaacgcgacaagacaggccggatggtgttcaacgacgacatggacatccccaggaacccggtagtcctacgcgccctaaaccaagcccgcaaagtcgtcaacgcgcttattaaagaatacggctcaccccatgaagtccacatcgaaatggcccgcgacctaagccgccccctcgacgagcgccgagacatcgaaaaactgcagaaagagttcggggaacgaaacaagaaagataaagaactattcgcccaagacttcaacatagtaggaacagtgaagggcaaacagttcgaaaaataccaactctaccgcgaacaacaaggaaagtgcatatacccgagcatggacgaaaaacagggaatatgctgctactccctcaagcccctggatctccaccgcgtcctatacgaagaaggatatgccgaaatagatcacgcactgccatacagtcggagcttcgacgatagcaaaaacaaccgagtcctagtcctggccaaagaaaaccgcgacaaaggaaacagaacgccgttcgaatacctgggagacaaagacaactccgaaccctggcgccaattcgtcgccttcgtagaaggcaacaaagcataccgcctcgcaaaacgaagcagactcctcaggaaagattttggcgacaaagaagcaaaagagttccgagaacgaaacctgaatgacacacgatacatctgtaagttctttaagaactacgtcgaacaatacctccaactacatgaagactccgaggccaagcgctgcgtcgttctttctggacagatgaccagtttcctcagagcaagatggggactggtaaaagtgcgcggagattccgacaggcaccatgcgctcgacgcagcagtagtggcagcgtgttcacacgggatggtaaagcgcctaagcgactacagccgacgaaaagaactagaacaagtacgcgaagggttcgtcgatgtagacacaggagaaattgttaacccggcaatgttccaacaagtgcaagaacacttccctaacccctggccacacttccgagacgaagtgaagctaaggctatctatcgacgacccaaccctattgcgaagcgaaatggaaaaattcgggacctacaccccagaatccctcgaagctctccgccctctctttgtctcacgcgcgccacagagaagaaacagcggcgccgcgcacaaggacacgatctacgctcaacccaagcggctcgtcgcccaaggcggagtaacacagaaggtagcactctcgagcctcaccctcaaagacctcgacaagctaatagacccacacaggaacgaaagactatatgcagcaatccgggcgaggctagaacaacacggagggaaaggggacaaagcattccctgcgtcaaacccattacgcaaacccgacagcgagggaaaccccacaggccccatcgtccgaggagtcacgatggtaatcgacaaactctcaggaatcccaatacgaggcggcatagccaaaaacgactcaatggtccgcgtagacgtgttcaccaaggcaaacaaattccacctagtgcccgtctacgtgcaccactcagtactaggactccccaaccaagcaattgtcgggggaaaagaagaatccgaatggacccagatagacgacagcttcgattggcacttctctatctacccaaacgacctcataagagtcaccctaaaacaagaaggccgattcggttactacgccggctgcgacaggtccacggcggctatccacctatgggcccacgaccgaaaccaacaggtaggaaaggatggactaatccgcagcattggggtgaagacggcactatcaatcgaaaaattcaacgtcgacgttctaggcaacaggtacccagcgccgccagagaaaagacgcgacctggcatga

SEQ ID NO: 6332 - RNA, 3438 nt, synthetic construct
  misc_feature 1..3438: note = Cas9 variant
  source 1..3438: mol_type = other RNA
atgaaaaccatcctgggactagacttaggaacaaacagcatcggctgggccctcgtaaaggaaacagaaaactcaaacgagaagagtgagatcataaaactcggggtgcgcgttaaccccctcaccgtcgacgagaaaacaaacttcgaagccggacgaccattaagcacgaacgccgaccgcacagcgaaaagaagcgcacgtcgcaacttacaacggtacaagctacgccgcaaaaacctcatagacctactaatcaaacacagactaatcgacaaagacacacccctgaccgaaatcggcaaaaataccacccaccaaaccctagaactccgagcaaaggcagctcgggaacgcattgaactagaggatctcgcccgagtcttcctagcaataaacaagaagcggggttaccgctcatcacgtaaagtaaacaacgaagaggagggccaagtcgtcgacggaatggcagtagccaaaaagctctatgacgagaacctaaccccgggacaatacgcatacgaactcctcagcaaaggaaagaagtacgttcctgacttctacaggtcagacctacaggcggagttcgacagcatctgggaataccagaaacaattctacgccgacattctcgatgacgaactatataacgccctaaaaggacaagggcagcagaactcacgcaaacgcttcctagcaataaaaggcgtctacacagcagaaaacaaaggaaaacgcgacgaggtaaaattacaacactacaaatggaggtcggaggcgataacacaaaagctcagcatcgaagaggtagcctacgtgctagtcgagatcaacaacgacctaaacaaaagcagcggctacctaggcgcaataagcgacagatcaaaggaactctacttcaacaaagaaacggtcggcgagaacctatggaagcaaatacaaaagaatccccacacttccctcaaaaaccaggtattctaccgccaggactacctcgacgagttcgaacagatctgggaaacacaggcccaattccacccccaactaaccctcgccctcaaagaacaaatccgagacgttgtaatattctaccagcgaaaactcaagagccagaagggcctactcagcttctgccagttcgaatcctgggaaatcgaacggaaggatgaaaacggtaacgtaatactaaataaaacgacgcaactaccgaagaggcaaacagtcggaagacgggttgccccaaaaagctcaccactcttccaagagttcaaaatctggcaaaacataaacaacctagaaatagccaagatcagcgacggaaactccaagaacaaaaaggaaaccgaggcactatcagacgacgagagaaaattactattcgaagaactcaatctccgcgggaacctgtcccaaaaggaagtgctgcagatactcggactcaaagacaaggagtacaagactaacttccccgagggcctggaaggaaaccgcacaaacgctgccctcttcaacatataccagcaaatagcagagaacgagggatacggggactggactaagaaaagcgcgcaagaaatcaaagaggagctaaaagccgtattcccacaaatcggaatccaagcggacatcctcgactttaacgcggaactcgacgggaaagagttcgagaatcaagccagctaccagctatggcacctactatactccgccgaagaggacgacaaaataaacgaggaggaccaaatcatatatggcaatagcgccgtttcactcaaaaagaaactatgcgaaaaattcggcttcacaccggaatacgccaaatggatcgccaacgtatctctccaagacgactacggcaacctgtccacaaaagccatgcgaaaaataataccatacctcatcgacggcaacgactactctgaggcctgcgccttagcaggatacaaccactcgaacagcctcaccaaagaagagaacgacaaccgagaacggctcaacaaactcgaactcctacccaaaaacagcctgagaaacccagtggtggagaaaatactaaaccagatggtcaacgtagtaaatcaagtaatagaaacatacggcaagcccgacgaggtcagaatagagctggccagagaactcaaaaagtcagcggaagaacgggcggaaatgacaaaggggattaacgaggcaacgcgccgaaacgaggacatcaagaaactaataaccaaaaacttcggaataccaaacccaacaaagaatgacgtcgtacgctatcgcctctgggaggaactagctcccctggcgtacaaagacgtgttcacaggtcgccaaatcaagaaagaagacctgttctcatcgaaaatcgacatagaacacatcatccccaaagctctcctattcgacgacagtttttcgaacaaaacgctcgccttccgtgagactaacctcaagaaagccgatagaacggcatacggcttcatagaatccgattacaacgccaccctagacgactacatacagagagtcgagacactgtacaacaacgcaaaaggaaccatctcgaaaggcaaaagaaacaagctactaatggcccagaaaaacctcccagacggcttcatcgagcgagacctacgaaacagccaatacatagcaaagaaagcaaaaagcatgattgagaaggtctttaacgacgtgaacgtcacgtcgggatcaataaccgatcgactgagggaggactgggatttaataaacgtcatgaaagagctaaacttccccaagtacaaagcgctcggcctgaccgaaatagaggaaagatacgacattggacaagagaaaaccaagaaagtagaagtgatcacagactggacaaaacgaaacgaccaccgccaccacgccatggacgcactcacagtagccttcacaacaaaaagccacgtgcaatacctcaacaacctaaacacaatccacagtctaaaaggagacgaagtcgacctcgagctctcgaaactctacgggctcaaaaacaccataacggaagtagtcaacaagaaaaggaaatttattccacccatgcccaatttcagagaggaagccaagaaacacatcgaaactatccttgtcagcatcaaaaataaaaacaaagtctacaccaaaaacataaacaaaaccaaaaaggagtccggataccacacaaaggaacaactcacaccccgaggacaactgcacaaagaaaccgtatatggcaagagcaaaagacccatgaacaagcccaccaaaataaacaaaaacttctccctagaacaagcacagctgatcataaacgtacaggaaaaagagctcgtcctgcgccaccttgcgcagttcgacaacaaccctgcggtagcatttgacacaaagactctaaagaaatgccactacctcaaaatggtcaacctctga

SEQ ID NO: 6333 - RNA, 3441 nt, synthetic construct
  misc_feature 1..3441: note = Cas9 variant
  source 1..3441: mol_type = other RNA
atgtcaggaaacacacacggtcccctcacattcggcttcgacatcgggatcgcctcagtcggctggtgcgtcctcggcgaaaaccgaatagtcaacctcggagtcagatgcttcgacaaagcagaaaccgcaaaagaaggcgaatctctaaacctagcccgccggaccgccagactcatgagaagacgcctccggcgacgcgcctggagactcacaaagctagcccgcctccttaaaagagaaggactcatcgccgaggcatcacgaatacacatccccagccccgtaagcccgtggcgtctcagagtcgaaggtatagaccgccgcctaacagacgacgaatgggcgcgagttatataccacctatgcaaacatcgaggctttcactggatatcacgagcagaggaacgcaaagcagaatccgatgccaaagaaggcggtcgggtgaagaaaggcctgagtgacacccaacgccgaatgacggaaaaaggatacagatccgcagccgagatggtacttgccgagttcccggacgcccagcgaaacaaacaaggtgactacggaaaagcactctcgcgcatcctcctcagcgacgaactcgccttacttttcagacgacaaagagaactcggaaaccccaacgcaggcaacgaacttgaagctacgatcctgggaaacggcaaccgtaaatccggattattctgggaacaaaagcccccgctagccggagcggacctcctaaaaatgctgggcagatgtacatttgagaaaaacgaataccgcgcacccaaagcatccttcactgccgaacgccacgtatggctcaccagactgaacaacctaagagtagtggtagacggtacaacccgctccctcgacgacgccgaacaccgactcgtactacccctaccatacaagcaggcaggagatttcacctacaagcaactaagaacagccctgacaaaggcaggactcctgcccgaaggcttcaagtttgcaggcctaagctaccctaccggccgccaactcgacgacccgaaggcaaaagaccccgaatcagaaaaactcgtccgtctgccagcctggcaagaactcagaaaaacgctcaaagacaaaaacttagagacagaatgggagggcatggccggcgcggccaccggcggaaaccccgaactcctcgacgaaattgcacgggtcctatccgtgttcaaagacggagacgaagtaaccgccgagctatggaaactgcccctaccaggaggaaaggcgatgatagatgccctgtcggaaatctccttcgataaattccacgccctaagcctcaaagccctgcgcaaaatagtaccgcacatggagagcggactcaggtacgacgaagcctgcgcggtcgccggctatcaccattcccaactccacgctgcgggagctggtgaacacaaattccttcccccgttctactcccggcgagataaagacggccgcatggtgttcaacgaagaactagacgtccccagaaaccctgtcgtccttcgagccctcaaccaagcgcgaaaggtactcaacgccctcgtacgcacatatggatcacctacggccgtccatatagaaatggcgagagacctgagcagacccctagacgaacgaaacaaagttaagaaagcccaggacgagtatcgagaaagaaacgaaaaagacaaagcagccttcgccgccgagtacggcatcgcacccaagtcacgagaatttgaaaaatttcaactctaccgcgaacaacaaggaaagtgcgcttacagtctaaaaagcctcgaccttcatcgcgtcctacacgacatcgggtacgccgaagtcgaccacgcgctgccctatagtcgcagctatgacgatagcaaaaacaataaagtactcgccctaaccgaagaaaaccgtaacaaaggaaaccgaacagcatacgaatacttgaccagcttcccgggcggcgagaacggagaaaggtggcgcaatttctccgtcgcagtcgaaacaaacaaagcataccgactcgccaaacgcacacgactcctacggaaagacttctctggccgcgcagctgaagaatttcgcgaacgcaacctgaacgacactcgctacatctgccgcttcttcaagaacaccgtcgagcgatttctaaaattagacgccaaagtcggcgccggagacacggccgaaataagcgcaaaacgatgcgtggtactctccggacaaaccaccgcattcttgcgcgcgagatggggcctactcaaagtccgtggtaatagcgatcgacaccacgccctcgacgccgctgtggtagccgcctgcagccatggaatggtcaaaagactcggagattactccagaaccaaagaactggccaaggtccatgacggattccccgacccggaaacaggcgaaatcatagatcccgtaatgttccaacaactacacgcacacttccctgacccttggccccactttagagcggaactcgaggcccgactaaacgtagatgacaccgcggacctacgcgcgcggatggaactattcggaacatatgccccagaggcgctcgaaacactcagaccattattcgtgtcaagggcaccgcaaaggagaaacagcggagccgcacacaaagacacaatctacgcacaaccggaacgtctcaaagaacaaggcggtgtcacacaaaaggtcccgctgacatcattaaccctcaaagacctcgacaaactaatagacccccatcgaaacgaaaaactatacgcggccatccgagccagactggaagcccacggaggtaaagcagataaagcgttcccggcaggcaacccccttagaaaacccgaccgcgaaggaaaccccacaggcccagtcgtcagaacagtaacaatggtcattgacaaactatcgggcattcccgtgcgcggtggtatcgcgaaaaatgacacaatgctccgagttgacatatttcgccataagaaagatggtaaattccacctagtacccgtttacgtctaccacgccgtggcaaaagaatttccaaaccgggccatcgtccaagcaaaagacgaagacgaatggacactcattgacgacaaattcgacttctgcttctccgcacacccaaacgacctactcaaaataacacagaaatccggtgaaacaatcttcggctactaccgtggctgccacagcggaactgcagcaataaacatcgcgctccacgacagatacgcatatgcagagaaaacaacctcactagccttctcgaagaagaaccccggcaaaccaatccctaacgacaaactcgggctcatagaaggcataggcgtaaaaatggcagccaacatggaaaagttccacgtcgacaccctcggaaacatatacccggcacccccagaacaacgacgtggactcgcgtga

SEQ ID NO: 6334 - RNA, 3441 nt, synthetic construct
  misc_feature 1..3441: note = Cas9 variant
  source 1..3441: mol_type = other RNA
atggcataccgcctaggattagacattggcatcacctccgtcgggtgggccgtcgtcgccctagaaaaagacgagtccggactaaagccagtacgcatacaagacctcggcgtacggatattcgacaaagccgaagatagcaaaacaggcgcgtcgttagccctaccccgaagggaggcacgaagcgcccgaagacgcacacgccggcgcagacaccggctctggcgcgtaaaaagactattagaacaacacggaatcctcagcatggaacaaatagaagcactttacgcacaacgaacgtccagccccgacgtctacgccctccgagtagccggactagaccgatgcctcatagcggaagagatcgcacgcgtgttaatacacatcgcccaccgacggggtttccagagtaaccgaaaaagcgagataaaagacagcgatgcggggaaactattaaaagccgtgcaggagaacgagaacctcatgcagagtaaaggctaccgaacggtcgccgaaatgctcgttagcgaagcgaccaagaccgacgcagagggaaagctagtacacgggaagaaacacggatacgtctctaacgtacggaacaaagcaggggagtaccggcacacagtctcgagacaagccatcgtagacgaagtgaggaagatattcgccgcacaacgagcacttggaaatgatgtaatgtccgaagaactcgaggactcatatctaaaaattctctgcagccagagaaatttcgacgacggccccgggggagactccccatacggccacgggagcgtaagcccggacggggtaagacaaagcatctatgaaaggatggtgggtagctgcaccttcgaaaccggagagaaaagggcacctcgaagcagctactcgttcgaacgcttccaactcctcaccaaggtcgtcaacctcagaatatatagacaacaagaagacggaggaaggtacccctgcgaactcacccagacagaacgagcccgagtcatagactgcgcatacgaacaaacaaagataacctacgggaaactgcggaaactcctagacatgaaagacacagaaagtttcgcgggcctcacctacgggctaaaccgatcccgcaacaagacggaagacacagtgttcgtcgaaatgaaattttatcacgaagtgcgcaaagcactgcaaagagccggagtgttcatccaagacctaagcatagaaacactcgaccaaatcggatggatactcagcgtatggaaaagcgatgacaaccggcggaaaaagctatcaaccctaggcctatccgacaacgtcattgaagaactgctgccgctcaatgggagcaaattcggacacctgtccctcaaagccatacgaaagatactaccgttcctggaagacggctacagctacgatgttgcctgcgaactagcagggtaccagttccaaggtaagacggagtatgtaaagcaaagactgctcccaccccttggcgagggagaagtaacgaatcccgtcgtgcgacgggccctcagccaagcaattaaggtagtaaacgctgtcatcaggaagcacgggagcccagaatccatacatatagagctggcgcgggagttaagcaaaaacctcgacgaaagacgaaaaatagaaaaggcgcaaaaagaaaaccaaaagaacaacgagcaaataaaggacgagataagagagatactcgggagcgcccacgtgaccgggcgcgacatagtgaaatacaaacttttcaagcaacagcaagagttctgcatgtatagcggagaaaaactagacgtgaccagactattcgaacccggctacgccgaagtcgaccacataataccctacggaatcagctttgacgacagctacgataacaaagtactcgtaaaaaccgaacaaaaccgacagaaaggaaaccgcacaccactcgagtatctcagagacaagccagagcaaaaggccaaattcatagccctagtagagtccataccgctatcacaaaagaaaaagaatcacctcctcatggacaaacgagccatagacctcgaacaagaagggttcagagaacggaacctcagtgacacgcggtatatcacgcgagcgctaatgaaccacatccaagcgtggctcctattcgacgaaacagcgtcaacaaggtcaaaaagagtcgtgtgcgtcaacggcgccgtaacggcatacatgagagcacggtggggactaaccaaggaccgtgacgcaggagacaaacaccacgcagccgacgccgtcgtagttgcgtgcatcggcgactcacttatccaacgcgtgacaaagtatgataaattcaaaaggaacgctctagctgaccgcaaccgatacgtccagcaagtcagcaaaagcgaagggataacccaatacgtcgacaaagaaacgggggaagtattcacatgggaatcattcgatgaaaggaaattcctacccaacgaacccttagaaccatggccattcttccgggacgaactcctcgcaaggctatcggacgacccatccaaaaatatcagagccatcggattactgacatactcagagaccgaacaaatagacccaatattcgtctccaggatgccaacgcgaaaggtcaccggggccgcccacaaagagacaataaggagcccccgcatagtcaaagtagacgacaacaaaggaacggagatacaagtcgtagtatcaaaagtcgccctcacagaactcaaactcaccaaggacggcgaaatcaaggactatttcagaccagaagacgacccccgcctctacaacaccctccgagagcggctagtccaattcggaggcgacgcgaaagcagccttcaaagagcccgtgtacaagatcagcaaagacggctccgtcagaacgccagtgcgaaaagtgaagatccaagagaaactcacgctcggcgtgcccgtccacggcggcagaggaatcgcggaaaacggcggcatggtgcgcatagacgtattcgctaaaggagggaaatattacttcgtcccgatatatgtagcggatgtcttgaagcgcgaactccctaatagactcgcgacagctcacaaaccctacagtgaatggcgggtggttgacgactcgtaccaattcaagttcagcttgtacccgaacgacgcagtcatgattaaaccatcacgggaagtagacataacatacaaagaccgcaaagaacccgtgggatgtcggataatgtacttcgtcagtgccaacatagcaagcgcaagcataagcctcagaacccacgacaatagcggagagctagaaggcctgggcatccaaggcctagaggtcttcgaaaaatacgtcgtgggccccctaggagacacacaccccgtttacaaggagagaagaatgccattcagggtagaaagaaaaatgaattga

SEQ ID NO: 6335 - RNA, 3441 nt, synthetic construct
  misc_feature 1..3441: note = Cas9 variant
  source 1..3441: mol_type = other RNA
atggcatatcgactgggcctggacatcggcatcaccagcgtaggatgggccgtagtagcccttgagaaagacgaatctggactaaaacccgtcagaatacaagacctgggagtacgaatattcgataaagccgaagactcgaaaactggcgccagcctggcgctgcccagacgcgaagccaggtcagcgagaaggcgaacacgacggcgacgccataggctatggagagtaaagagactactagaacaacacggcatactctccatggaacagatcgaggcactatacgcccaaaggacgagcagtccagacgtctacgcactaagagtggccgggctagacaggtgcctaatcgccgaagaaatagctcgagtactaatccacatagcacaccgccgtggcttccaatccaaccgaaagagcgaaataaaagactcagacgcaggaaaactgctcaaagccgtgcaagaaaacgaaaacttgatgcaaagcaaaggctataggacagtcgcagagatgctagtcagtgaagccaccaaaaccgacgccgaaggaaagctagtacacggcaagaaacacggttacgtaagcaacgtaagaaacaaggctggagaataccgacacacggtgtcaagacaggcaatcgtagacgaagtacgcaaaatttttgcggcgcagcgagccctcggaaatgacgtcatgtcagaagaacttgaagactcctatctgaaaatactatgttcgcaaagaaacttcgacgacggaccaggcggcgactccccatatggccacggcagcgtctcaccagacggagtacgccaatcgatatacgaacgcatggtaggcagctgcaccttcgaaacaggagagaagagagcaccaagaagcagctactcattcgagagattccaactattaacaaaagtcgtgaacctccgaatataccgacaacaagaagacggaggcagatatccgtgcgagctcacgcaaacagaaagggcaagggtaatagactgtgcatacgaacaaaccaaaatcacatacggcaagctacggaagctcctggacatgaaggacaccgaatcattcgctggactcacgtacggactaaaccgaagccgcaacaaaacagaggacacagtattcgtagaaatgaagttctaccacgaggtccggaaagcgctacaaagagcaggggtattcatacaagacctgagcatagaaaccctcgaccaaataggatggatcttgagcgtatggaaatccgatgacaatcgccggaagaaactctcaacactaggactatccgacaacgtcatcgaggagctactaccactcaacgggagcaaattcggccacctgagcctaaaagctatccgcaaaatacttcccttcctagaggatggatacagctatgacgtagcatgcgagctagcgggatatcagttccaaggaaagacggaatacgtaaaacaaaggctcctgccaccactaggagaaggagaagtaacaaacccagtcgtgcgccgagcgctctcgcaggcgatcaaagtagtaaacgcggtaatacgaaagcacggatcgcccgagtccatccacatagagctcgcacgcgaactcagtaaaaacctcgatgagagacgaaaaatcgaaaaagcacaaaaagaaaaccagaaaaacaatgaacaaataaaagacgagatccgcgaaatactgggatcagctcatgtcacaggacgagacatagtaaagtacaaactcttcaaacaacaacaagagttctgcatgtactcgggcgaaaagctagacgtcacacgtttattcgaaccaggatacgcagaagtagaccacatcataccatacgggatatccttcgacgactcgtacgacaacaaagtgcttgtcaagacagaacaaaacaggcaaaaaggaaaccggacaccactagaatacctccgcgacaaaccggaacagaaggccaaattcattgcactcgtagagagcataccactcagccaaaagaagaagaaccatctactgatggacaagagggcaatagacctagagcaagagggcttccgcgaacgaaacctatcagacacccgatatatcacccgcgcgctaatgaaccacatccaggcatggctactcttcgatgaaacggcaagcaccagatccaaaagggtagtctgcgtcaacggagcagtaacggcctatatgcgagcccgatgggggctaactaaagaccgtaacgcaggagacaagcaccatgccgcggacgcagtagttgttgcatgcataggagacagcctgatacagcgagtaacaaagtacgacaaattcaaacgaaatgccctggcagacaggaatcgttacgtacaacaggtttcaaagagcgaggggataacgcaatacgtagacaaagaaacgggcgaagtgttcacatgggagagtttcgacgagcgcaaatttctacccaacgagccgctcgagccatggccattcttcagagacgaactgctcgcgcggctgtcagacgacccgtctaaaaacatacgagcgataggcctactcacatacagcgaaacggaacagatcgaccccatattcgttagcaggatgccgacacggaaagtaacaggcgccgcgcacaaagaaacaatccggagtccccgaatagtcaaggttgacgacaacaaaggaacagagattcaagtggtcgtaagtaaagtggccctaacagagctcaaactcaccaaagacggcgaaataaaagactacttccgacccgaagacgaccctagactctacaacacgctaagggaacgcctagtccaattcgggggagacgctaaagcagcattcaaggaaccagtgtacaaaatatcaaaagatggatccgtccgcacaccagtaagaaaagtaaaaattcaagagaagctcacgctgggcgtacccgtacacggaggaagggggatcgccgagaacgggggcatggttcgcatcgacgttttcgcaaaggatggcaaatactacttcgtgcccatctacgtcgcggacgtactcaaaagagagctcccaaaccggctcgcgacggcacacaaaccttactcggaatggcgggtcgtggacgacagctatcaatttaaattcagcctataccccaacgacgccgtaatgatcaagccaagcagagaggtagacataacctataaagaccgaaaagaaccagtaggactacgtctaatgtacttcgcaggcgcagatatctccggggccacgctcacgctacgaacccacgacaacagcggagaactcaagggcctaggcatacagggactagaagtgttcgagaagtacgtcgtaggacccctcggcgacacacacccagtgtacaaggaaagacgtatgccgttcagagtcgaaagaaaaatgaactga

SEQ ID NO: 6336 - RNA, 3447 nt, synthetic construct
  misc_feature 1..3447: note = Cas9 variant
  source 1..3447: mol_type = other RNA
atgacgaaactaaaccaaccctacggcataggcctcgacatcggctcaaactccataggattcgcagttgtcgacgccaacagtcacctcctccgcctaaaaggtgaaacggccatcggagcccggctgttccgcgagggacaaagcgccgctgaccgccgcggatcgagaacaacacgacgccggctcagccgtacacgctggaggttgtccttcctccgagacttcttcgcaccccacatcactaaaatcgacccagacttcttcctgcgacaaaaatatagcgagatctcacccaaagacaaagaccgattcaagtacgagaagcgactcttcaacgaccggacggacgccgagttctatgaggcttatccctcgatgtatcacttacgactcaggctcatgaccgatgcaagccaggccgaccccagagaaatattccttgccatccaccacatcctcaaatcacgtgggcacttcctcacccccggggcagcaaaagacttcaataccgacaaggtagatctcgaagatatcttccccgccctcaccgaagcgtatgcgcaagtatatccagacctcgaactcactttcgatctagccaaggccgacgattttaaggcgaaactactcgacgaacaagccaccccctcagatacacagaaggcactggtcaacctactcctatcctcagacggagagaaagaaattgttaagaaacgaaaacaggtcctcactgaatttgccaaagccataaccggcctcaaaaccaaattcaacctcgccttaggaaccgaagtcgatgaagcagacgcttccaactggcaattctcaatgggccagcttgacgacaaatggtcgaacatcgagaccagcatgaccgaccaaggcaccgaaatcttcgaacaaatccaagaactctaccgtgctcgactcctcaacggaatcgtaccagcaggcatgtcgctcagtcaagccaaagtcgcggactacggacagcacaatgaagaccttgaactcttcaagacatacctcaagaaactcaacgaccatgaattagcaaaaaccatccgcgtcatatatgaccgatacataaacggagacgacgcaaaaccctttctaagagaagactttgtcaaggcactcactaaggaagtgacagcccaccccaacgaggtgtcagaacaactcctaaatcgcatgggccaagctaacttcatgctcaaacagcgcactaaagccaacggtgcaatccccgtccaactccaacaacgcgagctcgaccaaataatagccaatcaaagcaagtactacgactggctcgccaaaccaaaccctgtcgaaaaacaccgtgcttcgaaaccctaccaacttgacgaactccttacgttccgcatcccctactacgtcggccccctcatcacccccaaagaacaagcaaaatccggcgaaaacgtgttcgcttggatggtccgaaaagacccctccggaaacatcactccctacaacttcgacgaaaaagtagaccgagaagcctccgcaaacgttttcatacaacgaatgaagacaacggacacctacctaatcggggaggatgtcctacctaagcagtcactcttatatcagaaatacgaagtcctaaatgagctcaacaatgtccgcgtaaacaacgaagccctcggcacggaccaaaaacaacgtctcatccgcgaagtattcgaacgacacagctccgtgaccatcaaacaggtcgcagacaacctggtagcgcacggcgacttcgcccaacgcccagaaatccgcggactagcggacgagaaaaggttcctcagctctttgagcacataccaccaactcaaagaaatcttacacggcgccatcgacgactcgaccaaactacacgacatcgaaaacatcattacgtggagcaccgtcttcgaagacgccgcaatcttcaagaccaaactcgcggagatcgactggctagatgcagccacgatcaagaagctctctaacatccgctaccgtggctggggtcaattctctcgcaagttgctagacggactcaaactcggcaacggccagacagtaatccaggaactcatgctatcaaaccacaacttaatgcaaatcctaacagatgaaaccctcaaaaccacaatggccgaactcaatcaagacaaactcaaggcggacgacatcgaagacgtaatcaacgacgcctacacctccccctccaacaagaaagccctccggcaggtccttcgagtcgtggaagacatcaaacacgcggcaaacggccaagacccgagctggctctatatagaaacagctgacggcccaggcaccgcgggcaaacggactcaatcacggcaaaaacaaatacagaccgtctacgcgaacgcagcccaagaactcatagactcagcagtccgcggcgagctcgaggacaaaatagccgacaaagccagcttcacagaccggttagtactctacttcatgcagggaggccgcgacatatacactggagcgcccctcaacatcgaccaactatcgcactacgacatagaccacatccttccgcaatcactgatcaaggacgatagtctagacaaccgcgtcctggtcaatgccaccatcaatcgcgaaaagaacaacgtcttcacctcgaccctcttcgcaagcaaaatggcagcaacctggagaaaatggcacgaagccggtctcatctccggtcgcaaactcagaaacctcatgctgcgaccagatgaaatagacaagtttgcccacggcttcgtcgcacgacagctcgtagaaacacgtcaaatcataaaacttactgaacaaatcgccgccgcccaatacccgaacaccaaaatcatagctgtaaaagccggtctttcccaccaactacgggaagaacttgactttccgaagaaccgtgacgttaatcactaccaccatgcgttcgacgcattcctagccgctcgaataggcacctacctccttaaaagatacgctaaactcgctcctttctttacctacggcgaatttgcaaaagtggacgtgaagaaattccgagagttcaacttcatcggcgccctgaaacacgcaaagaaaaatatcgttgccaaagacaccggcgagatcgtctgggacaaagaacgtgacatacaagagctagaccgtatctacaacttcaaacgcatgcttatcacacacgaagtttacttcgaaaccgccgatctgttcaaacaaaccatctacgccgcaaaagactcgaaagaacgaggagggagcaagcaactaatacccaagaaacgggggtaccccacacaggtctacggcggcattcacggcaagatccgactcacctggcgctggctcaagctacttagaagaaagaagatgtccatcgaactatcagagcttcaactcttaaagtga

SEQ ID NO: 6337 - RNA, 3450 nt, synthetic construct
  misc_feature 1..3450: note = Cas9 variant
  source 1..3450: mol_type = other RNA
atggaaagataccacataggactagacataggaacaagcagcatcggatgggctgtgataggggacgacttcaaaatcaaacgaaagaaagggaaaaacctaatcggcgtgcgtctcttcaaagaaggcgacacagcagccgaaagaaggggttttcgcacccaacggcgtagactcaaccgaagaaaatggcgtctcaaactactagaagaaatcttcgacccctacatggccgaggtggacaaatacttctttgcgcggctaaaagaaagtaacctctccccaaaggacagtaacaagaaatacctgggttccctactcttcccagacataagcgactcaaatttctatgacaaatacccaacgatataccacctacgccgggatctcatggaaaaagacaagaaattcgacctacgtgaaatatatctagccatccaccatatcgtcaaataccgcggcaactttttggaaaaagtgcccgccaaaaactacaaaaactcaggcgcaagcataggcttcctccttgaagaagttaacgacctatatggcaacatcatcggaaacgaggacgtagcaatcctcgacaacgacaagtttgaagacgtcgagaagatcatactgaatgacgagatacgcaacatcgacaaacaaaagaacgtcgggcggctcctagttaaagacaagaaagagaaaaacatagtcacagcattcagtaaagccatatttgggtacaagttcaacctagaagacctgcttctaatcgaaagtgacgagaaaaacaaacttactttcaacgatgaaaacatcgacgacatattcaacgaactctcccacagcctaaacgacaaccagatggacctcctcacgaaaacccgagagatctacttcaaatttaagctcaacatgatagtacccacaggatacacaatatcagaatccatgatagagaagtacgagatgcacaaagcacacctcaagatgtacaaggagttcataaacaccctgaacgctaaggaccgcaaaatcctcaagaatgcctacagcgactacatcaacaacgaaaaagcaaaagccgctaacgcacaagagaacttttacaagaccgtcaagaaaacaatcaaagaaaacgactcagacaccgccaagaaaatcatcggcctcatagacgaaggcaactttatgccaaaacagcgaaccggcgaaaacggcgttattccccaccagttacatcagatcgagcttgaccgcataatagagaaccaggccaaatactacccgtggctggcagaggaaaacccagtggaaaagaaccgaaaatttgcgaaatacaaactcgacgagctagtcaccttccgggttccctactacgtcggacccctcatcgataaaaccgaatccaacaaaaacgaaaaagaaaccaaattcgcctggatggtccgcaaagcaaaagggacgatcacaccctggaacttcgaaaacctggtcgaccgcacagaatcagcgaaccggttcataaagagaatgacttctaaagacacctacatcataggagaagacgtgctcccagccagcagccttctttacgagaaatacaaggtactaaacgagctgaacaacattaaggtaaacaaaaagaaattggacgtcgagcaaaaacaacacgtctacctcgacctcttcacaacccgcaaaaacgtcaccaaggacgacctcgccacaagtcttaactgcgacgtcgagtcgatcaccggactgacagacaataagaaattcaacagcagcctctcctcctatatagacctgaaagcaatactgggcaacatcgtagacgactacagtaaaaacgaggacctcgagaaaataattgaatattccaccatcttcgaagacgggaacatctacaaagagaaactttcggaaatcagctggcttacggacgaacaaatagaaaaactgagcaacatacacttcaaagggtggggccgactgtctaagaaactgctaacccaaatcacaaatgaaaacggagaacgaatcatcgacactctctggaacacgtccaacaacttcatacaagtcatcagcgacgaatccatccaagcaaaactcgccgaaatcaacggcgaatacgccaacaaatacaacctagaagacatactagacgaagcgtacacaagcccccagaacaagaaagccattagacaggtaatgaaggtcgtagaggacatcgagaaagcaatgaagtgtgaaccgaccagcatagccatcgagttcacgcgcgagaaaagaaaatcgaaactgactaacactagatataagaaaatctccgaaacctacgagaaaatcacagacgaactcatcagtgaatacgagctaggcaaattacagagcgaacttgactcgaaggtaaacaacatgcgcgaccgctattatctatacttcatgcaactaggccgcgacatgtataccggggagaaaatgaacatcgacgaacttcaccaaaaatacgatatcgaccatatcttgccccagtcattcatcaaagacgactcactcaacaacagagtcctcacctccaaaagcgtcaatatcaaggaaaagtccgacaaaacagctgccgacctgtacgcggcaaagatgggtgacttctggcgcaagttacggaaacaaggcctaatgacagaacaaaagtacaagaacctattaacgcgcacggacagcataaataaatacaccaaacagtccttcatcaagagacaactcgtcgagacgtcgcaggtcgtcaagttggctgccaacattctccaagacaaatatcgcaacacgaaaattatcgagatcagagcccgcctgaacagcgacctccgcaaaaagtacgagctaatcaagaacagggaggtcaacgactaccaccacgcgattgacggatacctaaccacattcgtcggccaatacctatacaaggtctatccaaagctgcgaagctacttcgtatacgacgacttcaagaaattggactcgaactacctcaaacacatggacaaattcaacttcatctggaaacttgaggataagaaagccgaagacgtgtacgacaaagtcaacgacgagttcgtgctgaacgtccccgaaatgaaagaatacatccgcaaaatctacaactataagtacatgttggtctcgaaggaagtaaccacgaaaaacggcgcattctacgaccaaacaaaatacaacgccaagacaatcaacctaataccaatcaagaaagacaaacctaccaacatctacggaggttacaagggcaaagtatccagctacatgatgctcgtcaagatccagaaaaagaaagaagtcatctacaagttcgtaggagtgccacgactctggaccgacgaacttgaccgtctgatagatacagacgaaaagaaggccctcttaaagaaatga

SEQ ID NO: 6338 - RNA, 3459 nt, synthetic construct
  misc_feature 1..3459: note = Cas9 variant
  source 1..3459: mol_type = other RNA
atgaacgcggaacacggaaaagaaggtctcctaatcatggaagaaaatttccagtaccggataggcctagacatcgggataacaagcgtgggatgggcagtactacagaacaactctcaagacgaaccagtacgaatcacggacctcggggttcgtatcttcgacgtagccgaaaaccccaaaaacggcgacgcgctagccgctccacggcgagacgcacgaacaacccggagacgacttagaagaagacggcatagacttgaacgaataaaattcctactccaggaaaacggcctcatagagatggactccttcatggagaggtactacaaaggcaacctgcctgacgtataccaactcaggtacgaagggctcgaccggaaactaaaagacgaagaactcgcacaagtgctaatccacatagctaaacatcggggcttcaggagcaccagaaaagcagaaaccaaagagaaggaaggtggagccgtactaaaagcaacaaccgaaaaccagaaaatcatgcaggaaaaagggtaccgcacggtaggcgagatgctctaccttgacgaagcgttccacacagagtgcctttggaacgaaaaaggctacgtgctaacaccaaggaacagacccgacgactacaaacacaccatactaagaagcatgctagtcgaggaggttcatgcgatatttgcagcgcaaagagcgcacggcaaccagaaagcaacggaaggcctcgaagaagcgtacgtagaaatcatgacctctcagaggagcttcgatatgggacccggactgcaaccggacggaaagccatcaccctacgccatggaaggattcggggaccgagtgggaaagtgcacattcgaaaaagacgagtaccgcgcacctaaggcaacgtacacggccgaactcttcgtagcactccagaaaataaaccacacaaaacttatagacgaatttgggacaggccgattcttcagcgaagaggaaagaaagaccataataggccttctgctttcgtcaaaggagctaaagtacggcacaataaggaagaaactaaatatcgacccaagcctcaaattcaacagcctcaactacagcgccaagaaagagggcgaaacagaggaggaacgagtgctagacaccgaaaaagcaaaattcgcgtccatgttctggacctacgagtacagcaaatgcctcaaagaccgcaccgaggaaatgccagtcggagaaaaagcagacctcttcgaccgcatcggcgaaatcctcaccgcctacaagaacgacgacagccgcagctcccgattgaaagaacttggcctctccggcgaggagatcgacggcttgctagacctctcaccggcgaaataccaaagagtaagcctaaaggccatgcgcaagatgcaaccctacctggaagacggactcatctacgataaggcctgcgaagcggccggctacgacttccgcgccctcaacgacggcaacaagaaacacctcttgaaaggcgaagaaataaacgcaatagtgaacgacataacaaacccggtcgtgaaacgaagcgtatcacaaaccatcaaagtaataaacgcaataatacaaaaatacggaagcccgcaagccgtgaatatcgaactagcgcgagaaatgtccaagaacttccaagaccgcactaacttagaaaaggaaatgaaaaagaggcagcaagagaacgagcgcgcaaaacaacagataatcgagctaggcaaacagaatccaaccggccaagacatcctcaaatacagactgtggaacgaccagggaggctactgcctatacagcggcaagaaaatccccctggaagaactcttcgacgggggatacgatatagatcacatcctaccatacagtataacattcgatgactcgtaccgaaacaaagtcctagtaacagcccaagaaaacaggcaaaaggggaacaggaccccctacgaatacttcggcgcggacgaaaaacgctgggaggactacgaagcatcagtaagactcctggttcgggactacaagaaacaacaaaaactgctcaagaaaaactttacagaggaggaacgcaaagaatttaaagaacgaaacctaaacgacacaaaatacataacacgcgtcgtatacaacatgattcgccaaaacctggaactggaaccattcaaccacccagagaaaaagaaacaggtctgggccgtaaacggcgccgtaacaagctacctcagaaaacgctggggcctgatgcaaaaagaccgctccaccgatagacaccacgccatggacgccgtagtaattgcgtgctgcacagacggcatgatacacaagatcagccggtatatgcaaggaagagaactagcatacagtcgcaacttcaaattcccagacgaggaaacgggggagatcctcaaccgagacaacttcacccgagagcagtgggatgaaaagttcggagtcaaagtcccactaccgtggaacagcttccgggatgaactcgacatccgcctcctaaacgaggacccaaagaacttcctcctcactcacgctgacgtccaaagggagctggactaccccgggtggatgtacggcgaagaggagtcaccaatagaagagggacgatacataaactacatacgccccttattcgtctcaagaatgcccaaccacaaagtcacggggtctgcacacgatgctaccatacgatcagcacgcgactacgaaaccagaggggtcgtaataacaaaagtccccctaaccgacctaaagctcaacaaggacaacgaaatcgaaggatactatgacaaggattcggacaggctgctgtaccaagccctagtgcgccaactactgctacacggaaacgacggaaagaaagcgttcgcagaggacttccacaaaccaaaagccgacggcaccgaagggccggtcgttagaaaagtgaaaatagagaagaaacaaacaagtggagtcatggtccgcggagggacgggtatcgccgccaacggcgaaatggtccgcatagacgtcttccgagagaacggcaaatactacttcgtacccgtgtacaccgctgacgtagtaagaaaggtgcttccaaaccgcgccgccacacacacaaaaccctacagtgaatggcgcgtcatggacgatgcaaacttcgtgttcagcttatacagcagagacctcatccacgtcaaaagcaaaaaggacataaagacaaacctagtcaacggcggcctcctactacagaaggagatcttcgcgtactacacaggtgccgacatcgcaacagcctcaatcgcgggattcgcgaacgactcgaacttcaaattccgaggcctgggaatccaatcactagaaatcttcgaaaagtgccaagtagacatactggggaacatatcagtagtccgccacgaaaaccgacaagagttccattga

SEQ ID NO: 6339 - RNA, 3462 nt, synthetic construct
  misc_feature 1..3462: note = Cas9 variant
  source 1..3462: mol_type = other RNA
atgaaaaacatactagggctagacctaggactcagtagcatcggatggtccgtaattagggaaaactcggaggaacaggaactggtagcaatgggaagccgagtcgtcagcctaaccgccgcagagctgagcagcttcacccaaggaaacggggtcagcataaactcgcaacgaacccaaaaacggacacaacgaaagggatacgaccgctaccaattacgacgaaccctgcttagaaacaaattagatactctcggcatgctccccgacgactccttgtcatacctcccaaaactccagttatgggggctgcgggccaaggcggtgacccaaaggatcgagcttaacgaactcggacgcgtcctcctccacctgaaccagaaacgaggctacaaaagcatcaaaagcgacttcagcggtgacaaaaagatcaccgattacgtgaaaaccgtaaaaacccgatacgatgagctaaaggagatgaggctcacgatcggagagctattcttcagacgcctaacggagaacgcattcttcagatgcaaggaacaagtgtaccccaggcaagcctacgtagaggagttcgactgcataatgaactgccagcgtaagttctaccccgacatcctcaccgacgagacgatccgatgcatccgcgacgaaatcatctactaccaacgtcccctgaaatcgtgtaaatacttggtctcgcgatgcgagttcgaaaaacgcttctacctcaacgcagcaggcaaaaagaccgaggccgggcccaaagtctcacctaggactagccccctgttccaagtatgccggctgtgggagagcatcaacaacatcgtggtaaaggacaggcgaaacgagatagtcttcataagcgcagagcaacgcgccgccctattcgactttctaaacacacacgagaagctcaaaggatccgatctcctaaagctgctcggcctgagcaaaacatacgggtacagactaggtgaacagtttaagacgggaatccaagggaacaaaacgcgggtcgaaatcgaaagagcactcgggaactatccagacaagaaacggctgctccagttcaacctacaagaggagtctagttccatggtgaacacagaaacaggagaaatcattcccatgataagtctatccttcgaacaggagccactatacagactctggcacgtcctgtacagcatcgacgatcgagaacaacttcagagcgttctgcgacaaaaattcggcatcgacgacgacgaagtgctggaacgcctatccgcaatcgaccttgtaaaggcgggcttcgggaacaaaagttcgaaggctatacgcaggattctgcccttcctgcaactaggtatgaactacgcagaggcgtgcgaagcagcaggatacaaccactcaaacaactacaccaaagcggaaaacgaagcgcgagcgctactcgaccggttgccggccattaagaaaaatgaactacggcagcccgtagtcgagaaaatattgaaccaaatggtcaacgtcgtcaacgccctaatggaaaagtacgggcgattcgacgaaatccgcgttgaactagccagggagctaaaacaaagtaaagaagaacggagcaacacctacaagtccatcaacaaaaaccaaagagaaaacgaacaaattgccaaacgcatcgtggaatacggcgtacccacgagatcacgcatccaaaaatacaaaatgtgggaggaatccaagcactgctgcatctactgtggccaacccgtggacgtcggcgacttccttcgcgggttcgacgtagaagtcgaacacataatccccaaaagcctctactttgacgactccttcgccaacaaagtctgctcgtgccgaagctgtaacaaagagaaaaacaaccgcaccgcatatgactacatgaaatcaaaaggggaaaaagcactctcagactacgtggaacgcgtcaacaccatgtacacgaacaaccaaataagcaagaccaaatggcaaaacctactaacccccgttgacaaaatatcgatcgacttcatcgaccgccaattgcgcgaatcgcaatacatagcccggaaagcgaaagaaatcctcacaagcatctgctacaacgtcacagccaccagcgggagcgtaacatctttcctgcgacatgtatggggctgggataccgtcctccacgacctaaacttcgaccgatacaagaaagtaggactcaccgaagtaatcgaggtcaaccacagaggctcagtcatcagacgagaacaaatcaaagactggagcaaaagattcgaccaccgacaccacgcaatagatgccctgacaattgcatgcaccaaacaagcatacatccagcgactaaacaacctacgcgccgaagagggaccagacttcaacaaaatgtcgctagaacgctatatccaatcacaaccacactttagcgtcgcacaggtccgagaggccgtcgaccggatcctggtgagcttccgcgcaggcaaacgcgccgtgacaccaggaaagcgttacatacgcaaaaacagaaaacgaataagcgtgcaatcggtgctcatcccccggggcgccctttccgaagaatcggtctacggggtgatccacgtctgggaaaaagacgaacaagggcacgtcatccaaaaacaacgagccgtcatgaaataccccataacctccatcaacagagagatgctagacaaagaaaaagtcgtagacaagcgcatacaccgcatcctatccggacgactagcccagtacaacgacaaccccaaagaggctttcgcgaaacccgtctacatcgacaaagaatgccggattcccataagaaccgtcagatgcttcgccaaaccggcgataaacacacttgtaccccttaagaaagacgacaaaggcaacccggtcgcatgggtaaacccagggaacaaccaccacgtcgccatatatagagacgaagacggtaaatacaaagagaggacagtaaccttctgggaagctgtcgaccgatgccgggtaggaatcccagccatcgtcacccaacccgacacaatatgggacaacatattacagcggaacgacatttcggagaacgtactggagtccctgccggacgtaaaatggcagtttgtcctaagcctccagcaaaacgagatgttcatcctcggcatgaacgaagaggactaccgatacgctatggaccagcaagactacgccctacttaacaaatacctctaccgagtccagaagctgtcaaaatcagactactcgtttcgctaccataccgaaaccagcgtagaagacaaatatgacggcaaaccgaatctaaagctcagcatgcaaatgggcaaactgaaaagggtctcaataaaatccctacttggactaaacccacacaaggtccacatctccgtactgggggaaataaaagaaatctcatga

SEQ ID NO: 6340 - RNA, 3474 nt, synthetic construct
  misc_feature 1..3474: note = Cas9 variant
  source 1..3474: mol_type = other RNA
atgaactactacaacgggttcatcataacagagaacgctatgacgtcaaaacaagaaaaacacggcgcactaacattcggactagacataggaatagcatcagtggggtgggctgtactaggggaatcgcgaatcgtcgacctcggcgtacgctgcttcgacaaagccgaaaccgccaaagaaggcgagagcctgaacctcaccaggcgcatggccaggctcctccgcaggcggctgcgccgacgagcctggcgtctcacgaaattagcaaggttactaaaaagagaaggcctcatcgcggatgccaacctcttcaaacacaagatcgaaaagaacacgccggtacccaaatcaagctggcagcttcgcgtcgacggcctcgaccgacaactgaacgcggaagaatgggcccgagtgatctaccacctgtgcaaacaccgcggcttccactggatcagccgggctgaagaaaaagcggccgaaggagactccaaaggcgaaggcggaaaagtaaagcaggggcttgcaggcaccaagaaactaatgcaggagaaaagctaccgcacagcagcagaaatggtactagccgagttcccggacgcccaacgcaacaaacagggggactacagcaaagccttaagccgcatcctactgggcgatgaactcaaagccctattcgagcaccaacgcaaactaggaaacccagtagccaccgaaaaactcgaagcggccatcctcggcaacggggacaagaaatgcggactgttctgggcccaaaacccagcgctagcgggaaacaaactgctcgaaatgcttgggcgctgtacgtttgaaaagaccggcggagatgatggaaagggcgaataccgagcccccaaagcctcattctccgctgagagacatgtctggctcacccacctcaataacctccgtatcgtagtagacggcaccacaagaccactaaacgaagccgagcgcagggtagcactgccgatgccttaccagcaagcaggagacctaagctataaacagctaggcggagctctgataaaagaaggcttcctacagaaagacggattcaaattcgcgggcttaccctacccaacaaaacaagccagcgaagaaaaagccaaagacccagagacatccgtcctttgcaaactcccagcctggcatacgctaagaaaaacactagaaaagcacggtctcgagagcgaatggcagaagctatccacagacgccctggacggaaagcctcaactgctcgataacatagcctgggtgctcagcgtgtacaaagacgacgatgaagttaaaaccgaactcggcaaattaaacctcccgaacacagagaaaatgatagatgccttactagacatacgattcgacaagttctcaaacctttccctcaaagccctaagcaaaatcgtgccattcatggaacaaggacagagatacgacgaagcggtagcgaacatacctgaatatggacaccactcacaactccataaagttggcgcgggagaacacaaatacctaccaccgttttacaaagaacgggacaaaacaggacggatggtcttcaacgacgacatggacatcccgagaaacccagtcgttctgcgagccctgaaccaagcacgcaaggtcgtgaatgccctcataaaagaatacgggagcccacacgaggtacacatcgaaatggcgcgagacctatcaaggccgctagacgaaagaagagatatcgaaaaactacaaaaagagttcggagaacgaaacaaaaaggacaaggaactcttcgcgcaagacttcaacatagtcgggacagtaaaggggaaacaattcgaaaaataccaactttaccgcgaacaacaaggcaagtgcatatacccatccatggacgagaagcagggcatctgctgttactcgctgaaacccctcgacctccaccgcgtactctacgaagagggatacgcggaaatcgaccacgcactaccctactcgcgcagctttgacgactccaaaaacaaccgagtgctagtactagccaaagaaaacagggacaaaggcaaccgcacacccttcgaatacttaggagacaaggacaattcagaaccctggcgccaattcgtagcgttcgtagaaggaaacaaggcctaccgcctcgccaagagaagccgcctgctccgcaaggacttcggcgacaaagaagccaaggagttcagagaacgaaacctgaacgacacacgctacatctgtaagttcttcaaaaactacgtagaacaatacctccaacttcacgaagacagtgaagccaaacggtgcgtagtgctaagcggacaaatgacgtccttcctccgcgcacgatggggcctagtcaaagtgcgcggagactccgatagacaccacgcactcgacgcggccgtggtggcggcctgcagccacggaatggtaaaacgtctatccgattactcccgtcgaaaggaactcgagcaagtgcgcgagggcttcgtagacgtggacactggggaaatagtcaaccccgccatgttccagcaagtgcaggaacacttccccaacccgtggccacacttccgcgacgaagtaaagctccgactaagcatcgacgaccccaccctactgagatcggaaatggaaaagttcggcacatacactccggaatcactcgaagctctcagacccctattcgtaagcagggccccacaacgacgaaacagcggcgccgcacataaagatacaatatatgcacaaccaaaacggctcgtggcccagggcggagtgacccaaaaagtcgcactttcatcgctcacactcaaagacctagacaaactgatagatccacaccggaacgagcgcctctacgccgcaatccgagcacgccttgaacagcacggaggaaaaggagacaaggccttcccagcatcgaacccactccgaaagccagactcagaaggaaaccccacaggaccaatcgtacgaggcgtgacgatggttatagacaaactgtccggcattccaatccgtggaggaattgctaaaaatgactcaatggtcagggtggacgtattcaccaaggcaaacaaattccacctagtacccgtctatgtacaccacagtgtcctaggactccccaatcaagcaatcgtcggcggcaaggaagaaagcgaatggactcaaattgacgatagctttgactggcacttcagcatatacccgaacgacctcataagggtcaccctaaagcaggagggccgcttcggatattacgcgggctgcgacagaagcaccgccgccatacacttgtgggctcatgacagaaaccagcaagtgggcaaagacggactcatccgtagtataggggtgaagaccgcgttaagcattgaaaaattcaacgtcgacgtcctaggtaataggtaccctgcaccacccgagaaaagacgagacctagcatga

SEQ ID NO: 6341 - RNA, 3486 nt, synthetic construct
  misc_feature 1..3486: note = Cas9 variant
  source 1..3486: mol_type = other RNA
atgaagaaaatcctagggctcgatctcgggtcggcatcgattggctgggcacttgtagaagaaaccgagcagatgcaatacaacatcgtgtccctagggagccgcatcatcccatacaatggaacggaaggccaagagttcgaaaaagggacaggcgaatcgagaaacagcctacggacgaaagcgcgcaccgcaagaaaaggatacgacagatatcaactacgccgcaagaacctcgagaaaatcctactacaaaatggcatgtaccccaacgaacaagtcagagccctacagaagctagaactctggaagctgagggccgacgcccctaacgtacaaatatccctcccggaactcgggcgactactgttttggctaaatcaaaagcgaggttacaaaagtagcagaagcgacgcaaacctcgacaagaaagacacggaatacgtagcgaccgttaaaagccgacaccagaaaatcaaagacgcaggccaaacagtagggcaatacttttacggacaaatactagaaaacgaatatcaccgaatcaaggaacaggtcttcccccgcgaagcatacattgaagaatttgacgcgatcgtcgcgcgccaaaaagaatactacccaacaatcctcaagcaggaactgatagacaaaatccgcaacgaagtcatctactttcagcgaggcctcaaaagccagaagggactcgtatccgtgtgtgagttcgaagggcgcgagttcaacggacacttcggaggacctaaagtggcccccaaaagctcaccaatcttccagctaggcaaaatatgggaaaacatcaacaacatcaagatagcagacatagaattaaccgcagaacagaagctagtgttcttcaactacctcaattgccacgaaagaataacagaagccaaaatccgagaactcctaaaactcagcaaagactcacgactcaacggacaactgaaaaacggactaaccgggaacaaaacctactcccagatcgccagctgcttcggaaacaaaatcggagaatacgaacgcctattcaaattcgaattagaagtcattgaaagtgaaaaactagagtacacctatcatcccaaatcacacattccagtgggcgagaaacgacgcaaatacatcagtgaaaacgtcgaaaaagagccctactaccggctgtggcacaccatatatagcataaaagacaaagacgaatgccgagccgctctcatcaagaacttcggcatcgaagaggaaatcgcagaaaaactggcatcactcgacttctccgccggtggcttcggcaacaaatgcgcaaaggtcatacgcaaaatcctaccgtacctgatggaaggcgacaaatacaacgtagcaatggactacgccggctataaccacagcttctctcaaacaaaggacgaaaacctccagcgcgtattattggacagcatcaaccaccttcccaaaaattcactccggcagccaatagtggagaaaatactcaaccaaatgataaacctggtgaacgaagtaatcaagcaatggggacggccagacgaaattcgcgtcgaactagcccggaagctcaaacagtcaaaaactgaacgcaacgacgacgataacttcatgcgaaaacgcgaaagggaaaacgaaataatcaaagccgacctagcaaagtacggtctaaaggccacacgcaacaacgttataaaatggagactataccacgaaatagacgacaaggacaagaaactcaacgcaaggtgcatttactgcggccaaccaatctcactaaccgaagcaatcctcggaaacaacgtcgacgtcgagcacataatacccaaagacaaactctttgacgactcccaatctaacaaaacgctagcccaccgctcgtgcaactctggaaaaggaaacaagacagcttacgactttatgaaagacaaaccacagttcgaagaatatgtcgcccgggtcgaggaactctacaaaaagcacctaatatctctcacaaagaaacgcaaattcctcatgagcgaagataaaatcccgtcagacttcatagatagacagctccgcgaaagccaatacatagccagaaaaagcagagaaatcctccagacagtatgccgcaacgtctggagcacagacggcggcgtaactgcacaccttagaaaactatggggatgggacgacgtcaccatgaacctccaaatgcccaaatacaaaggaatcggcatgacagaaatcgtcgagtgggaatcgaaccacgggaaaaaccaacacacacaagaagtgataaaagactggagtaagcgagacgaccaccgccatcacgccatcgacgccctcgtcgtcgcatgcacccgccaggggtatatccagcgcatcaacacactaaacagcagcgagaccaaggacgagatgcaccgtaaggtggcaggcagcctagtggagtttaaccaaaagcacactcttctaaacaagtatctgataacagagaagccattcacaacctcggaagtcgaagacgttgtaagcaagatcctagttagcttcaaggctggcaaaaaggccgcaacgcccggaaaaagaaaagttgggaaacgaggaaacaagcaagtcgtccaagacgggataatcataccgcgaggcgccctacacgccgacagcgtcagcggctccatcaaacaatacgaccccacgggcaacttcgagaaccacaacgtaataaagtataaagtcggagtagggaaaggttaccttttcgacggcaaagacgacaaaaagaagatagacaagaccatcgactgcatcgtagacaagaaaatccgagacctcatcaaacaaagagccgaagaatctaactactcactcaagaaaatgttcgagaccccgatcctcttcaaccaacgagccgtattttccgttcgctgcaaaacaggcaacaaagccgtagtccccattcgaaacggatacgtcgtacccgacaacaaccaccatacggccatctacaaatacgacggaggactcaaagagcaatgcgtatccctaatgcaggccatagaacgcaaacgctacaacctccccatcatcatcaagaaccccaaagaaatatacgacaagatcaccgagatcgcaaacatcaaccagctactattcgactcgctacccaaactcgactgggagttcgtcaccacactccagaaaaatgacatgttcatcctggggatggactactcggcaacagaagaagccctagcggacggcaactaccggctcctaagcgagtacctctacaaagtacaaaacatcagcgacggaatctacagactttgccaccacacaataactaaatttgacctctcgaaggccaacaaaccagacaaacgtttctacaacatccagagcctgaaagcctggaacacccttaatccccaaaaagtcaaaatcaacatcctaggacaaatcgaaaggcaatga

SEQ ID NO: 6342 - RNA, 3501 nt, synthetic construct
  misc_feature 1..3501: note = Cas9 variant
  source 1..3501: mol_type = other RNA
atgcacgtagaaatagatttcccccacttttcacgcggcgacagccacctagcgatgaacaaaaacgagatattacgcggatcaagcgtgctctatcgactcggcctggatctcggatcaaacagccttggatggttcgtaactcacctagaaaagcgaggcgaccgccacgaaccagtcgcactcggcccagggggcgtccgtatatttcccgacggccgcgatccccaatccggtacaagcaacgcagtcgaccgcaggatggcaagaggcgccagaaaacggcgggaccgattcgtagagagacgaaaagagctaatagcggcactaataaagtacaacttactccccgatgatgccagagaaagacgagccctagaggtgctagacccatacgcactacggaaaaccgcactaacagacaccctccccgcccaccacgtcggccgggcgctgtttcacctcaaccaacgccgaggcttccaatccaaccgaaaaacagacagcaaacagtcggaagacggagcaataaaacaggctgccagcaggctcgcgacggacaagggcaacgagaccttaggggtattctttgcagacatgcatctgcgaaagagctacgaggaccggcaaactgcaataagagcggagctcgtcaggctaggaaaagaccacctaaccggaaacgcccgaaagaaaatatgggcaaaggttcgaaagcgacttttcggcgacgaggtcttaccacgagcagacgccccacacggagtacgagcgcgagcaaccatcacaggaacaaaagcctcgtacgactactaccccacccgggacatgctcagagatgagttcaacgccatatgggcaggacaaagcgcgcaccacgcaacaatcaccgacgaagcgagaaccgaaatagaacacataattttctaccaacgaccactgaaacccgctatcgtaggcaaatgcacactcgaccccgccacccgcccctttaaagaggaccctgaaggctaccgcgcgccctggagtcaccccctcgcgcagcgattcaggatactgtcagaggcacgcaacctagaaataagagacactggcaaagggtccagaaggctaaccaaagaacaaagcgacctcgtggtagccgccctactcgcaaacagggaggtaaaattcgacaaactacgaaccctcctaaaactccccgccgaggccagattcaacctcgaatcagacagaagggctgcgctagacggcgaccaaacggcagcacgtctaagcgacaaaaagggctttaacaaggcatggcgcggcttcccgcccgaacgacaaatcgcaatcgtagccaggctagaggaaaccgaagacgaaaacgaactaatcgcatggctcgagaaggaatgcgccctcgacggggcagcggcagcacgagtggcaaacacaactctgccagacggacattgccgactcggtctcagagcaatcaaaaagatagtaccaatcatgcaggacggactggacgaagatggcgtagcgggcgcgggataccacatcgccgccaaaagagcaggatacgaccacgccaagctgcccacgggggaacagctcggacgactaccatactacggacaatggctacaagacgccgtggtaggcagcggtgacgcgcgagaccaaaaggaaaagcaatacggccagttcccaaaccccacagtacacatcggactcggccagctacggagagtcgtcaacgacctcatagacaaatacggcccaccaacagaaatctcaattgaatttacccgcgccctcaaacttagcgagcaacaaaaagccgagcgccaaagggagcagcgccgaaaccaagacaaaaacaaggcaagagcagaagaactggcaaaattcgggagacccgcgaacccgcgtaatctccttaaaatgaggctctgggaggagctcgcacacgatccactcgaccggaaatgcgtgtacacaggagaacaaataagcatagagagactgctcagcgacgaagtagatatcgaccacatcctaccagtcgccatgacattggacgacagccccgcgaacaaaataatctgtatgcggtacgccaacagacacaaacgaaaacaaacccccagcgaagcattcggaagctccccgaccctccagggacaccgatacaattgggacgacatagctgcccgagcaaccggactaccgcgcaacaagcgctggagattcgacgcaaatgcccgcgaagagttcgacaaaagaggtgggttcctagcgcgacaactcaacgaaaccggatggctcgcccgactagcaaaacaatatctaggcgcagtcacagaccccaaccaaatatgggtagtccccggaagactaacaagcatgcttcgaggaaaatggggtctaaacggactccttccaagcgacaactacgccggggtacaagacaaggcagaagagttcctcgcctcaacagacgacatggaattttcaggcgtcaagaaccgtgcagatcaccgacaccacgcaatcgatgggctagtaacagccctcacagacaggtccctcctctggaaaatggccaatgcatacgacgaggaacatgaaaaattcgtaatcgaaccaccctggcccacgatgagagacgacctcaaagcagccctagagaaaatggtagtcagccacaaacccgaccacgggatagaaggcaagctacacgaagacagcgcctacggcttcgtaaaacccctagacgcaaccggcctcaaagaagaagaggcagggaacctcgtataccgaaaagccatcgaaagcctaaatgaaaacgaggtggatcgcataagagatattcaattaagaacaatagtgcgggatcacgtcaacgtagagaaaacaaaaggagtggccctagccgacgccctccgccagctccaagccccatccgacgactatccccaattcaagcatgggctgcgccatgtccgaatactcaagaaagagaaaggagattacctagtcccaatagcaaaccgagcatccggcgtcgcctacaaagcctacagcgcaggagagaacttctgcgttgaagttttcgaaaccgcaggcggaaaatgggacggcgaagccgtcaggcgcttcgacgccaacaagaaaaacgccgggcctaaaatcgcacacgcaccacaatggcgtgatgcaaacgaaggtgccaaactggtcatgcggatccacaaaggagacctaatacggctcgaccatgaaggacgggcgcgcatcatggtagtacacagacttgacgcagcagccgggcgattcaaactagccgaccacaacgaaacaggtaacctagacaaacgacacgcgacaaacaacgacatcgatccattccgctggctaatggcgagctacaatacccttaagaagttagccgcggtcccagtgcgcgtagacgaactagggagagtatggagagtcatgcctaactga

SEQ ID NO: 6343 - RNA, 3507 nt, synthetic construct
  misc_feature 1..3507: note = Cas9 variant
  source 1..3507: mol_type = other RNA
atggcgcgcccagcgttccgcgccccgcgaagagagcacgtcaatggctggacccctgacccacaccgaataagcaaacccttcttcatcttagtcagctggcacctactcagtagagttgtcatagacagcagctcaggctgcttcccgggcacgtcaagagaccacaccgacaaattcgccgaatgggaatgcgcagtacaaccctacagactcagcttcgatctaggaactaacagcatagggtggggattattaaacctagatcggcaaggaaaaccacgcgaaatcagagccctaggatcacgaatattctccgatggaagagacccacaagacaaagcaagtctagccgtcgcccggcgtctggcaaggcaaatgagacgaagacgcgacagatacctgacgaggcggacacgactaatgggagctctagtgcgctttgggctgatgccagccgacccagcagccagaaaaagactagaagtcgcagttgacccgtacctagcaagagaacgcgcaacaagagagcgcctagaaccattcgagatcgggagagccctattccacctgaaccagaggagaggatacaagccggtaagaacagcaaccaagcccgacgaagaggccggcaaagtcaaagaggcggtagagagactggaagcagcaatagcagccgcaggagcgccaacactgggggcctggttcgcctggcgcaaaaccagaggtgaaaccctgcgcgcccgattggcggggaaggggaaggaagcggcatacccattttatccagcaaggagaatgctagaagccgagttcgacactctctgggccgaacaggccagacaccatccggacctcctgacagcagaagcccgggaaatactaagacaccgaatattccaccaaagaccactaaaaccaccgccagtaggacgttgtacactgtacccagacgatggccgcgcgccgagagcactcccaagcgcccagcgactccgcctattccaagaactggcaagcctcagagtgatccaccttgacctaagtgaacgaccattaacaccggccgaaagagacaggatagtagcgttcgtccaagggaggccacccaaagccggcaggaaacccggcaaagtccagaagtccgtcccgtttgaaaaattaagaggactcctagaattaccaccgggaacaggcttctcactggaaagcgacaagagaccggaactactcggagacgaaaccggagcaagaatcgcccccgccttcggcccgggatggacagcgctgccgctagaagaacaagacgcactcgtagaattgctgctcacggaagcagaacccgaacgggccatcgctgcgctgactgcacgatgggccctagatgaagccacagccgccaagctagcaggggccactctacccgacttccacggacgatacggacgccgagcagtagccgaactgctaccagtcctcgaaagagaaacgagaggggaccccgacggccgggtgcgccccattagactggacgaagcggtaaaactcctgcggggaggcaaagaccacagcgactttagcagggaaggggccctactagacgctctcccatactacggagccgtactcgaacgccacgtcgctttcggaacagggaatccagccgaccccgaagagaaaagagtaggacgagtcgcaaacccgacagtccacatagccctgaaccagttacgtcacctagtaaacgccatactggcaaggcacggaagacccgaagaaatcgtaatcgaactggcaagagacctaaaaagaagcgccgaagacagaagaagagaagacaagaggcaggcagacaaccagaaaagaaacgaagaacggaaacgactgatattaagtctaggagaacgaccaacgccacgaaacctattgaaactgcggctctgggaagaacagggccccgtagagaatcgcagatgcccatatagcggagagactatatcaatgcgaatgttacttagcgaacaggtcgacatagaccacatactcccattcagcgtatcattggatgattcagcagccaacaaagtagtgtgcctcagagaagcaaatcgcatcaagcggaaccgatcgccatgggaggcttttggccacgacagcgaaagatgggcagggatactagcaagagcagaagccctaccgaagaacaaaagatggagattcgcaccagacgcgctagaaaaactcgaaggcgaaggaggcttacgagcccggcacttaaacgacacgagacacctaagccgcctagcagtggaatacctccgctgcgtatgcccaaaagtgcgcgtgagtccaggccgactcacagcgcttctccgaaggagatggggcatagacgcgatcctagcagaagccgacggcccaccgccggaagtgccggccgaaaccctagaccccagcccagccgaaaagaaccgcgccgatcacagacaccatgccctagacgcggtcgttataggttgcatagacaggagcatggtacaaagagtccaactagctgctgcgtcagcggaaagggaagccgcagcaagagaagacaacatacgcagggtactagaaggcttcaaagaggaaccgtgggatggattccgcgccgagctggaaagacgagccagaacaatcgtcgtcagccaccgaccggaacacggcataggaggggcactacacaaggaaacggcctacggaccggtcgatcccccagaagagggcttcaacctcgtggtaagaaaaccaatcgacgggcttagcaaggacgaaataaactcagtccgcgacccaagactaaggcgagcattaatagaccgactagccatccgccgaagagacgcgaacgacccagcaacagccttggccaaggcagccgaagaccttgcagcccaaccagcaagtcgtgggataaggcgagtaagagtactaaagaaagagtcaaatccaatccgagtggaacacggaggcaacccatcaggcccccgctcagggggcccattccacaaactcctactcgcaggagaagtccaccacgtcgacgtcgcgctaagagctgacggcagaagatgggtcggacactgggtcacactattcgaagcacatggcggacgaggggccgacggcgcagcggctccaccccgactaggcgacggcgagagatttctcatgagactacacaaaggcgactgcctaaaactagaacataaaggacgagtgagagtgatgcaagtggttaaactcgaaccgtcgagcaacagcgtagtagtggtagagcctcatcaagtcaaaacagacagaagtaaacacgtaaaaataagttgcgatcaactaagagcacgaggagcacgtcgcgttacagtcgaccccctaggacgcgtccgcgttcacgcaccgggagccagggttggaataggaggcgatgcgggtcgcaccgccatggaaccagcagaagacatcagctga

SEQ ID NO: 6344 - RNA, 3513 nt, synthetic construct
  misc_feature 1..3513: note = Cas9 variant
  source 1..3513: mol_type = other RNA
atgagcaaatacaatgtagggctcgacatcggcatcgcgagcgtgggctggagtatagtagatgccgacaaaaagaaaatcatcgacctgggctcccgcattttctcatcaggcaacgcggccgccaaccaagaacgccgcgggttcagaggaaccaggcgcttaatcaggcgacgaaagaaccgactgacggacgtcatcaacttctttggggagaaaaagttcatcgacacgaaagtagtcgacaagaacggtcacgtacactacaaattcagtgtgaacaacacagaaagcccctacgaattgagagtaaaaggcttgagcgaaatactcaccaagcaggaactcgtcattgcactataccacatagtaaagcacaggggtatctcgtacgacctcggtgacctcgaagacgacggaaccagcggtgtgacagattacaaaacaagtataaatataaataggcaactactcaatgagaaaaccgtaggccaaatccaactggaacgtctcaacgagttcggcaaagtacgcggacaagtcgaagaaaacgaaaacgtaacgctactcaacgtcttcccatccgcagcgtacgtcaaagaagccacgcaaatcctcacaaaacaacgagagttctaccccgaaatcacggatgacttcatagccaaattcatgctatttatcacgagaaagcgagactacttcgtcggccctggtaatgagaaatcaaggacggactacggaatttacaagaaagacggccggacgctggacaacctgttcgacgagctgatcggcatagacaagatcaacggcgagaaaagagcgtccgcgtcatcgttaacggcccaaatatacaacatgctcaacgacctcaacaacctgacagtccccaacaccgaagacgggcgcctaaccatccaaaccaagaaagaaattctagaagcagcaaaaacaaccaacggcctattcggaatcgcgcaaatatgcaaaatcataggatgcaaaaaggacgatatcaaaggcttccgaatcgataaatcagagaaaaagatcatgcacacactctccggctaccgcaagttccgcaaagagctggccgacgtcaacatagaagccaacgacctaaacatcaacctagttaacaagatcgcggacatcctgacactcaatacagaaaaggcagagattaggaagcaactagacaaaagtaacatggatatctcgaacgagatgaaagaaatagtaattaacaaaaacaaagagttcctagtcgatggacgagcgacctggcactcgttctcatataaaaccctgaacttactaatacccgaactcctcaacacgcccgaagaacaaatgacgatcctaaccaggctagggctcgtaaaaccgaacaacaaaaagtacgagggcctcaagaacatcccagccaggagaataactgaagaaatatacaaccccgtggtcgcccgcgcgaccagagaagccgtaaacgtattcaacgcaataacgaagaaagtcgggagagacaacataaaagacgtcattatcgagctgccgcgtgaagacaacgaagtagacatcaagaaaggcatagtcaaacgccaaaaacagaacgaagtcgagaaagagacagccgacgcgctagttaaacaacacatgaccatcagtgacagcgctctcatcgcacagtaccgcaaaatacgtggtctctcccaaaaagtacgatactggtaccagcaagacacgatctgcccgtactgcggcaagaaaatagaggccgtccaactcataaacaacaacgatagctttgaagtggaccacatagtacccatctcagtatccttcgacgacagccagaacaataaagtgctagtacacagtcaatgtaaccaggccaaagagaaacaaacacccctcggctggctgaacaacggaggcggctttgggcaatccaaagcggactacatcgccagggtaaaatcaaacaaaaactacgcgaaaaacaaaatcgataacctcctaaacgaaaccgacctaaacgacatagcaacacaaaggggattcatacagcgaaacctcaacgacacccgctacgcgtcccgcatagtgctcaacgaattttatagcttcttccgaagcaacaacttaagtacgaaagtcaaagtagtacgcggtaaatggaccagccaaatgcggaaaaagtggaacggggtgggaggactgagcaagacccgcgacacttaccaccaccatgcaatcgacgcctgcataatcgcgtgcttcccccttctaaaagccttcgataaggcaatcaaactgatcgacgttgatggcgaaaccggggaaattctgcaagacaagaaggcgatcaaacttgctcaggaggcagaaatcgtcgaaaagataagcgtaataaagaacaagaaattcgagaacatggtgaacgaaatctacaacttccccctgttcaaacaagtcgagctcgcgaacgacatcaccaacctcgagaaccccgtcaaattctcgcaccacgtggacaagaaagcaaacagggccgtagcaaaccaaaccatatacggcacccgaataaaagagaaagaggtcaccaagcgaggcaagaaagagaaaatacaagaacgatacacactcggaacgatcaagaacatctacgacatcgacggcttcatgaacttcaagaaactatacgataaaatcagcaagaacgacgacgtcaaattcctaatgcagaaaaacgatcccaaaacctgggagaagctaatagacattttcaacagttatcccgactcagaagaagtaacacaagtcgacggaaaagtcaagagagtcgccgttagtccattcaaactgtactacagagaaaacggattcataaccaaatacagcaaacataacgacggccccaaggtcgtgagcattaaatattacgacagcaaagtcggaagccacatagacataaccccaaaggacgcacggaacaaggtgatactccaatccctcaaaccctggcgcaccgacgtgtacttcaactccataacgcagcaatacgagctactaggcttgaagtatagcgacctaaagttcaccaacggggtgtacgggatcacaagagatgcatacgagaagctaaaacacggagtgtcagaggacggagtaaccgcgtggaaaccgatctcgaaaaattccgagttccgcttctcgctctaccgcaacgaccgggtccgagtaatcgacgagaaaggagactcaattgagctgttattcgcctccaggaccacaagcaatgaaggatacgtcgaactgaagccgatctacaaagcgaagttcgacagcaaggaagaagtcggtttctatgggctggtcagcaatggcagattaataaagaaaatgtccaaaggagggtacaaactctacaaagtaaacacagacatcctcggaaaaccatattacgtgactagagaatcagacgagccgaaactctcactctga

SEQ ID NO: 6345 - RNA, 3516 nt, synthetic construct
  misc_feature 1..3516: note = Cas9 variant
  source 1..3516: mol_type = other RNA
atggctaaatacagcgtgggcctcgacataggcataagctcagtcggctgggcaataatcgacatcgaaacaaagcagatcgtcaatctcggcagccgcatattcccctctggcaacgcagccggaaaccaagagcgccgcggcttccgcggaattagaagacttatccggcgcagaaagaaccggctaacggacctcaagaaactactcggtgagacattctttagcgacctcaagaaaatagactccaacggctacgaatactacgacatagacttccagatcaacgccaatccatacgagcttcgagttaaaggcataaccgaaaaactcagcaagaaagaactcgcagtggtactccaccatatcataaaacaccgcgggataagctacgacctcggagaccttgaagacgacggcacgtccggtgtcagcgactacaaaaatagcatcaacataaatcgacaactcctgagagagaaaaccgtcggccaaatacagctcgaacgactaatcgagttcaaccaagtccacggccaagtaaagaaagccgaagacgtaagccttctcaacgtcttccccagctccgcctatagggacgaagcaaacaagataatgatcaaacaacaagagttctactccgaaataaccaactctttcatggaacaggtagaccaactcgtcagccggaaacgtgactacttcatcggccccggaaacgaaaagtcccgcaccgactacggaatctacaaaagcgacggaaggacactggacaacctattcgcagagctcatcggtacggacaaaataaacggcgaaaagcgcgcctcagcgtccagcctaaccgcccaagtgtacaacctgctgaacgacctgaacaacctgcacgtctccaacacagaagacggaaagctgaccacgagcacgaaaaaggagatcattaaagccgccaaaacaacggacggggtcttcggaatctcccagatctgcaaaatcatcggctgcaagaaagaagaaataaccggcttccgccaagataagtcggaaaagaaagtcatacacaccctagcaggataccgaaaaatccgcaaagccttggccaccatcaacatagaggcaaacgaactcaaccccacagtattcgatcaaatcgctgacatactgacgctgaacaccgagaaagcagaaattcggaaacagctagacaaggttcaactagacataacagacgaaatgaaagaattagtaatagacaaaaacaaagatttcctggttgacggcagagcaacatggcacagcttctcctatcaaacacttaacatgctcatccccgaactcctgaacacaagcgaggagcaaatgaccatcctaacccggatgggactaatgaaatccgataacgagaaataccgcggcctaaagaaaataccagccgagaaaattgcatcggaaatattcaacccagtcgtggcaaaatcaacacgggaagcaataaaagtcttcaacgcaatctccaaagaaatcggaaagaacaacatagaacatgtagtgattgagctgcctcgagacgacaacgaagaagacgagaaacgcaaaattcaaaagctacagaaagccaacgaaacagaaaaggaggcagccgacaacctagtgaaacacaaactcgggatatctgacagcgcactcatcgctcactaccgcaagttcaaaggcctgtcgcaaaaagtccgatactggtaccaacaagaaacctattgcccctattgcggcaaaattatagaagccacacaactaatcaacaacaacgacaacttcgaagtagaccacatcataccgatatcggtgagttacgacgactcccagaacaacaaggtactcgtacactcgcaatgcaaccaagcaaaagaaaagcaaactcccctcggatggatcaacaacggaggcggcttcggccaaagcaagaacgagtacacaaaccgagttaaaaataacaagaaatactccaaaaacaaggtggacaacctcttaaacgaaaccgacctcacagacatcatcacccagcgcagcttcatccagcgaaaccttaacgacacccgttatgcagctcgtacagtacttgacgagttctactcattcttcaagagcaacgacctccctacgaaagtgaaggtcgtccggggcaagtggaccagtcaaatgcgccgcaaatggaacaacgtcggtggactccgaaaaacacgagatacacaccaccaccacgcaatcgacgcgtcgatcatcgccagcttccctcttctaagagcattcgacagagccataaagctcatcgacgtagacaaagaaaccggggaaatcgtccagtacggcaaggcatccctgaacggcgacgtcatagaagaaaaatcagtaatccaggcgccgataatcaagaacgagaaatttgagaagctagtagacgaaatatacaacttcccattattcaaacaagtcgagctggccaacaacatcgagaacccagaaaaccccgtcaaattcagccaccacgtcgacaagaaagcgaacagaacggtagctaatcaaaccatctacagcacccgtatcaagaaaaccgagaaaatcgtacgcaagaaagtaaccgctaaagaagaagagtacgtcatcgggaccataaaagacatctacgacgtcaccaacttcgagaaattcaagaaactctacgacgaaagcagcaagaaagacgacattaaattccttatgcagaaaaacgaccccaaaacctgggaaaagctagtggagatcatgaatacctatcccgactacgaggagataagccagctggacgggaaagtaaaacgagtaaaagtcagcccattcaaactctacttccgggaaaacggattcatcaccaaatacgcaaaacacaacaacggccccaaagtcgtgagcataaaatactatgactccaaactaggaaatcacatagacatcacccccgtaaacgccaacaacaaagtaatactacagtcactcaaaccctggcgaacagacgtctactataacaacgaaacccaacagtacgaactcctagggctaaaatacagcgacctgaaattcaccaaaggcgtttacgggataacccgagaagcctacgaaaaactaaagtacgggtacaccgacggagtgccagcatggaaaccgataagcaaagagtctgagttcaaattctcattgtaccgtaacgaccgagtacgcatcatcaacgaagcgggtgagaaaattgacctcctattcggttcccgcaacgaaacaagcgaaggctacgttgaaatgaaaccaatcttcaagacgaacttcgacgacgcagaagaagcctccttttacggtaagaccagtaacaaacggctaatcaagaaaatggcacggaaggggtaccagatctataaggtaaacaccgacatcctaggcaacctatactacacggcaaaggaaagcaacgaacccaagctagacctatga

SEQ ID NO: 6346 - RNA, 3519 nt, synthetic construct
  misc_feature 1..3519: note = Cas9 variant
  source 1..3519: mol_type = other RNA
atgcgcaaaccctacagcatcggcctagacatcggaaccaactcggtaggctgggcggttattaccgacgactacaaagttccatccaagaaaatgcgaatccagggaacaacagacagaacaagcataaagaaaaacttaatcggggccctcctattcgacaacggggagaccgccgaagccacacggctcaaaagaacaacacgccgccgctacacacgccgaaaatataggatcaaagaactacagaaaatcttctcctccgagatgaacgagctcgacatcgccttctttccacgcctaagcgagagcttcttggtttcagacgacaaagagttcgagaaccatccgatcttcggcaacctaaaagacgaaataacctaccataacgactaccccacaatctaccacctccgccaaacactcgccgactccgaccaaaaggcagatctacgactcatctacctcgcgctcgcgcacatcatcaaattcaggggccatttcctaatagaaggcaacttggattcggagaacaccgacgttcacgtcctcttcctcaacctggtaaatatctacaataacctcttcgaagaagacatcgtcgaaacagcctccatcgacgccgagaaaatacttaccagcaaaacttcaaaatcccgccgcctagagaatctcatcgctgaaatacccaaccaaaaacgaaatatgctattcgggaacttagtatcgctcgcgctcggactcaccccaaactttaaaacgaacttcgaactactggaagacgccaaactccaaatatccaaagacagctacgaggaagacctcgacaatctccttgcccaaatcggtgaccaatacgcagacctctttatagccgcaaagaaactcagcgacgccatcctcctatcagacatcatcaccgtcaaaggcgcctccaccaaggcacccctatcagcaagcatggtgcagcgctacgaagaacaccaacaagacctcgccctcctgaaaaaccttgtgaaaaagcaaataccagagaagtacaaagaaatatttgacaacaaagaaaagaatggatacgcaggctatatcgatggcaaaacttcccaagaagagttctataaatacataaaaccgatcctcctaaaattggacggcaccgaaaagttaatctcaaaactcgaaagggaggatttcctacgcaaacaacgcacattcgacaatggatcaatcccccaccagatccacctaaacgagttgaaagcgatcatccgccgacaagaaaaattttacccattcctaaaggaaaaccagaagaaaatcgaaaaactattcaccttcaaaattccatactacgtgggccccctcgccaacggccaatcgtcgttcgcctggttgaaacgccaatccaacgaaagcataacaccctggaacttcgaagaggtggttgaccaggaagcgtcggctcgcgccttcatcgagcgaatgaccaacttcgatacctacctcccggaagagaaggtactccccaaacacagcccactctacgaaatgttcatggtctacaacgaactaaccaaagtcaaatatcaaaccgaaggaatgaagcgcccagtcttcctcagcagcgaagataaggaagagatcgtcaacctccttttcaaaaaggaacgaaaggtaactgtaaaacagctaaaagaagaatatttcagcaaaatgaagtgcttccacacggtaaccatcctcggcgtggaagaccgattcaacgccagcttaggaacgtaccatgacctactgaaaatattcaaggacaaagccttcctagacgacgaagcgaaccaagacatactagaagaaatagtatggacactgacactgttcgaagatcaggccatgatcgagcgtcgtctagtgaagtacgcggacgtcttcgagaaaagcgttctcaagaaattaaagaaacgtcactacactggctggggtaggctctcacaaaaactgatcaacgggatcaaggacaagcagaccggcaaaacgatactcggcttcctaaaagacgacggcgtcgccaaccgcaacttcatgcagctcattaacgatagcagcctcgatttcgccaagatcatcaaaaacgaacaagagaaaaccatcaagaacgaatcactagaagaaaccatcgcaaacctggctggctcccccgcaatcaagaaaggaatactccaatccataaagatagtcgacgaaatcgtcaaaatcatgggccagaaccccgacaatattgtaatcgaaatggcccgagaaaaccagagcaccatgcaaggaataaagaacagccgccagcgtctccgtaagctagaagaagtacacaaaaacacaggctccaagatactcaaggagtacaacgtgagcaacacccaactccagagcgaccggttatacctatacctgctacaggacggaaaagatatgtacaccggcaaagaactagactacgacaacctatcccagtacgacatagaccatataatcccccaatcattcatcaaagataacagcatcgacaacacagtcctcaccacgcaagcaagcaaccgagggaaatctgacaacgtgcccaacattgaaacggtcaacaaaatgaaatcattctggtacaaacagcttaaaagcggcgccatctctcaacggaaattcgaccacctaacaaaagctgagcgcggagccctcagcgacttcgacaaagcggggttcatcaaacggcaactcgtcgagacccgacaaataaccaaacacgtcgcccaaatattggactcacgcttcaactccaacctaaccgaagactctaagtccaaccgtaacgtcaaaatcatcaccctaaagtcaaagatggtatccgacttccgaaaggatttcggcttctacaaactccgggaggtaaatgactaccaccacgcccaagacgcctacctcaacgcagtagttggcacagccctgctcaaaaagtaccccaaattggaggccgagttcgtctacggcgactacaagcactacgaccttgcaaaactcatgatccagcccgattccagcttgggcaaagcgactacccgcatgttcttctacagtaacctaatgaatttcttcaagaaagaaataaaactagcggacgacacgatcttcacacgcccacaaatagaagtgaacacggaaaccggcgagatcgtatgggacaaagtgaaagacatgcaaaccatcagaaaggtaatgtcatatccgcaagtgaacatcgtgatgaaaaccgaagtgcaaaccggtggattcagcaaagaaagcatctggccaaaaggcgacagcgacaaactcatcgcccggaagaaatcttgggaccctaagaaatatggaggcttcgattcgcccatcatcgcctacagcgtactcgtagtcgcaaagaattgcaagcgtaaaaattcgaaaaccaaaaattaccaaagaacgtgcgggaataaaaacaacggcacacgatga

SEQ ID NO: 6347 - RNA, 3522 nt, synthetic construct
  misc_feature 1..3522: note = Cas9 variant
  source 1..3522: mol_type = other RNA
atgagacctatcgaaccctggatcctaggtctagacatcggcacagacagcctcggatgggcagtcttctcctgcgaagaaaaaggcccacctaccgccaaagaactgctagggggaggagtcagactatttgactccggaagagacgccaaagaccatacatccagacaagccgaaagaggcgcatttcgacgggcccgtcggcagacgaggacctggccctggagacgagacagactaatagccctattccaagcagccggcctcactccaccagcagcagagacacggcaaatagcgctcgcattgcgtcgcgaagcggtaagccgacccctagcccccgacgccctctgggcggccctcctccatctagcccaccaccgaggattccgaagcaaccggatagacaagcgcgaacgagccgcagcaaaagcgttagccaaagcgaaacccgccaaagccaccgctaaagctacggcaccagcaaaagaagcagacgacgaagctgggttctgggaaggcgcagaggcggctctcagacaacgcatggcagcaagcggagcacccacagtgggcgcattactagcagacgacctagacagaggacaacccgtacggatgaggtacaaccaaagcgatcgagacggtgtagtcgcacccaccagagcactcatcgccgaagaactggccgaaatagttgcccgacaatcgtccgcatacccaggcctagactggcccgccgtcaccaggctagtacttgaccagcgacccctgcgctcaaaaggggcaggcccctgcgccttcctaccaggggaagaccgtgcgctccgagccctaccaaccgtacaggacttcataatacgccaaacattagcgaaccttagactaccctcgacaagcgccgacgaaccacgcccgctaacagacgaagaacatgctaaagcactagcactcctatccaccgcccgcttcgtagaatggcccgccctacgccgagcactcggacttaaacgaggcgtcaaattcacggcagaaacagagaggaacggagcaaagcaagccgccagaggcacagcgggcaatctcacagaagccatactggcgcccctaataccaggatggagcggatgggacctcgaccgaaaggacagagtattcagcgacctgtgggccgcaagacaagaccgaagcgcactattagctctcataggagatccacgcggaccaacacgagtaactgaggacgaaaccgctgaagcagttgcggatgccatccaaatagtactgccaactgggagagccagcctctcggccaaagccgcaagagcgatcgcacaagcaatggcacccggaataggatacgacgaggctgtaacactagcactaggactccatcacagccacagaccccgtcaagagcgactcgctcgcctaccgtactacgccgccgcactacccgacgtcggattagacggagaccccgtcggacccccgccagcagaggacgacggcgcagcagccgaagcatattacggtcgaattggcaacatcagcgtacacatagcactaaacgaaacacgaaaaattgtaaacgccctcctacacagacacggccctatactacgtctcgtaatggtagaaacaacaagagagctaaaagcaggcgctgatgagcgcaaaagaatgatcgcagaacaggccgaaagagaaagagaaaacgccgagatagacgtagaactaaggaaatcagatagatggatggcaaacgcgcgcgaaaggagacagcgtgtgagactggcgcgaagacaaaacaacctatgtccatacacatcaacaccgattggccacgccgacctactcggcgacgcatacgacatcgatcacgtaatcccactcgcccgaggaggaagagactcactcgacaatatggtactctgccaaagcgatgccaacaaaaccaaaggagacaagacaccttgggaagcatttcacgacaagccgggatggatagcacagagggacgatttcctcgcccgcctggaccctcagacagcaaaagctctagcatggcgattcgccgatgacgccggcgaacgagtggcccgcaagagcgcagaagatgaagaccaaggtttcctcccccgccagctgacagatactggctatatcgccagagtagccctgagatacctatccctcgtcaccaatgagcccaacgccgttgtagccacaaacggtcgattaacagggctattgcgcttagcctgggacattacccccggacccgcaccgcgagatttactgccaacacccagagatgccttacgcgacgacacagctgcccgacgattcctagacggtttaaccccaccacccttagccaaagccgtcgaaggcgccgtacaagccagactggccgcactcggacgctcacgcgtggcagacgcaggactagcagacgccctcggcctcaccctcgcctccctgggcggaggaggcaaaaacagagcagaccaccgacatcacttcatagatgccgcaatgatagccgtaacaacacggggcctaatcaaccaaataaatcaagcatcaggcgcaggacgcattctagacctccgcaaatggccccggacaaacttcgaacccccatacccaacatttcgagcagaagtcatgaaacaatgggatcatatacacccgtcgatcagaccagcccacagagacggtggcagcctacacgcagccactgttttcggcgtcagaaacagacccgatgcccgcgtcctcgtacaaagaaaacccgtagaaaaactcttcctggacgccaacgcgaagccgctaccggcagacaaaatcgcagaaataatcgacggtttcgcatcgccgagaatggcgaaaagatttaaagcgctcctcgcacgctaccaagcagcccaccccgaagtaccaccggcactagcagcactagcagtcgcgagagacccggctttcggaccccgcggaatgacggccaacaccgtaatcgcaggacgatcggatggagacggagaagacgcggggctaatcacaccgttccgagcaaacccaaaagccgccgtaagaaccatgggaaacgccgtctacgaagtctgggaaatacaagtaaagggacgcccacgatggacccatagggtgctcacaaggttcgaccggacgcaacctgcacccccaccaccaccggaaaacgctcgcctggtgatgaggctacgccgaggcgatctggtatactggccactagaatcaggagaccggctgttcctggtaaagaaaatggctgtagacggcagactcgcgctctggccagcccgcctagcaacagggaaagcaacagcactatacgcccagttatcctgcccgaacatcaacctaaacggcgaccaaggatactgcgtgcagagcgcagagggcatacgcaaagagaaaatacgaacaaccagctgcacggcactaggacgactacgcttaagcaaaaaggcaacatga

SEQ ID NO: 6348 - RNA, 3525 nt, synthetic construct
  misc_feature 1..3525: note = Cas9 variant
  source 1..3525: mol_type = other RNA
atgggtaaatactccataggactagacataggtatctcaagcgtaggctggagcatcatcgacatcgagaaaaagaaaatagtcgacttgggcagccgaatctttccctcagggaacgccgcagccaaccaagaccgccggggctaccgcggaacacgccgcttaatccggcgcaggaaaaaccgactggcggatgttattaacttcctcggggaagaaaacttcatcgacaccaaagtcgtggaccagaacggaaacatccactataaactactcgttaacagcaccgagagcccctacaagctccgagtcaagggactctcaaaaatgctaacgaaacaagaactcgtcatagcattataccacatagtaaaacaccggggaataagttacgacttgggcgacttagaagacgacggaacctccggcgtcacagactacaaaaccagtatcaacataaaccgccaactcctcatcaagaaaaccgtgggccaaatccaactcgaacgacttaaagagttcggaaaagtaagaggacatgttaaaaaggacgaaaacataaccctcctcaacgtattccccagcagcgcatacgtaaaagaagccacccaaatattaacgaaacaacgcgagttctaccccgaaatcactgacgactttatcacaaaattcatacccttcatctcccgaaagagagactactttgtaggccccggaaacgaaaaatctcgcactgactacgggatctacaaaaaggatggccgcactctcgacaacctattcgacgaacttataggcatcgacaagatctcgggggaaaaacgggcatcagcgtcgagcgttaccgctcaaatctacaacatgctcaacgacctcaacaatttaaccgtaaccaacaccgaagacggcaaactgacaacccaaacgaagcgcgagataatcgaggccgataaaaccacaaacggcctcttcggcataacacaaatctgcaaaataatcggctgtaagaaagacgacataaaaggcttccgcatcgataaggtagaaaagcccatcatgcacacactatcaggctaccgcaggttcagaaaagagctcgcgaaaataaacatagaggctaacgacctagatattaacctcgtgaacaagattgctgatatcctcaccctcaataccgaaaaagccgaaatccgaaaacaactaaacaaaagcaatatcgacgtctcaaacgaaatcaaggaactcataatcaacaaaaacaaggacttcctagtcgacggccgagcaacctggcactcattctcgtacaagacacttaacctgctaatacccgaactcatgaacacatccgaggagcaaatcacaatactaaccaggctagggctcgtgaaatctaacagcgaaaagtacaaaggtctcaaaaacatacccgcacgacgtataactgaaggcatctacaaccctgtcgtagccaaggccactagagaagcggtaaacgtattcaacgccatcgcaaagaagatcgggcgcgacaacatctcagacgtcgttatagagctaccccgcgaagacaacgaagctgacattaaaaagggcatcgtcaaacgacagaaacagaatgaactcgaaaaagaagctgcagatgccttggtaaagcaacagatgaccatttccgacagtgccctagtcgcacactaccgaaaagtccgaggtctatcacaaaaagttcgatattggtaccaacaaggaacctgttgtccgtactgcgggaagaacatagaagccgtccagctgatcaacaacaacgactccttcgaggtagaccacatcatcccaataagtgtctcatttgatgacagccagaacaacaaagtcctcgtacactcgcaatgcaatcaagcaaaaggcaagcaaactcccctgggctggttaaacaacgggggcggctttgggcaaaacaaaacagaatacgtcgcgaaggtcaaaaccaacaagaactacagcaagaacaagatggacaatctactgaacgacatggacctctcggacatcgtgacccagcgcggtttcatacagcgcaacctaaacgacaccagatacgcctcgaggatcgtcctagacgagttctactcattcttcaaaagcaacaacctatcaaccaaggtcaagatcgtaagggggaagtggaccagtcaaatgagaaagaaatggaacggggtcggtgggctaaagaaaactagagacacgtaccaccatcacgccatcgacgcctcaatcatagcaagtttcccactcctcaaagtgttcgacaaagccataaaactgatcgacatcgaccgcgaaaccggagaaatactgcaagacaaagaggcaatcaagatgtcccaggaggccaagctcctagagaagatcccggtcatccagaacgagaaattcgaagaactgatcaacgaactctacgacttccccctcttcaaacaagtcgaactcgcaaacgacataaccaatccagaaaacccagtgaagtttagccatcacgtcgacaagaaagccaaccgcagcgtagccaatcagacaatctacggcaccagaatcaaagaaaaagaaataaacaaacgtgggaaagtcgagaaagtacaggagcgctatatcctcggtaccatcaaaaacatatacgatatagacagctttacctccttcaaaaagatatatgacaaaatgagcaagacgggcgacgtaaaatttctaatgcaaaagaaagaccccaagacctggggcaagctcgtagaaatattaaatagttacccagactcagaggagataacacaggtggacggaaaggtcaagcgcgtcaaagtatcaccgttcgaactctacaggcgcgaaaacgacttcataacaaaatacgcaaaacacaacgacggacccaaaatcgtaagcatcaaatactatgacagtaaaataggaagccacatcgacataacacccataaacgccaagaacaaagtagttctacaatcactcaagccctggcggacggacgtgtacttcaacagcgaaacccgacaatacgaactactcggcctaaaatactccgacctcaaattcacaaacggggtctacggaataacctcggaagcgtacgaaaaattgaaacacgggataagcgaggacggaacaaagacctggaaacccatcggcaaaaactccggcttccgattctctctctaccgcaacaacagagtcaaaatagtagacgagaagggcgagtctctggaactactgtttgcctcccgcaccacctccaacgaagggtacgtggaactaaagcccatctacaaatcgaaattcgacagcaaagaagatgtaggattttacggccagatgaccccctccggccagtttgtcaagaaaatggctagagtcgggtacaagctatacaaagtaaacactgacgtactcggcaacccatactacatcaccaaggaatcagacgatcccgaactaagtctgtacaagaaatga

SEQ ID NO: 6349 - RNA, 3528 nt, synthetic construct
  misc_feature 1..3528: note = Cas9 variant
  source 1..3528: mol_type = other RNA
atggaagaaatgaaacaaactgggcgcaagaacgaagccccgaaactaaccgacctcaactaccgaatcgggctagacataggtatagcctccgtaggatgggccgtcctggagaacaacagccatgacgaaccattccgcataattgacctcggcgtgaggatattcgatacggccgaacaacccaaaaccggagcgagcctcgccctaccccgaagagaagcgcggtcagcccggcgacgtataagaagacgacgagacagaatagaacgcatcaaaaagctgttccaagccgaaggactgataaacatagacgagttcgaagcgcggtacaaaatcgcaggactgtcagacgtctacaaactacgatacgagggactagatcgcaaactcacggacgacgaactggcccaagtattgctccacatcgccaaacaccgcggcttcaaatccaccagcaaagccgaggaggcagagaacgagaacgacgcagcgaaaaagaaagaagcaggggcgctaaagaaagggatatcgaacaacaaaaagctcatggaagaaaaaggataccggaccgtcggtgagatgatgtaccttgacgagaacttcagaacggactgcccatggaacgaaaacggatacatcctgacgccccgaaataagtcaggtgactacaaacacaccgtcctccgcgacatgctggtggacgaagtcagggaaatattcaagagtcagcgatcactaggaaacatccacgcgagcgaagagttagaaaacgcctacctcgacatcatgctcagccaaaggtccttcgacatgggcccaggggcgcctagcaaatacgccatggagggcttcgaggaccgagtagggctttgcacctttgaaggcaaaaacggcgagaaaagagcagcgaaagccgcgtacacctccgaactgttcgtcgcactcgagaaaatcaaccacacgaaaatcgtgtcagatgacggcgccacccgattcctaaccacctacgaaagaaaatccatcattgaattaatgcacaaacaacaaactgtaaaatacgcggcggtcaggaaggcgataggactagcagaagaagacaaattctacaatcttaactacagcccgaaagccggaagcaagaaaagccccgaagacacagactttgtaaaactcgaaaattaccacaaaatacgaaaagcactgggggaagacatagtgtcggaacacctccccgccgaaaagataaaactatacgacagcatagcgacgatcctaacattgttcaaaaatgatgactcacggatcaagcggttcatcgaactaggcattggcgaagaatgcttcgacggactactctcgctctcccccagtaaattccacaacctcagtctcgttgccatgggtaaaatcataccattcctgctagacggaaacacatacgacaaagcatgcgaactagccggctacgacttcaaagcagacaacaagggggagaaaagcgtcctcctcaaaggtaaaaatatcacagacatggtaaacgacataacaaaccccgtagtaaggcgcagcgtatcacaaacgataaaggtcatcaacgcaatcatcctggaatacggaagccctcaggcggtgaacatcgaactcgcccgcgaaatgagtaaaaacttcgacgaacggcgcaaacttaaaagcgacatggaaagcagagaaaaggaaaacaacaacgtgataaaacgagtcaaagaatacaagctgaaccccacaggccaagacatcgtaaagttcagactgtgggaggaacaagacaggcgttgcctgtacagtggagagaaaatcgacatcaacgacttattttctcgagacggaggctacgacgtagatcacatactcccctactccatcacgttcgacgacacctaccgcaacaaggtgctcgtgaaagcctccgaaaaccgacagaaggggaataggacaccgtacgaatacttcatggccgaaaaagacgacgacgaatggaacgtgtacgaaacgctggtgcgtaatacagtcaaggactacaagaaagttctcaaactactcaagaagcacatcaccgaagacgagaagtcggaatttcgcgagcggaatcttaccgacacaaaatatataacgcgtataatctacaacatgattagacagaacctagtcctcaagccatacctaagcctggagaaggaaaggaagaagcaagtaatggctgtgaatggcagcatcacccactacctatccaaacgttggggcctagagagcaaagataggagaaccgacacgcaccacgcgcaggacgccgtggtaatagcctgcaccaccgacggcatgatcaacaaaatctcgcgctactcaaaggggcgagaactactatacagcaggggtttcaaattcgtagacgaggagacgggagaaatactctctcgggacaacttcaccagagaggaatgggatgaaaagtacggagtaaagatacccataccatgggagcacttccgagacgaactcgacatacgtatgagccgatacaatggcactggcgacgactccatagataaaacgacaccgcgggactttatactcagccaccgagacgcccacaagtggatcaactatccagagtggatgttcgtggagggacgaccagggagacgcggtgtcctagacggcatcttcgtcagccgcatgccaaagcacaaagtcagcggacaagcgcacgaagaaacggtacggagcgccaaatattacaacgatggagggagcgtatttgagagcggcggatatgtcgtcacgaagaaaagcatccaagacataaaactcaaagacggagagataaaagagttcttcaacccagatagtgaccggctcctctacaacgccctagtggacagactcaacaaattcgagaatgacccaaagaaggcattcgcggagccattctacaagccgaaggcagatggaacacaaggaccgatcgtaaagaagataaaagtcttcgagaaacaatcatcaggggtattcgtccgagatggaaagggtatcgccgccaatggggctatggtaaggattgacgtattctgcgaagaggataagggcaaaaagaagtactacttcgtgccaatctacaccgcggacgtagttaagaagaaactgcccgacagggccgcgacggcaaacaaactcatatccgagtggcgagtgatgaaagaggagaacttcatattcagcctatactccagagacctgatctacatcgaaagcgacaagggcgtccaggtcaaggacatagacggaaagataagtaaacctgtgaacctgtttgcctactacctgggggcagacaccagcaccgcatcgatcagcggaaagctacacgactccagcgccaacttcagatcaataggcatacaaggtctacgcaggttcgacaagtgccaagtagacgttctcggcaacatcagcttcgtgaacaaagagaaaagaatgccatttaactga

SEQ ID NO: 6350 - RNA, 3531 nt, synthetic construct
  misc_feature 1..3531: note = Cas9 variant
  source 1..3531: mol_type = other RNA
atgaacaaggtccaagaagactgctacaagaaaatcaaggaaaaactggcagacagggagtaccgcattggcctcgacctcggcgtcgggtcaatcgggtacgccgtagtatcactcaaaggtgacatgcctgaagatgttatcctagcgggctcacgcatattcaaatcgagcatcggcgcggccgaacgccgacacttccgcgcccaacgcaacactcaccgacaccaccgagagcgaatgcggtacctctggaagctactcgcggagaaaaacctggcactacaactccccgaaaacctctccaagaaagaaaactttacagacttcgataccagccgaaaacgctttcccatagaagtcctccgaaacgacccctatatcctaagatataaggctttagacgaaaagctatcacttttccaactgggctacgccctgtaccacatcgcgaaccacagagggaccgccagcgtccgttcattcctcgaagacgatgaggcaaaagtaaaagagaacaaggaaaccgcaaaactagccaagaacacaaagaagatcatgtacgagaagaaataccgaacattcggagaatacctatatcgtgagcgcatagaaaaattcaggcaaaacgaacgaatgaaagtaaccaacaaaaatgaaaacaaagagttcgctgtaactagagacatcatcgaaaaagaagtagaaatgatactcggtgcccaaaaacgctacaacaccgctgtcctagccgatgactacatagagcgcatcaagaaagccatcttttacgagaccgaaaaacttatccccgaacctgaatactgcccctatttcaaagacgacaagagactaccccgctcccacaaactgaacgagtaccggcgcatatatgaagctcttaataacaccagatactacatcccggagatagaagagaaaaccggcgaaatcctgagtaggaaggagaaggaacagctgagcaaagaggagaaagagaaactcttcaacttcctcctcaaaaacaaagaactcaccgaagcaaaagtcaagaaattgctaaacctgagcgaaatggccaaggtccaactacagggccgcgacaagaaaaatcagaaaatcaaaggatacgcactaattaccctagaaagcctacctttctggtccaaactacccgagcaacaacaagacgagttcctctatgactggaacaagctccccgacgaaaaactaaaagaccgcctgcgcaactactacaagctgacggacgacgaaatcgatgaaaccttccaaaacatcgtactcccgagcaactacgcacccctaggaaagaaggccatggaaattctcctagaatacatcaaaaacggcctcagctacatagaggcactagacaaagcagccgacgaaaacaaaatcaaagtagagaagcacgaaatcaacgacctactaccctactatggtaaaatcctccaagagtcaacacagatgccaatcggcaaggccttcagcaagcagttcgccgccaaaaactacaagaaaccagacattaacaaaaacgaacaagagttcggacgaatagccaacccagtagtccaccaaaccctgaacgaactgcgaaaactcataaacgaaatcataaccgtcttcggaaagaagcctcttgaaatcagcctggaaaccagccgcgaactcaagaaatcacaaaaagaacgtgaactcatcgccaagcagcaggacatagacgaggaaaaacgcaagaaaatctggaagacatacatcgaaccgcacctacaacaaataaaatcccgctcagacaagctcaagaaactatttgtattcgagctgtgggaggaccagaaacacaattgccccttctgtctcgagaaaatcaatgtagacgacatctactcccgcggagtagacaaggaacacctcttccccctaaagaaaagcgaagacgactcagaaaataacctcgtgatcgcgcacaacaaatgcaacgcaagaaaggctgaacgcgccccctttgacgcctttggccatgaaagcatatggaacgacatcttctcgaacgccgagaaaaaccttcccagaaaactctggcgattccgacaggggtctttcgaaaaattcctagaaaaaccgcccatgctcaaacgcttcgaaaccgacaactcctacatcagcaaaatcagcgcacgctacctggcctgcctctttgacaaaccctccaagatattctgcgtcaaacccttcctcaccgcccaactacgcatcgcctggcagctcgacgagatcatgatccgtctagccgagaacatcatcctcgactccgaaaaagactcattcaacaaaggtggcctccaaaagaagaaaagaatcgacaaccgccatcacgccttagacgcggtcgtaatcgcttatgctagccgcggctaccacaacttcctaaatcgagtccacgcaaaaggatacaaaatcaactacgacgagaaaacctggctgtcggaaacacttcgaccgcccggcaacaaaaaccttgaggacttcaaaagcggcatcatcaacgtcatgataaacgccaacatctccataaaacacgaccataataacaaagggcagctagtcaaatcgaaggcgtacaaattatactacagcgaaatcggtaagtacatcatcaccaccctcaagagcgtgtccgaaatactatttaagcaaaaggagaaaccccaagacacactccgccgcgccctgtgcaaattcgaggatcggctatccgacatcaaagacaagaaactacgaaagaagctggaagacaacataacaatctataagtcaattgaaaacgaatcggctctctcgaaagccaaacaagaacttgaagaatttgacctcaaagcaaagaaggaaggtaagaagggctacgagaaaataactgacatcctcatttacaagaaggcatgctccatgcatggcggaaaatacattcacgtcaaaaaccgcatcgagaacaaattcttcgcattgaaagagcccacagaaatagagacaggattcggctacgataccgcagacaatctcagcctagacctgtaccacgacaacaacgggaaactatgcggcgaagtcatccgcaagatcgacttcaaccgcaaccgagtaccaaattacaagaaagagggctacatccttctcgagcgaatctaccagggcgacacgctggaagtcgatatcagcgacgacaaaatatcactgaaaaacaaggtcggcagcgcacccgacaaacgaaccttcgtcaaggtcctcacctttaccgaaagcgacagatatctcaaaaacaaacgcgaccaaatccaaatattcttctgcaacctactaaagtcaaccctcaaacatgacgactcatcaaagcacgatgacagcttctacgtctcctccatgcagaaatataacgtccgtaaagtcatcctcacctcgctcggcatcatcaagtaccgctctaagatactcaaaaataaagaaatctga

SEQ ID NO: 6351 - RNA, 3531 nt, synthetic construct
  misc_feature 1..3531: note = Cas9 variant
  source 1..3531: mol_type = other RNA
atgctgttccctaagaaactttctaaagaagaggtcgcatacgtccttgtcgaaataaactcaaacctcaacaacagcagcaactacctgggcaacatcagcgaccgttcgaaagaattatacttcaacaaacagaccatcggacagttcctctacacaaaactgaaagaagaccgccactacagcctcaaaaacaaagtgttctaccgacaagactacctggacgaatttgagcgaatctgggaaacacaagccattttccacaaagaactgaccgaagacctcaagaaacagatccgagacacgataatcttttaccaaaggcgactcaaaagccaaaaggggctcatctctctctgcgagttcgagaacaaagagattaccatcgagaaggaaggtaagaccgtcaccaaacaaatcggtgtccgcgtcatccccaaatcttccccactattccaagagttcaaaatctggcaaatcctaaacaacgtcatttgtaagaagaaaggcacgcgcaaaaagaaagcagtcaccccagcacccctcctattcgaacttttcggcaccccatccgagacctttttcagtctcgacatggaatgcaaacagctgctattcgaagaactcaacctcaaaggcaacctgaaagcagacaaggtcatcaggctcctcggctacatcccccaagagtgggagatcaactacaaccaactagagggcaaccgcacgcaaaagagcttatacgaggcctacctcaaaatcatcgaaattgaaggatacgacatcaaaacgttcctacgcatcaagtcggacaaagaggactgggacctagaagaatcgcccctatccgccaaagagatccgtgaaaacatccaacatatattcgagacactcggcatttccacggccatactctatttcgacgcgacgctcccgatcaaagactttgaaaagcaagcgtcttaccagctctggcatctactatactcgtacgaaagcgacaacagcccctccggcaacgaaacactatacaaactccttcaggacaaattcggcttcaaacgcgagcacgcggtgttcttatccaacatctcattccaagatgattacggctccctatccgccaaagcgatacgcaaaatatacccatatatcaaagaaaatcaatactccacagcctgcgagctcgctgggtacagacactcgaaactctcactcacaaaggaggaactcaacaatcgccccctcaaggatctcatatccccactaaagaagaacagcctccgaaaccccgtcgtcgagaaggggctgaaccaaatgatcaacgtggtcaacgccctcatagagaaaaacagcgaaaaagacgccgaaggcaacatcataaagtacttccacttcgacgaaatcagaatcgagctcgcacgggaactcaaaaagaacgcccaggagcgagcagaaatgacgctaaacatcaaaaatgcaacaatcgaacaggaaaagatcaaaagcatcctcatatccgacttcggcatcaaaaacccaaccaaaaacgacatcacgcgatacaggttataccaagaacttgcacacaacgactacaaagacctctacacaaacactgacatcccaaaagagctcctattttcaaagaacatcgacatcgagcacatagtcccgaaggcccgcgtctttgacgactcattcagcaacaaaaccctcgcctaccgcgacttcaaccttaagaagggagaaaacaccgcattcgacttcatcgactcctcgctcggcgaagaggaactcaatcaatacatagccagggttgaaaacgccttcaaaaccaaaaatatctcggcaaccaagtaccgcaatctcctgaagaaagcgaccgaaatcaacgatggattcatcaaccgcgacctccgagaaacccaatacatcgcaaagaaagctaaagacctactatttcaaataacaagaagcgtcgtctcaacgagtggcagcataaccgacagactacgcgaagactggggcctgatcgacataatgaaagagctaaacatgccaaaataccgtgacctcggtctcacagagatcatcgaacgtcgcgacggaaggaaggtagaagtgatcaaagattggaccaaacggaacgaccaccgccaccacgcaatggacgccctcactgtagcattcacaaagcccagttacatccagtacctaaaccatcttaacgcacgcaaagacgagaacaacaagctctacgcagacatccttggcattgaaagaaaggagacaaccaagatacacgacgaaaacggaaacgagaaacgcgtatttatcgagccgatacccggctttcgccaaatcgccaaaaagtacctcgaggagatcctgatctcgcacaaaacaaagaacaaggtcgtcactaaatcaatcaacaagatcgctgggacgaacaagaaacaagaaacactaacgccacgcggccagctccacaaagaaactatatacggcaaataccactactacagtaacaaagaagagaaaatagggaccaagttcgacaaagaaaccatcagtaaagtgtccaaccccatctacagatacgccctccagaaacgactagaagccaacgaaaacaacccgaagaaagccttcacggggaaaaacgccttaagtaaaaacccaatctacctagacgacgcaaaaacaaagatcctccccgaaaaagtgaatctgatctacctggaagaagacttcagcatacgcaagaaaatcgtcagcgaaaacccgacttcaaaagaatttgtaccaaactcaatctcaatagagaaaatcgtcgatgaaggaataaagcggatccttaaagaacgcctggaaacctacaacaacgatcccaagaaagccttcgctgaccttgacaaaaatccgatatggctgaacaaagaaaaaggaatcagcattaagcgcgtgacaatttccggcgtaaagaatacacaagctctgcactcgaagaaagaccacctcggaaaaccaatccttgacaaagaaggacaagaaatccccgtcgatttcgtatccacaggcaataaccaccacgtcgctatctacagagatcagaaaggtaacctacaggagcagatcgtctctttcttcgaggcagtagtgcgcgcacaacaaggattgcccataatagacaaaacatacaaacaagaggaaggctggcaattcctcttcaccatgaaacaaaacgaaatgttcgtcttcccgaacgaaatcaccgggtttaacccttcagaaatcgatctgctagaccccaaaaacaagaaactaataagcccaaatctcttccgcgtccagaaaatatccattaaagactactttttccgccaccacctagaaacaaacgtcgaaacaaacaacatccttaaagacataacctggaaacgaggagggctgtccctgctcaaaggcatcataaaagtccgtatcaaccacctcggaaacatagtctccataggcgagtactga

SEQ ID NO: 6352 - RNA, 3534 nt, synthetic construct
  misc_feature 1..3534: note = Cas9 variant
  source 1..3534: mol_type = other RNA
atgaacaaagtccaagagatcgaatataagaaaatcaaagagaaacttgcagaccgagagtaccggataggactagacctcggagtcgggtcaatcggctacgccgtcgtaagcctgaagaaatacgacgacctctcatacttgccggaagacataatcctagcaggctcgcgcatattcgcctcgagcatcggggcggtcgaacgccgagaatttaggcttcagcggaactcacaccgccaccggcgggaacgcatgcgattcctatggaaactcctagccgagaaacaattagccctgcaaccgagcaaagacctggagaagaaagaaaattcagcagactgcgaaacctcccaaaaacggttcccgatcaacatactcaaaaacgatccatacatactgagatacaaagccctcgacgaaaaactgagcctctttcaactcggatatgtcctataccacgtagctaaccaccgaggaactgacagcatccgctcgttcctcgaggacaccgacgacaaaataaaagagaacaccaaaacagccaaacttgccaccgagaccaagaaaatcatcgactccaagaaataccgcacctttggggagtacctgtacaaagaacgcatccaacaaaacgagagaaagaaagtctccaaccggaaaaccgccggcaacaaaaacaaagagttcgcagtcactagagacatgatctttaaagaaaccgagaaaatcctagcctcacaaaagcaatactacacgaacgtactaacagacgaatatataaaggaaatagaaggagccatattctaccagaccgaaaagctcatccccgagtccggctactgcccgtacttcaaggacgaaaaacgtctcccatgctcacacaagctaaacgaataccgccggatatacgaggccttgaacaacgcacggtacagcgcacccgtactcgacgaaaagacgggcgaaatccttagctaccaagaaggagaagagttcagtagcgaagaaaagaaaatcctattcgacgaagtactgctaaagggcaagaaactcacagaaagcgagatcaagaaactcctccacctacccgacggatgcgaaatacaactccaaggacgagacaaacgcactcagaaaatcaaaggctacgcgcttaccgccctagaagccctcccattctggtcaaaactctcgcaacaacaacaggacgagttcctgtacgattggaacgggctacccgaagaaaaactcaagccaaagttgatagactgctactcgctaaccgaaaacgaagtcgacgagacattccagaaaatccgcctccccagcaattacgccccagtcggaaagaaagccatggaaatactcctgacatacatcaaagacggttatagctacactgaagcactggacaaggccgtctcagaaggcaaattcaaagtcgataagcaaactacaatttacgacagcctcccatactacggaaaaatactccaagaatccacccaaaaactaatcggcaaagccttcagcaaacaattcgccaagcgcaactataagaaaccaaacaccaacagaaacgaacgagagttcggaaagatcgccaaccccgttgtccaccaatctttaaacgaacttcgcaaactgatcaacgaaataataacggtctttggcaagaaacccctcgaaatcgggttagagaccgccagagaactcaagaaatcatccaaagacagagagagcctagtaaaacaacaaaacgaaaacgaatacaaccgaaacaaaatatataaagactacgtcgaacctcacctatcccaaatcaaaagcagacaagaaaacccatccagatatatcttcaaattcgaactcttcgaggaacaaaaatcaatctgccccttctgcctaaaagagattacgcctgacgacattatcaactcaaaagttgacatcgaacacatctttccaattgaggaatccgaagacgacgccaaaaacaacctcgttatagcacacaacgagtgcaacgcagacaagggcaaaaagtcccccttcgacgccttcggagacaagacatcgggcaagtacgtgtggaatgacatcctacacaacgccaagaaaaacttgccacacaaaatctggcgcttctaccaaggaagcctggaaaaattcctcgaaaacaaaccaatgctgaagcgcttcggcacggacaactcatacatttccaaaatcgcggctaaatacctagcgtgcctcttcaacaacagttcaaagatcttctgtatcaaatcctcgctgacagctcaactccgcatcgcatgggagctcaattcaatcatgatcccccttgcaaagaacatcctatcggagaaagagctcgaggagttcaagaccctcaaaaacaagaaaatcagaatggacaaccgccaccatgccctagacgctatcaccatcgcctacgccaaccgaggatatcacaacttcctaaacaaaatacacgcaaaaggatacaagatcgactacagagagaaaaactggctcagcaagatactgctcccacccctcaacagagatctcgaagacttcaaaatctccgtgaaaaactccatagaaaaagcgaacgtatccatcaaacacgaccacaagacaaacggatcgctagtcaaagggaccgcatacaaggtgtactactcaggcaccggtaaatacataatcaccaccctcaaaaacgtcgaagaaatatcattcaaagaaaaggaagaccccgaagacacactacgtagggcgctatgtggctttgaagactccaacatcaaagacgaaaaactcatcaagaaactcaaatataactccgacctctataagaaaatcctcaatacaaaacccaaagccaagcaagaactcgaacaggcaaaccaggaaaccaaagaagaaggcaaaaagacccagaaaatcaccgacgtcctaatctacaagaaagcctgctcactggtaggcgaacaatacatccaatgcgcatcgcgactagagaacaaatttttcgcagtgaaagaacccacggaaatcagaacaggcataggctacgacaccggagacaacctatttctcgacctatactacgataaaacacgtaaactatgcggcgagataatacgcaagatcgacttcaaccaaaacaaaatacccaactaccaaaaagaagggtacatcctcttcgaacgcatctaccagggcgacacccttgaagcggacacctcggaagacaaaataagcctcaaaaacaaaacaggcagcgccctagacaatagaacattcgtcaaagtactcacgttcacagagagcgataagtacttcgacggaaagaaagacaaaatacaaattttcttcggcaacctcttaaaatccaactacaaacaggacgactcattctacatatcctcgatgcagaaatacaacgtgaggaaagtgattcttacctccctaggtatcatcaagtaccgaagccaaatacttaaaaacaaagaagtctga

SEQ ID NO: 6353 - RNA, 3540 nt, synthetic construct
  misc_feature 1..3540: note = Cas9 variant
  source 1..3540: mol_type = other RNA
atgtccaagaaagtaagccgacgctacgaggaacaagcgcaagaaatctgccaacgactcggatcacgaccgtactccataggcttagacctcggagtgggaagcatcggagtagccgtcgcagcctacgaccccatcaagaaacagccgtccgaccttgtcttcgtctccagtcgtatctttataccatccacgggcgccgccgaacgacgccagaaaagagggcagaggaacagcctccgacacagagcgaaccgcctcaagttcctgtggaaactactagccgaaaggaacctgatgctatcctattctgagcaggacgtccccgatcccgcccgactccgattcgaagacgcagtcgtgcgtgcgaacccatacgaacttagactcaagggcctcaacgaacaacttaccctgagtgagctaggctacgccctctaccacatagcgaaccaccggggctccagcagcgtacgcactttcctcgacgaggaaaagtcctccgatgacaaaaagctcgaagaacaacaagcaatgactgaacaactggcaaaggaaaagggcataagtaccttcatagaagtgctcacagcgtttaacacaaacggactaataggttaccgcaacagcgaatcagtaaaaagcaaaggggtgcctgtacccacacgcgacataatcagcaacgagatcgacgtactgctccagacgcaaaaacaattctatcaagaaatactgagcgacgaatactgtgatcgcatcgtttccgccatcctcttcgagaatgagaaaatagtgcccgaggcaggctgctgcccatatttccccgacgagaaaaagctccctcgctgccacttcctgaatgaagaaaggcggctatgggaagcgatcaacaacgcgagaataaaaatgcccatgcaggaaggcgccgcaaaacgataccaaagcgcatccttctcagacgaacaacgacatatactcttccacatcgcgaggtccggaacagacataacacccaaacttgtccaaaaggaatttccggcacttaaaaccagcatcatagtgctccaaggtaaggaaaaagccatccaaaagatcgcgggcttcagattccgtcgcttagaagagaaatcattctggaaacgcctaagcgaggagcagaaggacgactttttcagcgcgtggacgaacacaccagacgacaaacgtctgtcaaaatacctaatgaaacacctcctcctcaccgaaaacgaagtcgtcgacgcgctgaagaccgtcagccttatcggagattacgggccaatcggaaaaacggcaacgcaactactcatgaaacatctcgaagacggccttacctacacggaggccctcgaaagaggcatggagaccggagagttccaggaactatcagtatgggaacaacaaagcctactgccatactacggccaaatacttaccggatcgacacaagccttaatgggaaaatactggcactcagcatttaaagaaaagcgcgactccgaaggcttcttcaaacccaacacaaacagcgacgaggaaaaatacggccgtattgcaaaccccgttgtacaccagaccctgaacgaactccggaaacttatgaacgaactgataaccatcctaggcgcaaaacctcaggagattacggtagagctggcgcgcgaactaaaagtcggcgcggaaaaacgggaagacatcattaaacaacaaaccaaacaggagaaggaagctgtgctagcatactcaaagtactgcgagccaaataatctagacaagcgttacatagaaaggttcaggctcctcgaagaccaagcctttgtctgcccctactgcctcgaacacattagcgtcgccgacatcgcggctggtagagcagacgtagaccacatattcccgagggacgacacggcagataactcatacggaaacaaagtcgtcgcccaccgacagtgcaatgacatcaaaggaaaaagaacgccctatgctgcattctcgaacaccagcgcgtggggccccatcatgcactacctcgacgagacacccggaatgtggaggaagcggcgtaagttcgaaaccaacgaagaggagtacgccaaatacctacaatcaaaagggttcgttagccgcttcgaatccgacaattcgtacatcgcgaaagccgccaaagaatacctacggtgcctcttcaacccaaacaacgttaccgccgtcggcagcctcaaaggtatggagacatccatcctccgcaaagcatggaacctccagggaatcgatgacctcctgggatcaagacactggtcaaaagacgccgacacatccccgacaatgcggaaaaaccgagatgacaaccggcaccacggtctagacgccattgtagcgctatactgctcacgcagcctcgtgcaaatgatcaacacgatgagcgaacaaggcaaaagagcagtcgaaatcgaagcaatgatccccatcccgggctacgcctcagaacccaacctatccttcgaggcccaacgcgaacttttccgcaagaaaatcctcgagttcatggaccttcacgcattcgtctccatgaaaaccgacaacgacgccaacggagcactgttaaaagacacggtctacagtatactaggagccgacacacaaggcgaagacctagtattcgtagtgaaaaagaaaatcaaagacataggagtcaaaatcggagactatgaagaagttgcaagcgccatccgaggcagaatcacggataaacaacccaaatggtacccaatggaaatgaaagacaaaattgaacaactacaaagcaaaaacgaggcagcgctccaaaaatacaaagaaagcctagtacaagctgcagcagtactggaagaatcaaaccgaaagctgatagagagcggcaagaaaccgatccagctatcggagaaaacaatctcaaagaaagcgctagagctcgtaggcggatactactacctaatttccaacaacaaacggaccaaaacgttcgtagtaaaagaaccatcaaacgaagtaaaaggattcgccttcgacactggctcgaacttatgtctagacttctaccatgacgcgcaaggtaaactatgcggagaaatcatccgcaaaatacaagccatgaacccatcatataaaccggcgtatatgaaacaaggctactcgttatacgtgcgcctctaccaaggagacgtatgcgaactacgggcctcggacctgacagaggcagaaagcaacctggccaaaaccacacacgtccgcctccctaacgccaagccaggccgcacatttgtaatcatcataacattcaccgaaatgggatccggctaccagatttacttcagtaacctcgcaaagagcaaaaagggccaagacacctcattcaccctcacgacgataaagaattacgacgtccgaaaagtgcaactatcctccgcaggcctcgtccgctacgtgagcccactactcgtagataaaatagaaaaagacgaagtggcactctgcggcgaatga

SEQ ID NO: 6354 - RNA, 3567 nt, synthetic construct
  misc_feature 1..3567: note = Cas9 variant
  source 1..3567: mol_type = other RNA
atgaaatacatactgggtctagacatcggcgtcagcagcgtcggaatagccgtgatctccgaagagaaccagaaaaagacaatagaaaacctcgccgttcgaatcgtccccgaggaccccgatttccacgggaaattctacagcggcaacactgcaagcaaaaacctggagcgcacagccaagcgagggaacagaaagaacaaccaacgtttcaaagcccgaagagacaaattataccagtcattaaaagagaacaacatgttccccacctccaacctgttcgacctctcggcagtagaactatacgggttgcgggccaaagctgtcagcgaacaagtgtcccttcaagaattagggcgcatcctcatactcctgaaccaacgccgaggattcctatccaatcgaaagtcagtctccgaagaaaacagtaccgaatacaaggaaaggatcgccggcctcgaaaaagcactcggcaacaaaaccatcggccaaaaactatacagcgaactccaagaaaacaacaacgtttttgaagtactactcagggaaagaacctaccagcgcagctcatatacggaagagttcgacagaatctgggacgaacagaagaaatactacctgatcctaaccggcagctcaaacgaagacgacaacaaaggcaccctctacgacctaataagaaaccgaattatctactaccaacgacccctcaagagccaaaaaggcctaatctccgaatgcctgttcgaaaaacaccacaaagcagtcgcaaaaagctcgccatacttcgaactcttccgaatctggcagaaaataaacgacctatcctggaagacacccaatggggaactgtttaaacccaccgatgaacaaaaacaaaaacttaaaaacgcgctctggaacggcgacaacctcaacccaaagcacaaactcaccgtatcgaagatcaaggagatattaggctacacctcgcgggagaaaatatacctcaacttcaccgagctcgacgggtcccgcacctactcaatcctcagaaacgcgctcatcgaagcagggatcgagaaacccgaacaatatctcttcttcaacatggaaaccaacgatgaaaagggcggactcttcgagctttggcacataacctattcactcccgatcgaaaaggaagtcattaacgcactgaagaacaggttcggcttcgacaaaaagcaagcagaaataatcgcccggagagtcgggtactcgtccgactacggctcactaagcacccgtgcaatcagaaaactcctcgttcatctggagaaaggcttgggctacaccgacgcatgcgacaacatcggctatgaccacagtggatacaaaaccaaaatcgacctgcaacccaaactgaagcaactaaaacgaaacgaactacgcaatcccgtcgtcgagcagatcctgaaccaagtcgtcaacgcggtcaacctaattatcgagaagtacggcaaaatcgacgagatacgggtggaactcgcccgcgagctacgaaacaacgccaagacccgaaagaatatcagcctactaaactcgaagaacaagaagaacaacgatatcatccgaaagaaactacaagaagagtacgggttcaaatttgtcaacgggcgggacgtaactcgctatatcttgtgggaggaaaacagcaaggaatgcctttactgcaacaaaacaatcaacgggtcggacatgctcaccgggaacgccgacatcgagcacatcctccccaaatcccgcagcttcaataacgccatgaacaactacatcataacccaccgtaaatgcaatagcgataaaggccaaaagaccgcgtacgacttcatgagctccaaaggcgaggtaattctgcaacagtacatagaaaaggtcaacgatctctataaagacggaaaaggaagcatcagcaagaccaagttcgagaatctcctctgcaaaggggaggacatcccctcagacttcgtggaacggatgaagaaagactcacaatacatagctaaagaagcagtgaaaatgctaaaaacggtctgcccaaacgtctacaccacgaccggccaagtcacggactttcttcgcgaagaatggaagctcaaaaacctgcttcaagagctcacattcgagaaatacaaagccattggtcaagtgaaagagaagatcatcaagaccaacaacgggcagacaaaaacatttaaggtcatagcagactggtcaaaaagagatgaccaccgccaccatgccatagatgcactcatctgcgcactaaccgaccagaagataatatttaaactcaacaacctaaataaaatataccaatacgagcggaacgcactctcccaaaaagaaattgaagaaatcgaagagttcctcgaaggaaaattcagcatcaaagagttctccgcccaacagggaaatatcatcgaatgctccatacctaacatccgcaaagacgcgcagaaacacctagaaaacatcctcatatccttcaagaaagaaaacagcaaagtactcacaatgaaccgtaaccagcccaaaaactgcaaagaacaaatcacctgggtgccccgagcccgactacacgaagacacaatcatgggacgagtcaaacgcattccggaaaagaaaatgaaactgaacgacaaagtatccttcgaacaaataaagatgatcgtaaacccggaaatcaaggaaatactcctatacaggctagcgaaattcggcgataaccccaaggtggcattcgccacaaaagcactcaagaaagaaccaatcttctacagggaaaacgaacttaaagaagtatcgatctacgagtgggttaacaccaaacgagtcgcgctaaacgaaaacatcacggactcacagatcgagaaaataatagaccaggcctccaaacgagccgttaaagaacgtctcaacggcggcaaaatcaaagaggtcttcaaaaacctaaccgagaacccaatccaactgaaaaacggcatgatcctaaagaacgtcacagtaacagatgaatcaaaagtcgaaaagataagaaatggcttcgctatcacaggcaaaaatcatcacgccctcgtgtacaaggacgagaacggaaagtacaacgacaaggtggtcagcttctgggaagctgtagccatcggcctcagaaacgttactgaatatggcaacccctatcctataatcaaccgaaaccacaacgacgaactaggtgagttctacttctcaatgcaaattaacgacctcttcgtattcgacctaaaacactcggaaaacccacaagaagaaaacgagatcaactttttcgacgtggaaaaccggaagcagatctccgacaaactatttcgtgtccaaaagatgtcgaagaaaagcaacggacaattcgtatcagacttccgacaccacctagagaccagcgtcataaggaacgacatgatactcaaaaacatcacgtggatctcaatctcgaaaaacagcgacctagaacggctaacaaagataagagtaaaccacctgggcgaaatcatcaaggtgggagaatga

SEQ ID NO: 6355 - RNA, 3585 nt, synthetic construct
  misc_feature 1..3585: note = Cas9 variant
  source 1..3585: mol_type = other RNA
atggatttcacggccgacgtatccgagctcaacgagagcttcatgcaaatacacacagaatcgaagttcgaaatcgacacagctaaggttcaagaaatatcgcaactactcctcgacaacaagataacacgcatggacagacaaaagcaagtcgcaaacgtgctggccaaaaattccggcgataaggaagcggataaaatcaacaagaaaatagccacagagttctgcaaagctgtgcttggaaacaaagctaaattcaacgtgatcctaggggaagatgcggtggacagcgactggagcttcaaaatggacgacgaaaactcggacgaggaaatcgagattctcatgggccaaacgaacggtcaacaacaaaacgtgctccgcataatacaccagtggtactcccagataacactcaatggcatcgtaccagacggacagatgattagcgaatccatgatcgataagtacgaactacacaggaaacacctccttctccttaaacaacagataaaggtcaccaaagacaaaaagaaagcccaacaacttcacgaggcatacgaacagtacgtccacggaaccggcgccaaaaagaaactcactcaggacgacttctattccaaggtcaccaagaatttagaaacctcagacttctcagacgaaatcaagaaacaaatcaacgcagagacattcatgcccaaacagcgtaccagcgccaacggcgtcatcccccaccagctgcaccaacaagagctcgacaaaatcatagaaaaacaagcaaaatactatcccttccttgccgaactcaatcccgacaccaaacgccaaaacattgccaagtacaaactcgacgagctgatagccttcaaaatcccctactacgtcgggccgctcataacaacggaggatcaaaagaagacatctggcaagagcttcgcctggatggtacggaaagagcctggcaaaatcacaccatggaacttcgaccagaaagtcgacaaaatggccagcgcggaccagttcatacgccgcatgaccaccaaagactcctacctgatcaccgaggacgtcttacccgccgagtcgctcatctaccagaaatacaaggtcctgaacgaactgaacatgatccgagtcaacggcaacaaattaacaaagcacgataaacaaaacatataccaacaagtcttcgagaaatacaaaacagtcaatgtaaagaaagtgcaaaactacttcctgaccgacggacgataccagcacgcgccaaaaatcaccggcctaagcgacgacaataagttcaacagcaatctcagtacgtatatagacttcaaaaagattttccaagacgtagtcgacgacccccaaaaacaaaaagacttcgagcgaatcatagaatggtcaactatctttgaagaccggcacatatatgaagtcaaactcaaagaaataagctggcttaacgatgaacagcgcaaagaactcaagaagaaacgccaccaaggttggggcagactctctgccaaactactaacagggatcttcgacgagaacggctacagcataatggatcaactctggaacacacagaaaaacttcatgcaaatccaagcggaagaaggcttcaacaagaaaatccaggccgagaacagcaaacacctagagaaaaacgacttcgaagacatcctagaagacgcctacacctcacctcagaacaagaaagccatccgacaagtcatcaaagtagtggaagatatccagaaaacgatgggtaccgcaccccaaaagataagcatagagttcacgcgatccgctgacaaaaacccccgccgaagcatcgagcgccagcggcagctcgaggagatctactacaacgacgcaaaagagatcgtatctgagggcatgcaagacaacctccaaaacttcactgataacaaacaaacgctaaccgacaaatatttcctctactttacccaactcggcatcgacatgtacaccggaaagaagataaacatcgacgaaatagggaactaccagatcgaccacatactcccccaggcattcatcaaggacgattccatcgacaacaaagtactggtatcctcggccatcaacaacggcaaatccgacaacgtccccctctccatgtacgcaagcgtacgcataaaaagcgaagtccaaaacaaatggaagaacttcgcggaacacggactgatctcacagcggaaactcaacaacctcatgacagaccccgaaagcatagacaagtacaaggcgcgaggtttcatcaagcgccaactcgtagaaacgagtcaggtcatacgactggtggcagagatcctcaacgaaaaataccaaggggaaaccgagataatagaagttcgcgcaaagatgaactcccaactccgcaaggacttcgacctcctgaaaaaccgcaacgtaaacgattaccatcacgctctcgacgcctacttaaccaccttcataggaaattacctctaccggcgctacccgaaactccgcagctacttcacatacggacacttcaagaaaatagacgacgccaagttaaaacagttcaacttcctccacgacatagaaaacgacaaggacccgaaatacgtcaacgacaatggagaactactatgggaccgagagaaagacatagcctatttcaagaaaatctacaacttcaaatatatgctggtcagccacgaagtttctacgcgacagggggcgatgttcaaacagaccatcttccccgcggcagccgacgcaaaaagtaagctgataccaatcaaaaacgataagcctaccgcgatatacggcggctacacgaacaacaacgacgcctatctcgcaataatcaaactagccaaaacaggacaattcaaagtggtcggcgtcccacaacgagcaatcgtaaaactcaaacaagcctacgacaaagagaccggcgactacagcaacgtcctctacaaggtactcgagcccaagttcgtaaagaagaaagtaaaccgcaagacaggggagataacctaccaagttgaaaagttcaaaatcgtagtaccaaaagtcccgtaccgccaactggtgatcgacggagaccaaaagttcatgctagggtccagcacctacaagtacaacgcgaaacaactggtgctttccgaaaacgccataaaaatcttagacaagaaatctttcgatcaatcgggatacaaatcaagtgacctggacacggtatacgacgaaatactcagtcaagtcgacagatacttcagcatgtatgacaaaaacaaattcagagaaggacttcacaacggaaagaaatactttcagaggctaccaatgatagacaatgtggaaaaagggaaaataaaagaaaacggaaagttcaaactcctaaacgaaatactgatcggactacacgccaaccccagcttcggaaacctaaagtccctcggcataagcaccccattcggcatgatgcagttcgccagcggcataagcctcagcgaaaacgcaatactatgctaccaatcccccaccggcatattcgagcgtcgcgtcgcactaaaagacctctga

SEQ ID NO: 6356 - RNA, 3588 nt, synthetic construct
  misc_feature 1..3588: note = Cas9 variant
  source 1..3588: mol_type = other RNA
atgcagaaaaacataaacactaaacaaaatcacatttacattaaacaagcccagaaaatcaaagagaaactaggcgacaagccttacaggatcggactagacttaggggtcgggtccatagggttcgccatagtaagcatggaagagaacgacggcaacgtactcctgcccaaagaaatcatcatggtagggtcacgcattttcaaagccagcgccggtgcagccgaccgcaaactatcccgcggacaaagaaacaaccaccgccatacaagagagcgcatgaggtacctatggaaggtcctagcagaacaaaaacttgccctacccgtccccgccgatctcgaccggaaagagaactcatccgagggggagacctcggccaaaagattcctgggagacgtactacagaaggacatctacgaactgcgagttaaaagcctcgacgagaggttatccctccaagaactgggctacgtactctaccatatagccgggcatcggggatcttcagcgatacgaacgttcgaaaacgacagcgaagaagcccaaaaggagaacacggaaaataagaaaattgccggaaacataaaacgactcatggccaagaaaaactaccggacatacggcgaatatctatacaaggagttcttcgaaaacaaagaaaaacacaagcgcgaaaagataagcaacgccgccaacaatcacaaattcagcccaacacgcgacctcgtaatcaaagaagcggaggccatcctcaaaaagcaagcaggaaaggatggcttccacaaggaactcaccgaagaatacatagaaaaactcacaaaggcaataggctacgagagcgaaaaactcatccccgagtccggcttctgtccgtacctaaaagacgaaaaacgactacccgccagccacaagctcaacgaagaacgaagactctgggaaacactcaataacgcccggtatagcgaccccatcgtcgacatagtcaccggcgaaatcaccggatactacgaaaaacagttcaccaaggagcagaaacaaaaactcttcgactacctgctgacaggtagcgaactcaccccagcccagacgaagaaactgctcggcctcaaaaatacaaacttcgaagacataatactacaaggtagggataagaaagcccagaaaatcaaaggatacaaactcataaaactagaatcaatgcccttctgggcccggctctccgaagcccaacaagatagtttcctatacgactggaacagctgccccgacgaaaaactcctaaccgagaaattatcaaacgaataccacctaaccgaagaagagatcgacaacgcgttcaacgagattgtcctgtccagcagctacgcgccactagggaaatccgcaatgctaataatactcgagaagatcaaaaacgacctatcctacaccgaagcagttgaagaagccctcaaggagggaaagctgaccaaagaaaaacaagcaatcaaagaccgcctaccgtactacggcgcagtcctacaagaatcgactcagaaaattatagcgaaaggattcagtccacaattcaaggacaaagggtacaaaacaccgcatacaaacaaatacgaactggagtatggcaggatagcgaacccagtcgtacaccaaacccttaacgaattacgaaaactcgtgaatgagatcattgacatcctcggcaagaaaccctgcgaaatcggcctagaaactgcccgggagctgaaaaagtccgccgaagaccgatctaaactcagcagagaacaaaacgacaacgagtccaaccgcaaccgaatctacgaaatatacatcagaccacaacaacaagtaataataacccgccgggaaaaccccaggaactacatactaaaattcgaactactcgaggaacaaaaatcacaatgcccgttctgcggtgggcaaatttcaccaaacgacatcatcaataatcaagccgatatcgaacaccttttccccatagccgaaagcgaggacaacggaagaaacaatttagtgatcagccattccgcatgcaacgcagacaaagccaaacgtagcccgtgggctgccttcgcaagcgccgccaaagattcgaaatacgactacaaccgcatactatctaatgtaaaagaaaacataccacacaaagcctggagattcaaccaaggcgccttcgaaaaattcatcgaaaacaaaccaatggctgcacgattcaagacagacaactcctacatctcaaaggtagcccacaagtacttggcgtgcctatttgaaaagccaaacatcatatgcgtaaaaggctcgctaacagcgcaactccggatggcgtggggcttgcaaggcctcatgatacccttcgccaaacaactcatcaccgaaaaggagtccgaatcattcaacaaggacgtaaacagcaacaagaagatacgactcgacaaccgtcaccacgcgctcgatgcgattgtgatcgcctacgcctcccgcgggtacgggaacctgctcaacaagatggccggcaaagactacaaaatcaactactcggaacggaattggctgtccaagatattactacccccaaacaacatcgtttgggaaaacatcgatgcggatctcgagagcttcgaaagcagtgtgaagaccgccctcaaaaacgccttcatctcagtcaaacacgaccactccgacaacggagaactggtcaaaggcaccatgtacaaaatcttctacagcgagagaggatacaccctcaccacctataagaagctgtccgcgctgaaactcaccgacccccagaaaaagaaaacaccaaaagacttcctggagaccgccctccttaaatttaaaggccgcgaaagcgagatgaaaaacgaaaagataaaatctgccatagaaaacaacaagcgcttattcgacgtcatccaagacaacctcgaaaaagccaaaaagctactcgaagaagaaaacgagaaatccaaagcagaaggcaagaaagagaaaaacataaacgatgccagcatctaccaaaaagccattagcctctccggggataaatacgtacagctaagtaagaaagaaccagggaaattcttcgcaatatcgaaaccgacgccaaccacgacaggatacggctacgacacaggggacagcctctgcgttgacctgtattatgacaataagggaaagctgtgtggcgagatcatacggaagatagacgcccaacagaaaaacccactcaagtacaaagaacaaggcttcacccttttcgaacgaatctacggcggagatatcctagaggtcgactttgacatccactcggataaaaattcgttccgcaacaacacaggcagcgcccccgagaatcgtgtcttcatcaaggtggggactttcacagagatcacaaacaacaacatccaaatatggttcggcaacatcataaaaagcaccggcggccaagatgacagcttcacaataaacagcatgcaacagtacaacccccgcaagctaatcctgagctcctgtggcttcataaaataccgatctccaatacttaaaaacaaagaaggctga

SEQ ID NO: 6357 - RNA, 3594 nt, synthetic construct
  misc_feature 1..3594: note = Cas9 variant
  source 1..3594: mol_type = other RNA
atgagcaagcatgtcctaggcctcgatctcggcgtcggaagtatagggtggtgcctaatcgcacttgacgaacaggatcaacccgcagaaatcctcggaatgggatcgcgaatcgtcccacttacaacagacgatctaaacgagttcagccaaggtaaagcaatcagcaaaaaccaaaagcgaacaacccaacgaacaatacgaaaggggcttgaccggtatcaactacgccgaaaagtactctcagaaaaactcgccggccacgggatgttgcccgacaaagacctaatgcaactcccagtcctcgacctatgggagctcagagcgagagcagcatcaccaggggaaaagctctccctccccgaaattggaagagtactataccacataaaccaaaaacgaggctacaaacacgccaaatcagatgaagcagaggaagtcacaaaaagaggaaaagagcagggatacgtcgccacggtcaaaggacgttacgctgaactccaacgtgagggggcaaccgtaggccaacatttcgcctgcaaattaaaggaacaccgacaagaatccccaagcggaggcttcttctataactacagaatcaaagaccaagtctacccgcgcgaagcatacatagaggagttcgaccggatcatggaagtacagtcagtcttttacccggaagtactaacaccagcattcatccaagaactgcgggacaaagtcatattcttccaaagacccctcaaaagctgcaagggcctcgtctccttctgcgagttcgaaaaacaagaacgcgtggtacaattgaaaagagtaaacagagaaggaaaagaagaactccaagagcgcaagatcacgataggacccaaagtggcgcccaaaagcagccccatcgcccaactatgcaaactgtgggaaagcatccacaacattcgaatctactatccagacggcaaagaacgaccaataacactcgaggagaaaagaaaactgctagcatatctacaaacccacgacaaactaacttttacagcactgaagaaagagctgaaaatcagcgacaaagagcgactatggtgcgacaaactcctgaaaggcgggatcaagggcgacaccacaagagtcctcctgagaaaggcgctcgccggctacaaacgctacgaacccctgctaagaatggacctagaactgagagactttcaagaaatcgtgagcggcaagcggcttatccggcccatagtagacgaaagctatctaagccagccgctatacagactatggcacatactatactcgatcgaggagcgagaagcgatgcgtcgcgcactcatcgatcagctaggtttcctagaagaagacctggacggcggactgttagacaaactgtaccagatcgacttcgcgaaacaaggatactccaacaagtcagccaagttcatctgcaagctactaccccacctccagggcggacacgggtactcccaggcctgcgagctagcgggaaaacgacacagcgccggcagtctcacaaaggaggaactggaagaaaggccgctactagagcacataccactactacagtgcaacgaactgagacaacccatagtcgagaaaatcctgaaccagatgatcaacctggtcaacgcactccgccagaagtacggatcgatagatgaagtacgcgtcgaacttgccagagaactaaagatgtcccgcgaagaacgcgaagaaacctcaaaacggataaggtccagagaaaaggagaacaaggaaatagcagaacgaataaaagaatacgaactctaccccacaaaatccagaatacaaaaataccggctctggcaggaagccggagaacaatgcctatattgcgggcgctcaatcgatgtcgtccaattcctacgaggagatggagtagaaatagaacacataatcccaaaatcgatactgtatgacgactcgagcgccaacaaaacatgcgcatgctcacggtgtaacaaggataaaggcaacaggaccgcatacgaatacatcttagccgaagggcgagaggcagaatatctagacagactagaaacactcttccatgacggtaaactaagctactcaaaacgccgccgactacaatggaagaaagccgacataccggtcgacttcatagagcggcaattacgcctcacgcaatacatagctagacaagcccaagaaatcttacgccaaggcatcagacgagtcggagcatctgaaggatccgtgacagcaaaattacgccacctttggggatacgacgacatactacgcgagctcaacttcgagaggtaccaaagcatgggcgaaacagaaatagtcagccaggaggaaaaagacggatcgatcaccaaaagcgaacgcattaaagattggagcaaaagaaaagaccaccgacaccacgcgatagacgccctggttgtcgcatgcacccgacagggctacatccaacgattgaactctctcaacagcgaagaagacagcctccaaatgcaagaagactcaaagcagatgcgtgagaaaatgggcgggcagaaaagacccaccgccgacaaacatagcatactcgaaaactggctcatactccaaccccacttctcccaccaagaagtgaaatccaaagtagcagaaatactcgtctccttccgacccggaaagaggaccgtgagcaccggccgaaacacatacctcagatcgggaaagaaagtgacccaatcgggagtcctgataccccgcggaccactctccgaagagtctctatatggccaaatcctacggaacggtgagccaacatacgtcaagaaagtcgccttagaatcattatcggaggcacaaatcgaacaaatcgtagaccccaaacttaggcgcgagatggtggcccgaacccaaccctcagaaggagctaaactaaaccctaaacttttacttgccaccccattctacagtgacgcagcaggaacgcaacgagtacggtcagtcagagtcgctatagaaaacggcaaaaactccatagtgccactgcgctacaacgaaagcggaaaagccataacattcgtcaaccccggcaacaaccatcacgttggcatctacaggacctccgaagggaaactggtagaatcctgcgtcacattttggcaagccgtggatcgggttcgctacggcattcccaccatcatccgcaaaccacgagaagtactggaccagctgttactgagggacgacatccctgaagcccttctagcgcacctccccgcaagcgactgggagttcgtcgaataccttcaagccaatgagatgttcctaatcggactcactgacgaagaaatacaaacagccctggccgaatcggacctcctgaccctaagcaaccacctataccgagtacagaaaatgagctccgaatactacgtcttccgctatcacctcgagacagaagtcgcagacaacaaaaacaacacagggatcataccaaaattttaccgcctacgaggcccaaatgacacctatctgaaagccaacccgaggaaagtaaaagtcaatctgctcggcgaaatttccctgccttga

SEQ ID NO: 6358 - RNA, 3615 nt, synthetic construct
  misc_feature 1..3615: note = Cas9 variant
  source 1..3615: mol_type = other RNA
atggaaagaatcctaggaatagacaccggcacgaactcactcgggtgggccatcgtagacaaagacgaaaaccaataccacctagttgctaagggcaccaacatattctccgaaggagtcaaaattgaaaagggcatagaaagtagcaaagcagcagaacgaaccgagcaccgcagcgtccgcaaacattactggcgacgcaaaatccgaaaaattcggctcctcacaatactatccgataatgacctctgcccgaggctaaaacatgaacagctgcgacagtggcgtctcaagaaagtatacccgaccgacgacaccttcatggaatggcaaagaacagaagacaaagcgcaagtcaacccatacaaattccgatacatctgcctcacgcagaagctcgacttatctgacataacacaaagattcatcctcggacgagcactttatcatctcaaccaacgcagagggttcctctccaaccgaaaagaagcgacgaaagaatccgagggcaccgtcaaggaaggcatatcctccctctcaaaagacatgaaagacagcgggtgcgaatacctcggcgagtacttttaccaactgtaccagcagggcaaaaagatcagaaaccactacaccgcacgcaaagaacactatctgaaagagttcaaagcaatctgctccaaacaggaactagacgacgccctgatagagaagctagaaaaagccatatttgatcagcgtcccctaaaatcccagaaaggacaggtcggaacctgcaccttcgaaaaaggaaaaagtcgatgccccagctcacacccgctttacgaagacttccgcatgtacagcttcatcaacaacataaaagtgcaagtcgacaccctgtacgacaagggcgaacgcagcctaacagacgaggaaaaacaactcatcattccgcttttcaaacgcaaaagcaagcgcaccttccccttcgaggacatcgcgaagaaaatcgcaggcaaaaacaactattgctatatcaaaagcaacgaggagaaagcctacaaattcaactatcaaatggatacccaagtcagcgggtctcccgtaaacgcccagctggaagagatattcggcgaggactggctaagctcagtctgcgaagtgtacacgctagccaacaacaagtcacggttccaaataatgaacgacgtttggcacgttctcttcttctacgacgatgaagacaaactcaaggagttcgccaaagaccgactacagctcgacgatgaactagccgaaaaattctcaaaaatcagcatccccaacgactacgcggcactgtccctgaaggcgataagaaaaatcatgccctacctcagggactacggactaatatattccgaggcggtgttcctagcaaacctagtcgacgtcctaccccaacacgtatggggcatcaaagagatgcgggaagcagcaatagaaaacgtaatagacgtcatgcacagttacgacaaaaacaacatagacggcattacgctagaaggttgtgtaaaaacattcctcaaggaacgctaccaggtgagcgacgacaatctaaagaaactataccacccctccatgctcgatccatacccccgccaacggccaaatgacgaaggcgtcttccaactagggtctccccgcatatctagcgtcaagaacccaatggcaatgcactccctcttccgactccgaaaggtggtgaacctaatgctcaagaaagggtacatcacacccgacacaaaggtacacatagagttctccagagatctaaacgacgcaaacaagcgatgggccatacagacatggcaaagggaaaacgaaaaagaacgtgaacgatgccgaaaagaaatcgagaagtacatagccagcccttccgataccgacatacttaagtaccaactttgggaggaacagaaccacaaatgcctatacaccggagacgagatccgcataacggatttcctcggcgacaaccccaaatacgacatagaacacacgataccccgcagtgcgggaggcgacagcaccaaaatgaacctgaccctctgctcctcacgattcaaccgagatgagaaaaagacgaagttaccggcagaactcgtaaaccacgacgagatcctagagagaataagcaactggaaagagaaatatgaagatatagacaaacagatacgcaagatctccacaaagggcgcgaccagtaaagaggacaaagactcaaaaatccgcaggcgacactacctgatactccagcgcgactactggcgaggcaagtaccagcgcttcaccatgacagaagtaccagaaggattctcgcgccggcagggcacagacatctccgtaatatcgagatacgcgcgcatgtacctgaaaagcgtctttaagcaggtatatatcgtcaaaggaatcgcgacaagcgacttccgcaagatgtggggcatacaagacgaatacgcaaagaaagaacgcgtaaaccacgtacaccattgcatagacgcaatcacaatcgcgtgcatcggaaaagctgaatacgacaaactcgcagactaccgccatcaatacgatgactacctcttccaaggcaaaacaaaaccaacattcgacaagccgtggccaagtttcgtgatcgacatcaaacacatacaagacgagctcctgatcgcacattacgcaaaagacaatctggaaaaattcaccaagaaaaacctcagaggcaaagacggccgaataataagggacaaatttggaaacaaactacagatgaaaggagacacgtcacgcaacagcctccacaacgacaagttctacggcgccataaaccacgagggcgagataaaatacgtgtaccgaaccaacattgaagccctggacgccaaaagcataggcaacattgtcgaccccacagtccgatcaatcatagaatccgccattgccatacacggaagtctgaaagccgcgattaataagggcatatggatgaacgaagaaaagcacatacccatcaagaaggtccgcgtattccgaaacgacgtcaaaaagcccatcgaacttaaagaccaacgcgacttaagcgacaaggactataagcaacactactacgttaccaacgacggcaattatatgatgctcatcttcagcaaactgaacaacaaaggacgcgagatccgacaacacgtcgtgatcaactccctggaggcaaccgaggtaatcaaatcccacaaacgaagccaggtgggcaaagtggtctgggagagctactactccaaagagggcttcgatctcatctacaagctcaaaagtggaacgatgatccttttatacgagaacaacagagacgaagtctgggacttagatatccgcaacctacagaagcgcctatacatcatcaccaagatgaaatatgacggcagaatatacatgatgcaccaccaggaagcccgagagaagaaagacctcgaagagaaaagtggcagctttaaaatcaacgaagattacagacccctcatagtcaactcctacaaccaattcaatgccctagtacaggacctagacttcgaaatcaacgacctgggagaaatccgccgcctaatttga

SEQ ID NO: 6359 - RNA, 3630 nt, synthetic construct
  misc_feature 1..3630: note = Cas9 variant
  source 1..3630: mol_type = other RNA
atgaaaaaggactacatactaggcctcgacatcgggatctcgtctgtaggctggggcctattggaactagacgacaataacaacccatacaagataattgacgtgggcagccgtatattcaccccaggcgaagtagaaaagactggcgactcgcgcgcgaaagaacggcgggaaaaacgaggagcaagacggatagctcgccgccgcgagttccgactcgaccgcgtgaaaaacctcctgtacgaaaacggatatctcaagggcaacataaacagtaacatcgtcagcgagaagaacgaggaactgtcaatcatcttcaacaacatgatcaataactactacaacggaaagaacacaaacccctacatactgaaagttgaggcgctagaccgaaaactaaccgacgaggaactatctataatcctggtccactacgccaagaaaagaggttataaatcaaaccgcgaagaggcgtcggacaaagagagcgggaaagtactaaccgctatcaaagaaaacgagaaaatcatgaaagacaacaactatcgtacgatcagcgaaatgtacattaaggacgacaagttcaagaacaagatcaaaaatagccctaacgactataaaatatcagtgaccaacgaaatgtacctggaagagataaacaaagtactagactcacaaataaaattcggactaatcactgacgactttaagaatcaatacctagaaatctacaacagccgacgtagctacgccaagggcccgggcggcaacagcccatacggaggagacctaatcgaacgcatgacaggaaagtgcaacttcgatgggaacccccgcgcgccaaaaagagccttttcgtcagagatctacgttgcactcaccaagctcgtcaacctgaagtacaaggttaatgatggagagtacatcaaactctcagaaaaagagattaaaaacataatagaaaaagccaaggaaaagaaatccataagctacaaagacctaaccaaaatgatagggaacaacatagacttcaaagacctaacactgagtaagaaagaatatataaaactaattgaggaactaaagaagaaactaaacatcaagaaagacaccaaaatcaatatcaatgaactaagctccgaagacaaagagctctacaacaaactgtgcaacgacaaactgctctcaaaaaccctcatagagctgaaaggctaccacatcctaaaagattcggtcatcaaggcgtacagcaaggacatctgggacgaggtgaaggacaatatgtacctattagacgacctagctctatactgcaccaactacaaggtcaacgaggacatcctcaataagatcaaagaatccgaaaacatagacaacatttttaacgacatccactttgtcgaattgctcccaaacttcaaggaccacctaatgctatcgaccgagctgatacgcaaactaatacccataatgtacggcggcaacacctacgacaaggcaatgaacatcctcgggtacaaccattcggacattaacggggacaaagagaagaaagacctacttgtgccgatatgcgttgacgataatatcacgaaccaacgagtaatccgaagtctgacacagactagaaaagtcatcaactcgataatcaagaaatacggaatgccaaaaatcataaacatcgagacggcccgcgaactggccaaatcgagacaggaaaggaacgaaatagctaaaaataacgtcgaaaagcaagctgagaacgagaaaatcaaaaaccaactcgtggaactcggcctcttcgtcagcaccgacaaaataagtagtactgacctcctcaagtacaagctctggaaagaacaaaatgagttctgcgggtatagcatgaagaaaatcagcatagaagacctcttcggaaacaacatagtccaaattgaccatatcctgccctattcccggacatataatgataactacctcaacaaaacgctagtatacaccaaagaaaaccaggaaaagggaaaccggaccccatacgaatggtttggcaagaccgacaaatgggacgaatacgaaacatacatcaacaatttgacgatctctcaaaagaagaaagacaactacctcctcaagaaactcgatttcgacacggagcgagaaatgcgctctcagaacctaaatgacaccaagtacataagcaaagaactcagcagcctcatcaaggcctacctcaacgtcgaaaaagtaaatatgtaccccggcgcaattacggcgaagttaagggctcggtggggattcaaccgactcacccacagctacctcagcaaaaactacatcctaccaaagaacataaaggaagacattaataaagaccgcgacaaccacctacaccacgccatggacgccctggtcatcgcctcaattactccctcactccaacagaaaataacactctacgaaaaattctcccggtacatcgacggcctgacggaactccaaattaagaatataagttacatcaaaatagaagactcagagggacaatactacaacgacgacacagacgaggtcgaaaccatcgacattagggagtatattaaacagcagctggcagaaaacaacatctattacaatagacacaatatcagcaaactcgagttccccttgccctacgaaaacttcgacaaggaagcgaagctcagggtctacgaacaagacctagacacactcaagtggaacctcaaatcatacaacacatacacacagaaggacatcgacaacgtacatactctcatcccaagcatagccaagaccaaagtatcgggaaagatgcacgaagagacttactacggcataaaggaaatcggaaaagacgaggacaagaaaatctacaagaccctccggacgccgatcgaaaaagtcaaacgcaaagaccttgacaacatcccggatagactcggaggatcgaaggacgtctacgagtccctagtcgaatggttcggcgactacgaagttggagaagaagtcctcaaagccaacgggaacaaatacccagtcagcaagtccgacaaagaacataaagagatcaagaaactcaaactgtattccgagtacaaaaacaccggacacatgatcaataagagtaacgtcgaaaagggaggcatataccgcatagacgtattcaagagcaaagacaaagaagacgacaagctgtacttcgccgcatacgacatccttgaaattaaaaagatcaataccctaaaggagaaaaacagagttgacgacaatttcaacatcaaactcgactacggccaaggaaagaactcaaagatcatgtcttacactgacatcatcaacaactacgacctctacatctccctcaacaaaaacgacctcatcaagatcacaaccaacgatggcaaggaaagcgtcgcttatgtcgtagggtgctccagcggcatgctcgaagttaaatcaaaactcggcgacggatacgacatcatcaaaacagaccttaacgaaaataacatcttctcaaagcaaagggcgcagtaccaaatcacggtcagcaccatcaaagagattaagaagctatccatcagcgtcttgggagagatatccgggctatga

SEQ ID NO: 6360 - RNA, 3633 nt, synthetic construct
  misc_feature 1..3633: note = Cas9 variant
  source 1..3633: mol_type = other RNA
atgcgcaccatcctaggactggacctcggaactaactcaatcggatgggctgtgataaacagcgtaattaaagaacagaccgaaagaatctggatcgaaatggcagggtccagaatcatccccatggacgcagcgatccttggagacttcgacaagggaaactcaatcagccagactgcggagagaaccaggtttagaggggtacgacgcttacgcgaacgccaactgctccggcgagaacgcctacacaaagtactaaagatcctgggattcctccccgagcactacctcaaaggtatagatttcgaaaaacacaccggaaaattcctcagcggcagtgaaccaaagctaccctgggtaaaggacagatggggaaaatacagcttcctcttccagaccgccttcaacgaaatgcttgctgacttcgccaaacaccaaccgagcctagtcttcgacgggaaaaagatcccctacgactggacagtatactacctgcgaaagaaagcgctgaccgagatgatatcaaaagaagaactagcctggatactactaaacttcaatcaaaaacgcggatactaccagctcagaggcgaggaggaagaagataacgctgggaaatcggtcgagttctacgcactcaaggtattatcggtggaagccacggacgaaaagaaaggcagggacatatggtacaacgtccacctcgaaaacgggtgggtctaccgtcggagctccaatgtacccctagactgggaagggagagtcaaagagttcatagtcaccacagacctcaacccggacggaacacccaaactggacaagtacggcgaagtcaagaggtcattccgtgcccccaaagaagacgactggatgctaatcaagaaacgaactgaagctgacatcaccggcacgcacaaaacaataggctcctacatatacgacgcattactccaagaaccgcaacagaaaatcataggcaaactcgttaaaacagtagaacggaagttctacaaggaagaattaaacttcatactacagaaacaatgcgccttccacgcagaactacaagatcgggacctatacatgcgctgcatagaggcactctaccccggcaacgaggtacaacgaaggaacattgcaaaccgagactttatatacctcctaatcgacgacgtcctcttttaccagcgacccctcaaaacaaagaaaagcctgatcgccaactgtccctacgaagaaaacgaatacgtcaaccgcaaaactggagaaataaaaacagcacccctcaaatgcatcgccaagtcgcacccactcttccaagagttcagactatggtactttctatctaacatacgggtgtatcaaaaagaacgggaggtaaacggaaccctgcaccttgacgtagacgtaaccacggagttccttaaaacggaagacgactacgttgccctgttcgactggctcaactcgcgcaaggaaatcgaccaaaaagccttcctccggtaccccgcgtttggcctcaagaaagaaataaacaattaccgctggaactacgtcgaagataaattctacccatgcaatgaaaccagacacgccatcctgagcagactcgaaaaagccggcataggcatagacttcctaagcgacgaaaaagaaaccgccctgtggcacatactttactccgtatcagacaaacaagaaatcgaaaaagcgctcgccaccttcgccgtgaaaaacgggctaaacgaatcattcgtggaagtcttcaaaaagttcccacccttcaagtccgaatatggcgcatacagcgccaaggccatcaagaaactcctaccactcatgaggtgcggaaaatactgggatatgagcctcatagacggcaccaccaaagagcggatcgaaaggataatcgcgggagaatgcgacgaaagcataggggcaaaagttcgggagaaggcgatgaacctgagcgacataagttgcttcaaaagactgccattatggttagcatgctacgtcgtctacaacagacacagcgaagacaaagaaatcaccaaatgggaaaccccagccgacatagacgcctacctagcagccttcaaacaacacagtctgcggaaccccatagtcgagcaggtcatcacagaaacactccgcgtagtacgcgacatatggaaacaagtcggcaaaatagatgaaatacgtatcgaactgggcagagaaatgaaaaacccagcagacaaacgaaaaaggatgaccacgcaaatccttgaaaacgaaaacgcaaatctccgaatcaaggcgctcctggccgagttcgtcaaccccgaatacggcgttgagaacgtacgcccttacagcccaagtcagcaagaaatcctccgaatttacgaagacgccgtcctcaaaggagaagaacaaatcccagaggacatcgacgtcatcctcaagaagtttaacacctccaagctacccaccaagtctgagttcctcaggtacaaactctggcttgaacagaaatacagatctccttatacgggcgaactaataccactcgccaaactatttaccgccgcctacgaaatcgagcacgtaatccctcagtcacgctacttcgacgactcgttcagcaacaaagtcatctgcgagagcgcagtaaacaagctaaaggataaccaactgggctacgagttcatcaaaaaccatcacggccaaaaggtggaagtcggattcggcaaaaccgtagaaatattctcagtggactcatacgagcgattcgtaaaagaacaatacgcgaaatcgggaatcaagatgaagaaactcctaatggacgacatcccggagcaattcatcgaacgacaactcaacgactcccggtatataagcaaagtagtaaaagggctcctctccaacatagtccgagagaaaaacgacagcggagaatacgagccagaagcagtgtcgaagaatatactggtctgcaccggaagcgtcaccgaccgactcaagaaagactgggggatgaatgatgtatggaacagcatcgtctccccacgtttcgaacgactcaacgcccttacagagacccaatgcttcggccactgggaaaacaaagacggcaagaaggtcttccagacagcagtccctttagagtaccaaaaagggttcagcaaaaagagaatcgaccacaggcaccacgccatggacgcaatagtaatcgcatgcgccacccgcaaccacgtcaactatttgaacaacgagtcagctagccggaacgccaaaatatcccgctatgacctacaaagactcctctgtgacaagtcacgaggggacggcaacggaaactaccgctggatcatcaaaaagccctggaccaccttcacccaagacgcccgggaggcgctctccggcataatagtatctcttaagcagaacctacgcatcatcaacaagacaaccaacatataccaacacttcgacgccaatggaacacgggtctacgaaaaacagaagataggagactcatgggccatacgtaaacccatgcacaaagataccgtcttcggggccgtaaacctccggaaggccctaatcccacaacactacaacctcaccctatttatatcgagctga

SEQ ID NO: 6361 - RNA, 3642 nt, synthetic construct
  misc_feature 1..3642: note = Cas9 variant
  source 1..3642: mol_type = other RNA
atggagaagcggcttggaatagacgtgggaacaaactcactcggctgggccatagtagaagttgacgacgagggctgcacactattagaccgaggagtcgacatcttccaagaaggagtggcgcgagagaaaaatcaagaaaaaccagcagtgcaagatcgcacggacgcgagggcgttaagacggcattactttagaaggaggctgcgaaagatcgcactcctaagagtactggtgcggcacgacctttgcccggctctctccgaagaacagctcaacgcctggcaaggaaaggggatctaccccttagatgacgcctttatcaggtggcaacgaaccgacgataacgcggaccgaaacccgtacagggaccgattcagatgcctcaccgaggaactagacctagcatgccgagaggagagatatgtactcgggagagcgttataccacctgtgccagagacgagggtttctaagcaacagaaaggacgcaggaaacgaggccgaagaagggaaggtaaaacaggaaataaagacactgagcgcggacatggcggctgcaggctgtgaatacctcggtgaatacttctatcgcctgtaccagaggaaagaaaagatcagaaaacactacacggcaagaaacgagcactacctcgccgaatttagagcaatctgcagaaaacaaaggctcgatgaggagcttcggcaagccctagagaaagccatattctaccaacgcccgctcaaaagccaaaaaggccttgtgggcaaatgcacgttcgaaaaagataaaagccgatgcccagtatcacatccgcgcttcgaagagttccggatgctccaattcatcaacaacgttagggtcaccgggcccggcgacgcagaacccaggcccctcagccccgaggaggtggaaatcgtgcgcccactattcttgaggaaatccaaaccacacttcgatttcgaagacatcgcaaagaaaatagcaggaaaaggaaattatgcgtgcagaggagagctattacaagcaccataccgcttcaattgcgcgggaaaatcgacggtaaccggcagccccgtctctgcactattcgcgagcgtcttcggcgacgactggcagagagaaatctgcagcctatatacactaggagcagggaaaaacgaagaacaaatcctaaatgacgtatggcacgtactattcgcgtttgaagatgaggaacgcctgcaagcctggctacaagaaaaactacagttatcggccgatgacgcgaagacactggcagcattccgcctaccccaaggatacgcatcactctccctaaacgtcattaacaagatattgccatacctaaggagggggtaccggtacgatgaagcagtcttcttcgccaatttgggcaaggtcctaccagcggaagtatacgcggacccggcccgcagaagggaagttgaacaggggatatcggcacagatggacgatcttggggacggcgagaaaacacggaaagaagaaagaataagggactacctccgccgatactggggtgttgaggaaaagcgcctggagagactatatcatccaagcatgattgaagcctatccatccgcatcgccgaacggccaaggacttctacagctcgggagtccacgcatccccgcggtaagaaacccaatggcaatgagagctctgttcagactccgtgtactactgaatgaactcctacgagaggggaaaatagaccgcgggaccaagatcaatatagaactggcgcgagaattgaacgacgccaacaagcgtaaagccatagaacgatatcaacgagaaagagaagcagaaaacagaaaatatgcagaagaaataagacaacaatacgtggaagcgacagggcactcgatagaaccaagcgaagaagatatcctaaagtacagactatgggtagaacaaggacactgcagcctgtacaccgggaaaactataggcatcagcgagttcttgggcgacggccggcgatacgacattgaacacacagtacccagatccagaggcggagaagacgcccaatacaacaaaacactatgcgaagaggagttcaacagagacataaagagggacaaactacccagtgagctagccaaccacacagccatcctggcatgcgtagaatcctgcggatggttcgaacggatagaagggctagaacacagagtatggggcgcagacaggagagctaagagcgcaacgaccaaatcagcaaaggacttcgcaatacaagaccgacactattggaggatgcacctggactactggaggcgaaaatgcgaagccttcacaatgacggaagtccctgaggggttcagcaataggcaaggcgtagacgtaggcattataggccgctacgcacgactctacctacaaacagtattcgatcgagtgtacaccgttaaaggcgccaccacggccgcgttccgccggatgtggggcctacaggaagagtacgcagcaaaagagagggtcaatcacgtccaccactgcatcgacgcgattacgatagcttgcataggaagcagggaatacgccctctgggcacaatacgtacgccaagacgaactgtaccgatggggagaagccgacaagccacgatgcggaaagccgtggccgaccttcacagaagacgtgagggctacggcagacgaactactgataagccaccatacaccggacaacatgccaaagcaatcacgcaaacggctgcgagtgagaggcaaagtgcagcgaaacgaccggggagaagtcaagtacatgcaaggcgacacggcacgaggggcgctccaccaacaaacgttctacggggccatcgaaagagacggcgagatacgatatgtagtcagaaagagcctagaccaactgctgcccgccgatgtagagaaaatagtcgacgaagcagtacggcagaaggtaagggaagcagtcgaagcatacggatttaaagaagccacagaccccaccaaacatacagtatggatgaatgaagaaaaacaaatcccaatacgaaaagtcagaatacttacgggagttaaaaaccccatactactgaagccccaccgagacgtaagcgtgaaagaatacaaaagatactaccacgtagtgaacgacggaaactactgcatggcgatatacgaggggcgcgaccgacagggcagactcaaacgcacattcgaaatagtcaataagctcgaagctgcccgctacttcaaacgtagcgccgaccgggagagcaggccagatctggtgcccctaagcgacgtaaacggatacagcttaaaatacctgctgaagacgggcaccatggtcctcttttatgaaaactcgcccgacgaactctatgaatgctccgtgggcgaactagcaaagcgactctacaaagtggtagggatggcccaagacggacgcgtgcaatttctattccaccaggaagcgcgcgaccagaaggccgtaaccgcggaatgtgggatgggcataagcgtattcgacgcacgccacccggccccaaaactcaggatacgggtcagcaatttcaagatgttcgtggaaggctacgacttcgaactgaccgtaacaggcgaagtaaaattcaaacggtga

SEQ ID NO: 6362 - RNA, 3642 nt, synthetic construct
  misc_feature 1..3642: note = Cas9 variant
  source 1..3642: mol_type = other RNA
atggaaaagcggctcggcatagatgtggggacgaacagtctgggctgggcaatagtcgaagtagacgacgaaggctgcacgctcctggaccgtggcgtagacatattccaagaaggagtcgcccgggagaaaaaccaagaaaagcctgcagtccaagaccgaacagacgcccgagccctcaggcgacactacttcagacgacgcctaagaaaaatagcgctcctaagagtactcgtacgccacgacctatgcccggcactcagcgaggaacaactcaacgcctggcaaggaaaaggaatatacccactagacgacgccttcataaggtggcaacgcacggacgacaacgccgaccgtaacccctaccgagatagattccgctgcctgacagaagaactggacctggcatgcagagaagaaagatacgtgttaggcagagcactctatcacctatgccagcgaagaggatttctctccaacaggaaagacgcgggcaatgaagcagaggaaggaaaagtaaaacaggaaataaagactctatcagcagacatggccgcagccggctgcgaatacctgggcgaatacttctaccgcctatatcaacgaaaagagaaaatacgaaaacattacaccgccaggaacgaacactacctagcagagttcagagcaatatgccggaaacaaaggctagacgaggaactacgacaggcattagaaaaagcgatattctatcaacgccccctgaaaagccaaaagggcctagtaggaaagtgcacgttcgaaaaggacaaatcaaggtgcccggtaagccacccacggttcgaagagttcaggatgctccaatttataaacaacgtgagggtcacagggccaggggatgcggaacccaggccactcagccccgaagaggtcgagattgtaagacccctattccttcggaaaagcaaactacacttcgacttcgaagacatagccaagaaaatagcagggaaaggcaactacgcctgcagaggagaactactgcaagccccatacagattcaactgcgccgggaaatccacggtaacagggtcgcccgtatcagcgctattcgccagcgtcttcggggacgactggcaaagagagatatgcagcctatatacgctcggggcaggcaaaaatgaggaacaaatactaaacgacgtgtggcacgtcctgttcgcattcgaagacgaagaaagactgcaaacatggttgcaggaaaaactccaactatccgcagacgacgccaaaacgctggcagcatttagactaccccaaggatacgcatcattgagcctgaacgtaattaacaaaatcctcccctatctaagacgcggctacagatacgacgaagcggtattcttcgcgaacctaggaaaggtcctcccagcagaggtgtacgcagacccggccagacgacgcgaagtagagcaaggaatatcggcacaaatggatgacctcggcgacggggaacagaccagaaaagaggagaggatcagggactacctccgaagatactggggagtagaagagaagaggctggagagattgtaccacccgagcatgatagaggcgtatccatcggcatccccgaacggccaaggactactccagctaggaagccctaggataccagccgtcagaaacccgatggccatgcgagctctcttcaggctaagggtcctattgaacgaactgctaagagagggcaaaatagaccgaggaaccaagataaacatcgagctcgcccgagagctcaacgacgcaaacaaaaggaaagcaatagagcgataccaacgcgagcgcgaagctgaaaaccgaaaatatgcagaagagatacgtcaacagtacgtagaagcaaccggccactccatcgaaccgagtgaagaagatatactaaagtaccgcctatgggtggaacaaggacactgttccctctataccggcaaaacaataggcataagtgagttcctaggggacggacggcgctatgacatcgaacacacagtcccgagaagcaggggaggtgaagacgcccaatacaacaaaacactatgcgaagaggagttcaacagagacataaagcgggacaagctcccaagcgaattagccaaccacacggcaatactcgcgtgcgtggaaagctgcggatggttcgagcgcattgaggggctcgagcaccgagtatggggagccgaccgccgcgccaaaagcgcaaccacgaagtcggcaaaagacttcgcgatccaagataggcactattggagaatgcacctcgactactggcgacgcaagtgcgaggcctttacaatgacagaagtcccagaaggattctctaatcgacagggagtagacgtgggaattataggacggtacgcaagactctatctacaaacggtctttgaccgagtatacacggtcaaaggagccacaacggccgctttccgaaggatgtggggcctacaagaagagtacgcagccaaagaaagggtcaaccacgtacaccactgcatcgacgcgataacgatcgcatgcataggcagcagggaatacgccctctgggcccagtacgtccgacaggacgagctatacaggcgaggcgaagcagataaaccccggtgcggaaaaccgtggccaaccttcacagaagacgtgagggccaccgcagacgagctactaataagccaccacacaccagacaacatgccgaaacaatcacgtaaaagactacgagtacgcggcaaagtgcaacgaaatgacagaggggaagtaaaatatatgcaaggagacaccgcgcgaggggcattacaccaacaaaccttctacggtgcgatagagcgagatggcgaaatcagatacgtcgtacgaaagagcctcgaccaactgctccccgcggacgtcgagaaaatcgtcgacgaagcggtaaggcaaaaggtccgcgaggcagtagaagcatacggcttcaaagaggcaacagaccccaccaagcatacggtctggatgaacgaggaaaagcagataccaatacgaaaggtgcggattctcacaggagtgaaaaacccgatcctcctaaaaccccacagagacgtaagcgtgaaggaatacaaacgctactaccatgtagtgaacgacgggaactattgcatggcaatctacgagggccgagacagacaaggacgactaaaaagaacgttcgaaatagtcaacaaactagaggccgcacggtactttaaaagaagcgccgacagggagtcgcgaccagatctggtgcccctaagcgacgtgaacggatatagtctgaaatatctactgaaaacaggaacaatggtcctgttctacgaaaactcacccgacgaactatacgaatgctcagtcggggagctagcgaagaggctatacaaggtagtaggaatggcccaggacggcagggtacaatttctctttcatcaagaagctagagaccaaaaggccgtaacggcagaatgcggcatggggatcagcgtattcgacgcaaggcacccagcacccaaactccgaatacgagtaagcaactttaaaatgtttgtagaagggtacgacttcgaactaacagtgacaggcgaagtcaagttcaaaagatga

SEQ ID NO: 6363 - RNA, 3651 nt, synthetic construct
  misc_feature 1..3651: note = Cas9 variant
  source 1..3651: mol_type = other RNA
atgacaaaaatacttggcatagacaccggaacgaactccctaggctgggcaatagtagacaaaacggccgacaactacaacctcctagacaaaggcgttaacatcttccaagaaggagtaaagattgagaaaggaattgaatcctccaaggccgcagaacgcaccgaacatcgcgccacaagagtcaggtactatcgcattaaactgcgtaagataaggctcttacggatattatcggacaaccacctgtgtccacccctctcccaagaagagttatcaacttggcggctcaagaaggtctaccctaaaaacgaactattcatgcagtggcagcgaacggacgacgacaccgaaaagaccccctacgcataccgacacaaatgtatacacgaaaaactagacctcagcgatgtaacagaccggtacatactaggacgagccttctaccacataatccagcgccgcgggttcctaagcaacagaaaagaacaagggggcgaagattcgggaaaagtaaaggaggggatctcgacgctaacacacgaaatgaacgaagcaggctacgagtatctaggcgactacttctacgccctctacaacaagggcgagaaaatccggaagcactataccgcgcgaaacgaacatttcctatccgagttcaaagcaatctgcgaaaaacaagacctagaaaaggaactcggaagcgaagtggtcagaaatatagaaaaggccatcttcgaccaacgccctctcaaatcgcaaaaaggacaagtcggtaagtgcgtcttcgaaaagaataagacaaaatgtccaagcagtcacccaatgtacgaagagttccgcatgctcacattcatcaacaacatcaagataaaaacacccaacgacgacgtactacgacccctgaacaccggtgaacgggagaaaataatgcccctattcttccgaaagagtaagaaacaattcgactttgaagacataaccaaaaagctagcccccaagaaaatgtacggcttctacaaaaaggaagaagacgcagaaatgccgttccttttcaactaccccatggataccagcgtaagcggctgcccggtaaccgcggccctcaaagacgtattcggcgacgactggattacagccatatgtgaaacatacacactgggagaaggcaagtcccgcttcgacatcgtcaacgacatctggcacgcactatacttctacagcgataaagacaaactggccgagttcgcaatcaaccgtctccaactatctgaagacgaagccaaaatcttctcagaaatctcactcccagccgactacgcatccctcagcctaaaagcaatatgtaaaatcctcccctacttacgccgcggcctcatctacagccacgcagtcttcctgggcaacctatgcgaagtgatgccgaaatatgaatggagcataaaagaaatgagggaaacaatcatcgacaatatcatcatggaaatggacaagtgcgacacaaaagacaaacgaacatttgaagtttgcataaaagactacctaaaaggccagtacaacgtgagtgacaatagcctaaagaaattataccaccccagcatgatagagacctatccccgggtccaatacaccaatgaacatggcgtgtaccagctcggatcaccccggatcgattcggtaaggaacccgatggccatgcgctccatgttcaggctccgcaagctcgtaaatagactattagtggaaggcaagatcgaccaaaacaccgaagtgcacatagagttcgcgcgggagctaaacgacgcgaacaaacgcaacgcaatagcactcttcgtcaaagaaaatcagtcagccaacgacgaagcccgcaaacaaatcatcaccctcttcaagaaagaaacgggtacggacatcgagccaactgacaaagacatcctgaaatacgtactatgggaagaacaaaaccacatctgcctatacacgggaaagcaaatacggatatccgacttcatcggcgcgaatccaaaattcgacatagaacacacgattcctcgaagcgtcggcggggactcaaccaaaatgaatctaaccctatgtgatagccgctttaacagagaagtgaagaaaacgaaactacccgtagaactacctaaccacgacgaaatcatggaacgaatcaaagaatggaaaaagaactacgaactgcttgacattcaaatacgcaagaacaaaaagttatcaaagggcgcaaccaccaaagaacagaaggacaccatcatacgcaagcgacatctgctcgaactcagacgagactactggcgaggtaaatacgagcgattcacaatggaaagcgtacccgagggcttcagtcgaagacaggggacagacatatcggtaatatcaaaatacgcacggctgtacctaaagtccctcttcaaccgcgtttacaccgtgaagggaatagccacaagcgacttccgaaagatctggggcatccaggacatatacagcaaaaaggaaagaatcaaccacgtacaccactgcatcgacgccatcgtaatagcatgcataggcctcgacgaatacaacaagctaggcgcatactaccacgacgaagagaacaacaaatggtacggcatgtcaaaagccagctttaagaaaccatgggccacattcgtagaagacataaagaaaatccaagacgaaatactcgtataccactacaccccagacaacatgcccaaacaaggccgccgcagaataaaaattgacggaaagaaaatactgtgcaagggcgacgcggccagaggctccctccacaacgacacatactatggcgccattgagaatgatggagccgtgaagtacgtcaagcgaatcgacctagccagcctagaagaaaaagacgtcaaaaatatcgtcgacgataccgtccggtccataatagaagccgcaatcaaagaaaaaggtttcaaagacgcaatggcatccaccatctggatgaacgaagaaaagagagtccccataaagaaggtgaggtgcttcaccccatccataaccaaaccactcaatatacgcaaacaacgcgacgtctcgataaaagaatacaaacagcaatatcacgtcgcaaacgacagcaactacctcctcgctctgtatataggaaccgacaacaaaggaaaggaaaaacgcgagttcgaaatcgtcaacattctgcaagcagcacagtactaccggacctctaacgacaaagaagtcgtagaccgtcacatagtccccataaaaagcgaacacgactacccgttcgcctacaccctcaaaatcggcactatggtcctactatacgaaaaatcccccaacgaagtctgggacgccaccataaaagagagaaataggcgactatacaaggtaacgggcctctcgacgatgcgcatgaaaggccgaaacggggagtacgcttacgctaccgtcaagctaatccacaacgaagaagcacgcccatcaaaagacatcaaagccaaaaacggagagtacgagcaaggcgaagagttccgccccgcaataataatgctccacactcagcttaacgccctcgtccagggatacgactttgagatcaacgagctgggtgaaatccgccgtctacgctga

SEQ ID NO: 6364 - RNA, 3654 nt, synthetic construct
  misc_feature 1..3654: note = Cas9 variant
  source 1..3654: mol_type = other RNA
atggagaaacagagaatcttaggcctcgacccgggcaccaactccctcggttgggcagtcctagactttgacaacagcaaacaggagtacaatctggtgcgcaaaggcgaggtcatcttcgaagaaggagtaggcaaaagcgagcgaggagagttctcaaaagcggcataccggactttctacaaaagtacccgaaagcactacttcaggcgaagactccgaaaaatcgaagtcttaaaagtgctcgtaaagtacgacttctgcccctacctaagcgacgacctcctaaagcagtggcatgaaaagaagatatacccggctgtaaaagagttcatggactggcaacggaccagcgatgctgagggaaagaatccatactacgaccgccactgctgcctgaacgaaaaactcgacctcagtctaaaatcagacagatacatactcggcagagcgctctaccacctgacacagcgccgcggcttcaaaagcaatcgcctgatacaaaacaacgacgaaaacgaagaaggcaaggtgaagaaagggatcagcgaactcagcacggagatgcaagaggccaactgcaattacctgggcgactacttctacaagctctacacagaaaaggggaacaccgtacagatacggaaacgatataccgacagagagaaacactataagaacgagttcaatgccatctgcgaaaaacaagaactaaatgaaaccatagtaaaagaactggacaaagccatattcttccaacgcaagctcaagccccagcgtcacggcgtaggcaaatgcacgttcgaacccaacaaccgacgctgtgccatatcgcaccccgacttcgaaagattccgaatgttatgcttcatcaacaacataaaaatcaaaaccccattcgaagaaaatctccgcccactcaacaacgaagaaaaggcgctcatcgaacccctattttaccgcaaatccatcaaaaacttcgatttcgaggaaatagccaagaaattagcaggcaaaaataattactgctacataaaagacgactccagcaagcagtataaattcaactatcgcatgtcacagggcgcctccacatgccagacaatagcaaagctaaagtcaatattcggcgaggagtggaaaaacggcatagccgagacctacaccaacaggcgcaagaaagaaggactgaagaaacaggcagaaatggtcgacgacatctggaacgtgctgtattccgtgtcagaatgtgacgtattaaaagacttcgcgataaacaaacttcaactagacgagaaaacagccgacaacttcagcaaaacgaaactcgcgcagggattcgccacgctttccctcaaagcgatcaggaagatcctcccgtttctggaacagggcttcgggtacacggaagcagtattcctagcaaacatccccaccgtcgtaggaaaagagtactggaacaacgaagacatacgcaacgacatcatggaggaaataaaaaccatcttctaccacaacacgctaaagacaaacgacagccacaataccatcctcttctgcatcaaagacatcctcagcaacaattttgacctggccccaggggccatagacaaactctaccaccccagcatgataaacgtatacaaagatgtgatcccaaacgaggacggaatcctccagctgggatcacccaaaatcgacgccgtgaagaacccaatggccatgcggtcactgcacatcatacgcaaggtcgtcaacgaactcctgcgcgagggaattatcaactctgatacggaagtccgcatcgaatatgcgcgagagctcaacgacgcaaacaagcgccacgccatagcggactggcaaaagaagcagtacggaaaacaccaaaaataccgcaaggaaatcaaggaattattcaaagcagagacaggattcgaaattgaaccaaacgagacagacatcctaaaattcgagctctgggaagaacaaaaccacatatgcctctacaccggtcaagaaatcggcataagcgaatttgttggagagaacccaaaatacgacatcgagcacacgttccccaggtcgctgggtggggactcaaccaaaatgaacatgaccctgtgtgaaaacaagttcaaccgcgaaaataaacaaaagaaactgccaagcgaactagcaaatcactcagaaatcctagagcggatcgacgactggaagaagaaaatatacatcctgcagaagaaatacgacagcatcaggacacataacggcatggacaaagagaacaaagacaagaaaatagtaagtcgacacaaaataaaactggaactagactactggaaaggtaaatacaatcgatttacgatgaccgagatcccagaaggtttctccaggcgccaaggaatggggataggcctaatctcacgatacgcaggcttgtacttaaaaacgatattccacaaaaaggacaacccccaaaagagcaacgtctacatcgtaaaaggctcgatcaccgcagagttccgtagaatctggaacatccaagacgactacgagaaaaagtgtcgcgacaaccacatacaccactgcatcgacgccatagtagtaggctgcatcggcaaacgcgaatacgacctgatggcccagttctaccgggacgaagaaaaatatcggtgggaaaagaagaagaagccattcttcaaaaagccatgggaaacattcactcaagacatgctctcactcaaggacgaagtgctgaccgtgcacttcaatccgagcaacttcacaaagaaagcgcacaagaaggtcttcacacccaagggcatattcgtggcccaaggggactgcgccagggttaaactccacaagggttcctacttcggagccatagaacagaagggcgaaatcaagtacgtgatgcgtaaagaactaagcgcactaaagattgaagacatcaaaaacatagtcgacgctgtggtaaaagagaaagtgttagcagtcgttaaaaagaaaggcttcaaacaagccatggcggagccaatctacatgaacgaggacaaaaggatcctcattaagaaagtacgactgttcgtcagccaggccaacccactcatagtcaagaaacaccgcgatctctcctcaaaagaatacaagcaaaattactacgtagacaacgagggaaacctcatgatcgccatgtatgagggcgtcaagaaaaacggcaagatcgaccgcgagatcactgtggtgaacaacctagaagcagctaaatttttcagacagtcccaaaagaacaatgccgagaaacaactcattagccacctctcgcccaaaaacgggtatccattgaaaactgtgctcacccaaaagcagctagtactaatgtacgaagacagcccaaaagaaatcaaactccgggacacgaaaaacatggtgaaaaggctctaccaagtgttcggcatagaaaaagacgggagagtaaaactaaaattccaccaagaagccagatctgaaggtctcaacatcaactccgcggcgtttaagatacaggacacccccgaatcactctacaggcatacaaaatcaaacctgaaagtactcgtcaacggcgtggacttcaagataaacatcctgggcgaaatcagcctaatatga

SEQ ID NO: 6365 - RNA, 3654 nt, synthetic construct
  misc_feature 1..3654: note = Cas9 variant
  source 1..3654: mol_type = other RNA
atggaaaagcagcgaatactagggctcgacccaggcaccaacagcctcggatgggccgtcctggactttgacaactccaaacaggaatacaatctagtacgcaagggcgaagtcatattcgaggagggggtgggaaaatcagaacgcggcgagttctcaaaagcagcgtaccgaaccttctacaaaagcacccgaaaacactacttccgcagacgcctccgaaagatcgaagtcctgaaagtactcgtcaaatacgacttctgcccatacctaagcgatgatctcctcaagcaatggcacgagaagaaaatataccccgcggtgaaagagttcatggactggcagcgaacatccgacgccgaggggaaaaacccctattacgacagacactgctgcctcaacgaaaaactagacctttcacttaaatccgaccgctatgtgctcgggcgcgcactctaccaccttacccaacgacggggcttcaagagtaaccgcctcatacagaataacgatgaaaacgaagaaggtaaggtcaaaaagggaatatccgaactgtccacagagatgcaagaggccaattgcaactacctaggcgactacttctacaaactctacacggaaaagggtaacaccgtacagataagaaaaaggtacacggaccgagagaagcactacaaaaacgagttcaacgcaatctgcgaaaaacaagaactcaatgaaaccatcgtaaaagaactagacaaagcgatcttcttccaacggaaactaaagccccagcgtcacggagtgggcaaatgcacatttgaacccaacaacagacgctgcgcaatctctcacccagacttcgagaggttcaggatgttatgttttataaacaatataaagatcaaaaccccgttcgaggaaaacctccgacccctcaacaatgaagagaaagcactcatcgagccactattctaccgcaagtcaatcaagaacttcgactttgaagagatagcgaagaaactcgccgggaaaaataactattgctacattaaagacgactcatccaagcaatacaaattcaactaccgcatgtcccagggggcctccacatgccaaaccatcgccaaactcaagagcatcttcggggaagagtggaagaacggaatagccgaaacttacacaaatagacgcaagaaggaagggctcaagaaccaagccgaaatggtcgacgacatatggaacgtcctgtacagcgtcagcgagtgcgacgttctcaaagacttcgccataaacaagctccagctagatgagaaaacagcagacaacttcagcaagacaaaactcgcccaggggttcgccacactgtcgctcaaggccattcggaaaatcctgccctttctggaacagggcttcggatacacagaagccgtcttcctagccaacatccccacggtcgtcggtaaggaatactggaacaacgaagacatacgcaacgacattatggaagagataaagacaatattctatcacaacacactaaagacaaacgactcccacaacaccatcctcttctgcataaaagatatcctgtccaacaactttgacctcgcgccgggagcaatcgacaaactataccaccccagcatgataaatgtatacaaagacgtcatccccaacgaggacggaatcctacaactcggcagcccaaagatcgacgccgtcaaaaaccccatggcaatgcggagtcttcacataatccgcaaggtagtgaacgaactactccgggagggcatcatcaacagtgacacagaggtccgaatagagtacgcgcgggaactcaacgacgcgaacaagaggcacgcgatagccgactggcaaaagaaacagtacggcaaacaccagaaataccgcaaagaaattaaagaactcttcaaagccgagacaggattcgaaatcgaaccgaacgaaacggacatcctaaaattcgaactatgggaggaacagaaccacatctgcttatacaccggccaagaaataggcatatcagagtttgtaggggagaaccccaaatacgacatcgagcatacaattccccgctcgctaggaggcgactccacgaaaatgaacatgaccctctgcgaaaacaaatttaaccgagaaaacaaacaaaagaaactaccatcagaactagctaaccacagcgaaatcctagagcgcatcgacgattggaagaagaaaatctacatcctacaaaagaaatacgatagtataaggacccataacggcatggacaaagaaaacaaagacaagaaaatagtgtcacggcacaaaatcaaactcgagcttgactactggaaaggaaagtacaaccgcttcacaatgacagagataccggaaggattctccagacgccaaggaatggggatcggactcatttcacgttacgcaggcctctatctaaaaaccatcttccacaaaaaggacaacccgcagaaaagcaacgtatacatcgtcaaagggagcatcaccgcagagttcagaagaatctggaacatacaggacgattacgaaaagaaatgccgagacaaccatatacaccactgcatagacgccattgtcgtcggttgcataggcaaacgggaatacgacctgatggcacagttctaccgagatgaagaaaaataccggtgggagaaaaagaagaaaccgtttttcaaaaagccttgggagaccttcacacaagacatgctctctctaaaagacgaagtcttaacagtccacttcaatccgtcaaactttacaaagaaagcgcacaagaaagtattcacaccgaaaggcatattcgtcgcgcaaggggactgcgccagagtcaaactacacaagggatcctacttcggagccatagaacaaaagggcgagatcaaatacgtaatgaggaagaaactctcggcgctaaaaatcgaggacatcgaacacatagtcgacgccgtggtcaaagaaaaggtcctagccgtggtgaaaaagaaaggcttcaaacaagctatggcagaaccaatatacatgaacgaagacaaacgcatcctaataaagaaagtgcgcctattcgtcagccagaccaatcccctcatagtgaagaaacaccgcgacctgagttccaaagaatacaaacagaattactacgtagataacgaagggaacctcatgatcgccatgtacgaaggcgtaaagaaaaacggcaaaatcgaccgcgaaatcaccgtcgtcaacaacttagaggcagctaaattcttccgacagtcgcagaaaaacaacgcagaaaagcaactaatttcacacctcagccccaaaaacggctaccccctaaagaccgtccttacccaaaaacaactggtactcatgtacgaggattcaccgaaagaaatcaaacttcgagacaccaaaaacatggtgaaacgcctctaccaagtcttcgggattgaaaaagacggacgagtagaactcaagttccatcaagaggcccggagcgagggactcaacaagaactcagcggcctttaagatccaggacacgccagaaagcctttaccggcacaccaaaagcaacctaaaagttcttgtcaacggagttgacttcaaaatcaacatcctcggcgaaatcagtctcatttga

SEQ ID NO: 6366 - RNA, 3654 nt, synthetic construct
  misc_feature 1..3654: note = Cas9 variant
  source 1..3654: mol_type = other RNA
atgaaatacaactacgttctcggactcgatattggaatcagctccgtcggctggggactgttagcgctagacgagaataataacccgtacaagatcatagacgtaggcagccgcatcttctcacccggcgaggtcgagaaaacgggtgacagcaaggcgaaagaacgacgtgaaaaacggggcacccgccgtgtaattcgccgccgcgagtttcgcctggacagagtgcgtaacttactctacgagaaaggatacctcaagggcaacataaccagcaatatcgtatctgtcaagaacgaggaactaactatcatcttcaacgacatggtaaacaactactacaagtccaaggacaccaacccttacaaactaaaagtggaagcccttgacaggaaactcacaaatgacgagctcagcatcatcctagtccattacgccaagaaacggggctacaaaagcaaccgcgaagagagctctgataatgacaacgggaaagtcaaggaagccatcaaggaaaataccaatctcatggaggaaaagaaatatcgtacaataagcgaaatgtacatcaaaaacgaaaaattcaaaaacaagatcaaaaacgggcccgatgactacaagctgagcgtaaccaacgagatgtaccttgaagagatcaataaagtgctagatagccaaatcgggttcggcctgattgacgacaatttcaagaacgagtacttagaaatatacaacagccgcagacactacagcgaggggccaggctactactacgccaaagacgccaacggtaacaaagtcaaggtacgcagcccatacggtggcgacctaatcaagaagatgacaggcgtctgcagcttcgacaaaaaggccagagcccccaaatacgcgttctcaagcgaactcttcgtaagtatctcaaaattagtcaacctccgatacaaaatagacgatgactcctacaaacagctgacaaaggagcaaataaacgagctcatcgacgaggcgaaaaacaagaataaggtaacctataagagtctgatcaaaatcctaggcattaaaaacataaaggtcaaggacctcaacctgtcaaagagcgaatacataaaagtgatcgatgagcttaaaaagaaattaaacatatcaaaagaagaaaagatcgacatttacagcctcgacgaggaaaacaagaaaatctacgacgacatctacaacgaaaaactcttctcaaaaacactcatcgaatttaaagggtacaatctcctaaagaaagcaatcaccctaagttacaattccggaacgtggaacgacgtcaaagacaacattgagttcctggacgaacttgcgctctactgcaccgactataaagtaaacaacgaaatccaagagcacatccacaacagcctcatcatcgacagccgctttgacgactcaaatttcgtcgagaacctgccaaacttcaaagaccacctcatgctcagcacggacatcatccgcaaactcatacccatcatgctggagggcataacatatgacaaagcaatggacaaaatcggctacaatcactcgaatctctacaaggacaccattaaagaagacctcttagttccagtctacgtctccaaaaacattaccaaccagagagtaatacgcagcctaacccaggcccgcaaggtgatcaacgcaataatcaagaaatacggatcacctaaaatcatcaatattgaaacagcccgagaactggccaagacgcagaaggaacgcagaataatcgaaaagaaccaacaggacaaacaatacgaaaatgagcggatcaaaaagcacctcgtcgaactagaactattcagcgacgaatcgaaaataacaggcaacgacctactcaaatacaaactctggcaggaacaaaaggagttctgtgggtacagcatgaaaaagattaaactggaagatctattctcaaacaatatcgtccaaatcgaccacatcctaccttactcacgaacatataacgacaattacttgaacaagaccctcgtatacaccaaatacaaccaggacaagggaaataaaacgccgtacgaatggttcggaaaaacagacaaatggcaagagtacgaagccttcataaactccctaagcatcagccaaaacaagaaggacaactacctactgaagaacctcgaccaagacgcggaaagggaaatgcgcgaacaaaacctcaatgataccaaatacatcagccgagagctcctgtctttgatcaaggcttatcttaacgttgatgaggtaaacgcattccccggggcaataacggcgaaactaagggcccgctggggattcaaccgactcacacattcctatatcagcaagacgtacataatgcccgaggacatgaaaaagggcattaataaagaccgcgacaaccatctccaccacgcgatggacgccctagtcattgccagcatcacaaaatccttacaacaaaagatcacactatacgaaaagttcagccgatatgtagacggaataaccaaaaacgagctcggcaagatcagcacggggaacatcaacgatgatctctacaactactatgatgaggaaaccggcgaaataaaagaactcgaactccgccaatatattaaaaaccaggtagcacaaaacaacatttacttcagcaagcataacgtgtccaaacttatcttccccaccccttacaataacttcgtggaagaggcgaaacttcgcgtctacgagcgagatcttgaagtcctaaagtggaatctaaagaacctgggaacgtacacctcatccgaactcaaccggatacatgtactcatcccatcagtggctaaaaacaaaatctctggccggctccacgaagagacttactacggcctcaaagaagtagggattggcgaggacaaagttacctacaaaaccctgaaaacacccatcagcaaagtcaagaagaaagacctggataatattccggactgcaaaggaggctcgaaagacatctacaacgccctagtgaaatggttcgggaactgcgaaactggagaggaagcactcaagatgcacgacgggaagtatccagtgaacccaaacgacaaggaacagaaggagattcgaaaaataaaagtgtacaccaagtataacgcgaccggccacgtcgtgaacaacggcaacgtagagaagggaggaatataccgcatagatgtcttcaaaagtaaaaacaaagaggacaacaaactctactttaccagctacgacatattcgaaatagaacaaataaaggcctacgagaagggcaaaaacataaatttcagcatcaaactggaatacggccaaggaaagaacaacaaaatcctcctgtacaaagatgtcaaaaatgagtacgacttaataatgagcatctacaaaaacgacctcatccgcataaaaaccaaaaccggaaacaagtctacagcctacgtagtgggattctcaggcggcaaactcgagatcaagtccacaataggcgacggctacgacatcatcggcaataacaacatcttcgacaaatccatggaacgataccgcgtaaccagcagcaccatagtaaagatcgacaaactcagcatttcgatcctcggcgaggtcagtggactctga

SEQ ID NO: 6367 - RNA, 3657 nt, synthetic construct
  misc_feature 1..3657: note = Cas9 variant
  source 1..3657: mol_type = other RNA
atgaataagcggattctaggtcttgacacagggacaaactccctcgggtgggcggtagtggactgggacgaacacgctcagtcgtacgaacttataaaatacggcgacgtaatatttcaggaaggggtcaagatcgagaaaggaatagagagcagcaaagcggcagagagaagcggctacaaagcaatccggaagcaatactttagacggcgactgcgaaaaatccaagtactgaaggtcctcgtgaagtatcacctatgcccatacttaagcgacgatgatctgcgacaatggcatctgcagaaacaataccccaaaagcgacgaactaatgctttggcaaagaaccagcgatgaagagggaaagaacccatattacgatcgccaccgatgcctccacgagaaacttgaccttacggtcgaggcagaccgctacacactaggccgggccctatatcacctcacacagagacgggggtttctgtccaacagactagacacatccgccgacaacaaagaggacggagtagtgaaaagcggcatctcgcaactttccacagaaatggaagaggcaggatgcgaatatctcggagactacttctacaagctctaccacgaacaaggaaacaaggtgcgcatcaggcagcgatacacggaccgcaagaagcactaccaacacgagttcgatgccatatgcgaaaaacaagaactctcatcagaacttatcgaagaccttcagcgtgccatattcttccaacttcccctcaagagccagcgccacggcgtaggccgatgcacattcgaacgcggcaaaccacgctgcgcggactcacacccagactacgaagagttcagaatgctctgcttcgtcaataatatccaagtcaaaggccctcacgacctcgagctcaggccgctaacctacgaggagcgagagaaaatagaacacctattcttccgcaaaagtaaacccaacttcgacttcgaggacatcgccaaagaactagcaggcaagaaaaactacgcctggatccacgacaaagaggagcgcgcctacaaattcaactatagaatgacgcaaggcgtgcccggctgtccaaccacggcccaactaaaatcgatattcggcgacgactggaagacgggcatcgccgagacatacaccttaatacagaagaaaaacggctcaaagtcgctccaggaaatggtcgacgacgtgtggaacgtactctattcattcagcagtgtcgaaaagctcaaagagttcgcacaccacaaactgcagctagacgaagaaaacgccgaaaaattcgccaagatcaaactctcacatagcttcgctgccctctcccttaaagcgatccggaaattcctaccgttcctccgcaaaggcatgtactacacacacgccagctttttcgcaaacataccaacaatcgtgggcaaagaaatatggaacaacgagcagtcccgaaagtacatcatggagaacgttggagagctcgtcttcaactaccaacccaagcatagagacgtccaaggtactatcgaaatgctcatcaaggacttcctagccaacaacttcgagctaccggccggagcaaccgataaactctaccaccccagcatgatagaaacctacccacatgcgctccgcaacgagttcggaatactgcaactaggcagcccccgcaccaacgcaatacgaaaccccatggccatgcgaagcctacacgtgctcagacgcgtcgtaaaccaactcctaaaagaaagcatcatagacgaaaacaccgaagtccacgtagaatacgctcgtgaactaaacgacgcaaacaagcgccgcgcaatagctgaccgacaaaaagaacaagacaaacagcacaagaaatacggagacgaaatacgaaaactctacaaagaagagaccggtaaagacatcgaaccgacacaaacagacgtactaaaattccaactgtgggaggaacagaaccactattgcctttacacaggagaacaaatcggtattacggacttcatcggtagcaacccaaagttcgacatagaacacaccatcccacaatcagttggcggagactcaacacagatgaatctaaccctctgtgacaacaggttcaacagggaagtcaagaaagccaaactccctacggaattggccaaccacgaagagatcctcacgcgcatcgaaccctggaaaaacaaatacgaacagctagtaaaggaacgagacaaacaacgaacattcgcggggatggacaaagcggtcaaagacatccgcatccagaaaaggcacaaactccaaatggaaatcgactattggcgcggcaaatacgagagattcacaatgacagaagtcccggaaggcttttcgcggcgacaaggcacaggaataggtctaataagccgatacgcaggactgtacctgaagtcactattccaccaggcagactctcgcaacaagagtaacgtctacgtagtaaagggggtcgccaccgccgagttccggaaaatgtggggacttcagagcgaatacgaaaagaaatgccgcgacaaccactcacaccattgtatggatgccataaccatagcctgcataggcaaacgagaatacgacctgatggcagaatactaccacatggaagaaaccttcaggcagggccgcggaagcaaaccgaaattctcaaaaccgtgggcaacatttaccgaggacgtgctcaacatctacaagaatctcctggtcgtgcacgacacgcccaacaacatgccaaaacacacaaagaaatacgtccagaccagcaaaggaaaagtactcgcccagggtgacaccgctcggggcagcctccacctagatacctactacggggcaatagaaagggacggagagataagatacgtggtaaggagaccactcagttcattcacgaaccccaaagagcttgaaaacatcgtagacgaaacagtcaaacgaacgataaaagaagcgatcgcggacaaaaacttcaaacaggcaatagcagaacccatctacatgaacgaagacaaaggcatattaatcaagaaagtacgctgctttgcgaacagtgtcaaacaacccatcaacatccgccaacaccgagacttatccaagaaagagtacaaacaacaataccacgtcatgaatgaaaacaattacctgctagcgatttacgagggcttagtcaaaaacaaagtcgtcagggagttcgaaatagtatcgtacatagaagccgccaaatactacaaaagatcccaagacagaaacatcttcagcagcatcgtaccaacacactcgaccaagtacgggttaccccttaaaacaaaactactcatgggccaacaagtccttatgttcgaagaaaatccagacgaaatccaggtagacaacaccaaagacctcgtaaaacgcttatataaggtcgtcgggatcgagaaagacggccgcatcaagttcaagcaccaccaggaagcccgaaaagaggggctcactatctacagcactccgtacaaaaacaacgacgactacgtccccattttccgacaatcaatcaaaaacataaatatcctagtagacggcatcgacttcaatatagatatcctcgggaaagtaacgctcaaggagtga

SEQ ID NO: 6368 - RNA, 3657 nt, synthetic construct
  misc_feature 1..3657: note = Cas9 variant
  source 1..3657: mol_type = other RNA
atgaacaaaagaatactcggcctagacactggaactaactcactaggatgggccgtcgtcgactgggacgagcacgcgcaatcttacgaactaatcaaatacggcgacgtcatattccaggaaggagtgaaaatagagaaaggaatcgagtccagcaaggcagcagaacgcagtggatacaaagccatcagaaagcaatacttccgaagacggctgcgaaagatccaggtcctaaaagtcctcgtgaaataccacctctgcccctacctatcagacgacgaccttcgccaatggcacctccaaaaacagtaccccaaaagcgacgagctcatgctgtggcaacgaacatcagacgaagagggcaagaatccgtattacgaccgacaccgctgcctccacgagaaattggacctcaccgtcgaagccgaccgttatacactcggccgagccctctaccacctaacccagcgccgcgggttcctatcaaaccgactagacacgagtgcagacaacaaagaagacggcgttgtcaaaagcgggataagccaactcagtaccgaaatggaagaggctggttgcgaatacctcggagattacttctacaaactctacgacgcccaaggaaacaaagtacgaataagacaaagatacacagacaggaacaaacactaccaacacgaatttgacgcgatctgcgaaaaacaagaactgtcgtccgaattaatagaagacctccaacgcgcaatcttcttccaactacccctcaagagccaaagacacggggtcggccgctgcacattcgaaagagggaaacccagatgcgccgactcacaccccgactacgaagagttcaggatgctctgcttcgtcaacaacatccaagtcaagggaccccacgacttagaactccgcccactaacctatgaagaaagagaaaagatcgaaccgctatttttccgaaagagcaaaccaaacttcgacttcgaggatatcgcgaaagcgctagccggcaagaaaaactacgcctggatacatgacaaagaagaacgcgcctacaaatttaactatcgcatgacgcagggcgtcccaggttgcccgaccatcgcccagctaaaaagcatattcggagacgactggaaaacaggcatcgccgagacgtacaccctgatacagaaaaagaacggctctaaatccctgcaagaaatggtcgacgacgtatggaacgtactttactccttctcgtccgtggaaaaactcaaggagttcgcccaccacaaactccaactcgacgaagaatccgcagaaaaattcgccaagatcaaactctcacactcattcgccgccctatctctcaaagcaattcggaaattcctccccttcctccgaaaagggatgtactacacccacgcatcattctttgccaacatacctaccatcgtgggaaaagaaatatggaacaaagaacaaaaccgaaagtacatcatggaaaacgtaggcgagctggtcttcaactaccaacccaagcaccgggaagtccagggaacaatagagatgctaataaaagactttcttgccaacaacttcgaactcccagccggagcaaccgacaaactatatcacccaagcatgatcgaaacctatccaaacgcccaacggaacgagttcggcatactacagttgggctcaccccgaacaaacgcgattcgaaacccaatggccatgcgctccctacacatcctacgcagggtcgtcaaccagctactaaaggaatcaataatagacgaaaataccgaagtccacgttgaatacgcacgcgagttgaacgacgccaacaagcgacgagcaatcgcagaccgccaaaaagagcaggataagcaacataaaaagtacggagacgaaatacggaaactctataaagaagaaaccggcaaggacatcgaacccacccagacagacgttctcaagttccaactttgggaggagcaaaaccatcactgcctctacacaggcgaacagataggcataacagacttcattggctcgaaccctaaattcgacatcgaacacacaataccacaatcagttggcggcgatagcacccagatgaacctgaccctctgcgataacagattcaacagggaagtcaagaaagcgaaactccccacggaacttgccaaccacgaagaaatcctgacccgcatagagccctggaaaaacaaatacgagcagcttgtaaaagaacgcgacaaacagcgcactttcgccggtatggataaagccgtaaaggacatcagaatccaaaagcggcacaagctgcagatggagatcgactactggcgcggcaagtacgagcgatttacaatgaccgaagtgccggaaggctttagccgacgccaaggcactggaatcggcctgatctcgcgatacgcgggtctctacctaaaatctctcttccaccaagcagactcgcgaaacaaaagtaacgtctacgtagttaaaggcgtcgcgaccgccgagttccgcaaaatgtggggcctgcaatcagaatacgagaaaaagtgccgagacaaccacagccaccactgtatggacgcaataacaatcgcttgtataggaaagagagaatacgatctaatggccgaatactaccgcatggaagaaacgttcaagcagggccgcgggagtaaacccaaattcagcaaaccgtgggccactttcacagaagatgtactcaacatctacaaaaacctcctggtagtccatgacaccccgaataacatgccgaaacacacaaagaaatacgtacagaccagcataggcaaagtattagcacagggagacaccgcaagaggcagcctccacttagacacctactacggcgccatagaaagagacggcgagatacgctacgtcgtcagacgcccgttaagctcattcacaaaaccggaggaacttgaaaacattgtcgacgagactgtcaaacgcacaatcaaagaagcaatcgcggacaaaaacttcaaacaggcaatagccgaaccaatctacatgaacgaagaaaaagggatactcatcaaaaaggtcagatgcttcgcaaaatccgtaaaacaaccaataaacatacgacaacaccgagacctatcaaagaaagaatacaaacaacaataccacgtcatgaatgaaaacaactacctcctcgcgatctacgaaggacttgtcaaaaacaaagtagtacgagagttcgaaatcgtaagctatatcgaagcggcaaaatattacaaacgatcacaagaccgtaacatcttcagctccatcgtgcctacccacagtacgaaatacggactacccctcaagactaaactactaatgggccaactcgtcctcatgttcgaggaaaacccagacgaaatccaagtcgacaacaccaaggacctcgtcaaaaggctatacaaggtcgtaggcatagaaaaggacgggaggatcaaattcaaataccaccaagaagcacgcaaggagggactgcccatcttctccacaccgtacaaaaacaacgacgactatgccccaatcttccggcaaagcatcaacaacatcaacattctcgtggacggaatagatttcaccatcgacatcctaggcaaagtcaccctgaaagagtga

SEQ ID NO: 6369 - RNA, 3657 nt, synthetic construct
  misc_feature 1..3657: note = Cas9 variant
  source 1..3657: mol_type = other RNA
atgaataaacgaatattagggctagacaccggcacaaacagtctaggatgggccgtggtggattgggatgaacacgcccagtcgtacgagttcataaagtacggcgacgtgatcttccaggaaggggtgaaaattgaaaaaggcatagaatcctcaaaagcggcagaacgctccggatacaaagcgatacgcaaacagtactttcggagacgactgcgaaaaatccaagtgctcaaggtccttgtcaaataccacctgtgcccttacctatcggacgacgatctccgacaatggcatctgcaaaaacagtaccccaagagcgacgaactgatgctctggcaaagaacgtccgataaaaagggcaagaacccgtactacgataggcacaggtgccttcacgaaaaactagacttaaccgtagaagcagaccgctataccctaggccgcgctctataccacctgacgcagcggcgaggcttcctcagcaatagactcgacacgagcgcagacaacaaagaagacggagtagtgaaaagtggaattagccagctcagcaccgagatggaggaagccggctgcgagtacctcggggactacttctacaaactctacgacgagcaaggcaacaaggtaaggatccggcagcgctacaccgaccgaaacaaacactatcaacacgagttcgatgcgatctgcgaaaaacaagagctcagcagcgagctgatcgaagacctccagcgcgcaatcttctttcagctccccctaaagtcgcaacgtcacggcgtcgggcgctgcacctttgaacgcggcaaaccccgatgcgccgactcccacccggactacgaggagttcagaatgctgtgtttcgtaaacaacatccaggtaaagggaccccacgacttagaactaaggccactgacttacgaagaacgagaaaagatagaacccctcttcttccgcaaatctaaaccgaacttcgacttcgaagacatcgccaaggccctagccgggaaaaagaactatgcctggatccacgataaagaagaacgagcctacaagtttaactaccgcatgactcagggagtaccaggctgcccaaccacagcacaactcaagtcaatcttcggggacgactggaaaacaggaatagcggaaacatacacgctgatccaaaagaaaaacggctcaaaatccctacaagaaatggaagatgacgtctggaacgtgctatactccttctcgtccgtcgaaaaactcaaagagttcgcacaccacaaactacaactagacgaagaatccgccgagaagttcgcaaaaatcaaactaagccacagtttcgccgctctttccctcaaagcaataagaaaatttcttcccttcctgcgtaaaggcatgtactatacacacgccagcttcttcgcaaacatccctaccatcgtaggcaaagaaatatggaataacgagcaaaaccgaaaatacatcatggaaaacgtaggggaacttgtattcaactaccagcccaaacaccgggaggtccaaggaacgatagaaatgctcataaaagacttccttgcaaataacttcgaattaccagcaggagcgacagataaattatatcacccgtccatgatagaaacctacccacacgcccagcgtaatgagttcggcatcctacaactaggatcaccacgcaccaacgcaatccgcaaccctatggcaatgagaagcctccacatattacggcgcgttgtaaaccaactcctgaaagaatcgatcatcgacgaaaatacagaagtccacgtcgaatatgcgcgagaactaaatgatgccaacaaacggagagcgatcgcgggatggcaaaaagagcaagataagcaacacaagaaatacgtagacgaaataagaaaactatataaggaagaaaccggaaaagacatagagcctacccaaaccgatgtcctaaaattccagttatgggaagaacaagaccaccattgcctgtacacaggcgaacagattggcatcaccgacttcatcggttccaacccgaaattcgacatcgaacacacaatcccacaatcggttggaggcgacagcacacaaatgaacctaaccctttgcgacaaccgcttcaaccgtgaaattaaaaaggcaaaactaccagcgcaactcagcaaccatgaagagatactcgcaaggatagaaccctggaaaaacaaatacgaacagaaaatcaaggaacgcgacaaacagcgcacctttgccggcatggacaaagcggtgaaagacctaagaatacagaaaagacacaagctccaaatggacatagattactggcgaggcaaatacgagcgcttcaccatgacagaagtcccagaaggcttttcccgtcgacaaggaacaggcatcggcttaataagcaggtacgccggcctttacctcaagtcccttttccaccaagctgacagccgaaacaagagtaacgtgtatgtagtgaagggggtcgcaactgctgagttccgcaagatgtggggcttgcaaagcgagtacgaaaagaaatgccgcgacaaccactcacaccactgtatggacgccataacaatagcatgcataggcaaacgggagtacgacctcatggccgaatactaccgaatggaggaaaccttccggcaaggccgcggtagtaaacccaaattcagcaaaccctgggcaacattcacagaagatgtgctaaacatctacaaaaacctcctcgtggtccacgacacgcccaacaacatgcccaaacacacaaagaaatacgtccaaaccagtaaaggaaaagtcttagctcaaggcgacacagcgcgcggatcgctccacctagacacctactacggagccatcgagagagatggcgagatccgatacgtagtccgcaggccgctaagcagcttcacaaaacctaaagaactggaaaacatagtcgacgagaccgtcaagaggaccattaaagaagccatcgccgacaaaaacttcaaacaagcaatagcggaacccatatacatgaatgaagacaaaggcattctaatcaagaaagtacgatgcttcgctaaaagcgtcaagcaacccatcaacatacgccaacaccgcgatctaagcaagaaagaatacaaacaacaataccacgtcgtaaacgagaacaactacatgctggtaatctacgaaggactggtcaaaaacaaagtagtccgcgagttcgaaatcgtgagctacatcgaagctgccaaatactacaaacgatcccaggacaggaacatcttctctagcatagtccctacccattcagcaaaatacggactcccactcaagaccaaactcctcatgggacagctagtgctcatgttcgaagaaaaccccgacgaaatccaagtcgacaacaccaaagacctggtaaaacgattgtacaaggtagtcggaatcaaaaaggatggacgagtaaaattcaaattccaccaagaagctcggaaggatggacttctcatatttagcacaccctacaagaacaataacggctacgtccccatattccgccactccaagaaaaacataaacatcctagttgacggcaaagactttacgatagatatactcgggaaagtgactctgaaagagtga

SEQ ID NO: 6370 - RNA, 3660 nt, synthetic construct
  misc_feature 1..3660: note = Cas9 variant
  source 1..3660: mol_type = other RNA
atgaaagaggaagtaagaggtaagaaccgctcacagacttgggccatcctggcaaaattcttcgtctggagcgaaaaggaaagcgtgtggaatgagaaagaagcgcggacagaagagagagtaaaagaatacaagctagtcggcctcaaacgcgacaccaaaggcaacgagctgaagctagagaattacaggtggcgggtacaggcactaagcgaacagctcaacccggagatagtcgcgatcgtcctacaagaaatcaacggacagatcagtgcctcgagcggatacctcggcgccatcagcgacagatccaaacaattgtatttcaacaggcaaaccgtcggccaatacctaatgtcggaactggaaaaggatccgaacgtctccctgagaaacagagtattctatcgccaggactacctcgacgagtttgaccgcatatgggagaagcaagccgagttccacgaagaactcaccgtcgaactcaagaaagaaatccgagacataataatcttctaccaacgccgcctcaagtcccaaaaaggcctgatatccttctgcgagttcgagaaacgagaagttgtagtcgaggaagacggacggaagaaaaacaaaaccgtcggctgcagagtaatcccacggtcacaccccttattccaagagttcaaaatctggcaaacattgaacgacatcgaagtcttcgcgtgggacaagcagagcaaaagaaagaaagccgacaagtcctctatcctgttcgacaactcagaagacgccctcctcgtcgaagggaaacgttttctctaccaggaggagaaggagctactagccaaagaattattcgtaaaagaaagcatgaagaaagcagaagtgttaaagctgctattcgaaaactatcaggagctagacctaaacttcaagcagattgacggtaaccacaccggcttcgccctattcagcgcctacagtaagatgatcgagaagtacggatacgaacccgtcgacttcaagcgatcggccgacgaaatcatagaaaaactcgaaaccatatttacgaacctagggtggaacacagaactactctcaatcgacctctcaaaagaagacaaggaattagagagacagtcatacttccgcttatggcacctactatactcgtttgaaggggacaacacccccacaggaaacggcaaactcctagaaaagatcatgcaactttgcgacgtagagaaagaatacgcggtagaactagcgaacgtgagcttccaagaggactacggctcgctaagcgcgaaggccatcaagaaaatcctaccgtacctgaaagaaggaaaccaatacgacgtagcctgcgactacgcaggctaccgccacagcagatcgtctctcacgaaagatgagatcgaaaacaaaatactaaaagacaaactcgaaattctacccaagaactccctccggaatcccgtagtggagaaaatactgaaccaaatggtcaatctcattaacaccctcatcgacacatacggcaagcccgacgaaatacgcgttgaactcgcacgcgaattaaagaaaaacgcaaaagaaagagaggaactcacaaagagcatagcccgcaacacacgcgagcacgacgaaatccgccagctcctccgtaccgagttcgggatgatgaacgtcagccgcaacgacataatccgttacaagctatacgaggaacttaaagacaacggctacaaaaccctatactcaaatgaatatatcccgcgagagaaaatcttcagcaaagaaatcgacatagagcacgtaatcccacaagcacgtctatttgatgactctctctcaaacaagacactggaataccgagcgataaacatcgagaaggggaataaaaccgcgtacgacttcgtcaaagagaaatacggaaacgacggacttgagaagtttctcaaccgatgcgaaaccctcttcaaagacaaaagaaccaagctacgaaaactaaagatggaagagaaggacatacccgaaggttttatcgaccgggacctgaggaatacgcaatacatctcaaagaaagcattcgccatgctaaacgagataagccgccgagtagtagcgaccactggcagcataaccgataaattacgcgaagattggcagctagtagacctgatgaaagaactgaacctcccaaaatatgagaaactggggatggtcgaaatgttcgaagacaaagacggtcgcaagatcaagaaaatcaccgactggacgaaaagaaacgaccaccgccatcatgcggtagacgccctaaccgtagccttcaccaaagacgtattcatccaattctacaacaacaaaaacgccgcttggatgcccgcgagcaaagaacacgcaaatataacggggatcaaggccaggtacttcgagaacgggaaagcactagctcccatgcctctagcacagttccgcgccgaagccaaacgtcacctcgagaacttactcgtaagtatcaaggcgaaaaataaagtaatcacaagcaatgttaaccgcaccaaaaacaagaacggagaaaaccggaaactgcaacaaacaccccgtggacagctacacttagaaacggtttacggctcacaccgccagtacgccactaaaatagagaaggtcaacgccgccttcgacgtaacaaagatcgccactgtgagcaagctagcctatcgaaacgcactgctaaagcggctcgaggccttcgggaacgatcccaaaaaggctttcactggcaaaaacacgctagagaaaaacccactgtacctagacgaaaaccaaacagaaatggtcccagaaaaggtgcaaacagtcgagttcgagacagtgtacactatacgcaaacccatagaccccaacctctcgatcgacaaagtcgtcgacgtcaaaataagaagtgtgctcgagaagcgcctaaaggaatacggaggcgacgcgaagaaggccttcgttaatctcgacgaaaaccccatatggctcaacgaagccaaaggaataagcataaaacgggtttccatccgaggcataagcaacgctcagagcctccacgaaaagaaagacaaagacggcaacctcatactagggaaagagggcagaaaaataccagtggacttcgtaaacacgggaaataaccaccacgtggccatctacaagaaacccgtcctggacaaagtcggacaggtagtcctagacgaagagggaaaccccaagtacgagctagacgaagtcgtggtatcattcttcgacgcagtcacacgcgcgaacctaggccaaccaatcatcgacaaagactacagaagaagcgaaggttggcaattcctcttttcgatgaaacaaaacgaatatttcgttttcccaaacgacaaaaccggatttaaccccaaagaagtcgacctgttaaacccagaaaactacgcactgataagccccaatctcttccgagtgcaaaaattcgcctacaaaaattacgtattcagacaccacctagaaaccacaatcaaagacacctcctcgacgctgaaaggcatcacctggacagactttcgctcatcgaagggactggacaaaatcgtaaaagtgcgtgtcgaccacataggacaaatcgtctccatcggcgagtactga

SEQ ID NO: 6371 - RNA, 3663 nt, synthetic construct
  misc_feature 1..3663: note = Cas9 variant
  source 1..3663: mol_type = other RNA
atgaaacgaatactgggccttgacctcgggagtgcgagcatcggctgggcgctcatagaagaagacgaaaaaggcatccggatcatcgcgctagggtcacgtatcataccatacaacggaaccgagggacaagacttcgccaaaggggcgggtgaatcacgtaacagcttgcgaacccaggcccgaacgacccgcaaaggctacgaccgctaccaactacgaagaaaatacctcatcaacgtactcgagaaaaacctgatgatgccctccgaagacctgcgcaagatgccgaagatgaatctatggcagctacgatccaaagcggtgaccgaatacataagcagacaagaactgggacgcctcctcctatggctgaaccaaaaacgagggtacaagtcttccagaagcgacgctaatctggacaaaaaggacaccgactacgtgaaggaagtgaaaagccgattcgacaaaatcaaagagaaaaatcaaactatcggccaatacttttacgagagcttacaatgcgacgaatacttccgagtcaaagaaaacgtcttcccgcgcgaagcatacattgcagagttcgacgcaatctgctcccgacaaaaagaccacctcggcctctccgaagaattaatcgcagagatccgaaacgaaataatctactaccagaggccactaaaatcacaaaaaggccttgtaagtgtctacgacttcgaaggaaaatggatgaaccaaaacggcaaagaactcttcataggtcccaaagtagcccacaagagcagccccttattccagcttgccaaaatatgggaaagcgtgaacaacatcaaactcagcaccaaatacggagacactatcgagctaaccctcgaggaaaagaaacaactcgtagagttcctcgataacaacgaaaagctcaccacggccgcactcttcaagatactgcgaaaggacaagaaagaatacatactacccaaacagctagagaagggcctacaaggaaacatcaccaaatgcaaaatcgcagacatcctaggaagtaaatataaccaactactacaattgaacctcgagaaacaggaagtgggaaccccatgctacctatacactaagagcacgggcgaggtcctcggcgaaaagccactacaatacatcgacaagtccgtggagaaggaactcttctatcaactgtggcacaccatctacagcatcagcgacgaggacgagtgctgcaaagccctgcagaaacgcttcgacatagacgccgaaacagctggacgtctagccaaaatcgacttcagcaagtacggattcggcaataagtccgccaaagccattcgaaaaatccttccctacctgatggaaggcgacaagtacagcgacgccatgtgctacgccggctacaaccacagtaacagcttgaccaaggaagaaaaccatgagcgcaaattaaacgacaaactgaagctcctaacgaagaactcactccgacagcccatagtcgagaagatcatgaaccaaatgatacagctagtaaacacaataattgacaagtacgggaaacccgacgaaatacgcctggaactcgcccgcgagctcaaacaatcaaaagaagagagaaacgacgccgacaaagccatgtcaaaacgacaaagggaaaacaaagaagcagaaaagaaactcgaggaacacggaatacgggccacgcacaacaatatactaaaataccgactgttcgaggaaatgggcgagaaaaagcacgaagccatatgcatctactgcggaaaccccatcagctttagcgcagccatgaatggtgacgaagtagacgtcgagcacatcatcccccgcagtaaactcttcgacgactcgcaatcaaacaagaccctcgcacacaggaagtgcaacgcaaacaaaaacgacatgactgcctacgacttcatgaagacgaaatctaagcaagacttcgataaatacgtcgaacgagtcaaccaactctacgccgacagaataatctcaaggtcgaaatacaacaaattactaatgtcggaagacgacatcccgagcaacttcatagacaggcaactacgcgaatcccaatacatcgcaacaaaagcacgagaaatcctacaaacgatctgctacaacgtatggagcaccagtggcacagtcacagccgaactgcgccacctctggggctgggacgacataacaatgaacctccaaatgccgaaatataaagagctggggctaaccgaaatggtggaatggacctccgaccatggcaaaaacgtacactccaaagaagtaatcaagggctggaccaagcgggacgatcaccgccaccacgcaatcgacgctctaaccatagcgtgcacaaagcaaggcttcatccaacgattcaacaccctcagctccagtaaaactagagatgacatgcagaaggaactggaaaagtgctcaatacaattccgggagaaacgcagcttactcgagaaatacatcatctcccaacgacccatcagcgtctccgacgtcgccgaggccgtcagcaggatcctcatctccttcaaggcaggaaagaaagtcgctacaataggaaagcggaaagtcaaggggaaagtcgtacagcaaggcatagtcgtgccccgcggcgcacttagcgaaggttcagtgtacggcaaaatacgcacaatcgtgcgaaagatgcccgtcaagtacctcttcgagaacccggacctcatattcaagccctacataaaagccctagtgaaagaacgcctagccgagttcgacaacgacaacaaacaagcattagcatccctaaagaaaaaccccgtttacctcgacaaagaaaagacaaagctcctggaatacggaacctgctttaaagacgaatacgtgaagaagtacgacgtcaacccgaacttcacgaaaatcgcagatgttattgacggcaaggtaaagcaaatcctagaagaccgcctgagcaagttcggagggaaacccaaagaggctttcaaggacgtggttaaggacggcaaaacgctaaaatggtacgaggacgagggcctggagcgtcctatccgtagtgtgcgttgcctcacgggactatcagcagtagtcccggtaaagaaagacgagaacgggatggacataggattcgtcaaacccggcaacaaccaccacgtagcaatctacgtcggcgccgacggaaaaggtcaggagcacgtctgcaccttctggaatgcagtagaaaggaagaaatacggactcccaatcatcataaaagatgctaacgaggtatgggacaaaataacgatggctggggacgacgtctacccccagagcttcctcagtctcctccccaagccagactggaccctcaaacttagcatgcaacagaacgaaatgttcattctggggatggaagaggacgaggtcaagttcgccatcgaatccaaagattacaaactactaagtgaccacctgtacagggtgcaaaagctgagctcgagcgactacaacttcatccaccacctggaaacggacgttcagaagaaaaccatgacctaccgtgtccggtcgctatcgggcctgttcgcgctccgccccttcaaagtccgcatagattgcctagggaatataatacccagctga

SEQ ID NO: 6372 - RNA, 3669 nt, synthetic construct
  misc_feature 1..3669: note = Cas9 variant
  source 1..3669: mol_type = other RNA
atgaaaaagaggatactaggcctcgactccggaacaaactccctaggctgggccgtagtagaccgcgacgaaaacaaccaatactcgctcataaagtacggagatctcatcttcgaggaaggcgtgaaaatcgagaaaggtgtggaatcctcaaaagccgcagagcgcactagccaccgagccctccgtaagctatatttcagacgacgcctaagaaagatcgaagtactaaaagtcctcgtcaaatacaacctatgcccccaagtctcagaggaagaactacacctctggcacacaagaaagctgtacccacaaaacaaggacctactccaatggcaacgcacagacgaaaaagccgggaagaacccgtacatataccgctacagatgcctccacgaagaactcgacatgagcgtcagtgccaatagaatgacagtgggacgcgcgatgtaccacctggcccaacgccggggctttctgtcaaaccgcctcgacaacgaggaagacgaaaaccaaatcggtgcggtcaaatgcgggatcagtaacctcaccgaggaaatccaatcaagcgggtgcaaatacctaggagagtatttctacaaactctacaacgaacacggcaacaccgttagactgcgcacccgctacaccagccgcgagttccactacaagaaagagttctacgccatctgcgaaaaacaaaaactcgacaaaaagctcatcgaagaactggcatccgccctatacttccaacgccctttgaagtcccaacgccacacagtcggaaggtgcaccttcgaaccaaacaaaccacgatgcgccgactcacacccggcgtacgaagagttccgaatgctctcgttcatcaacacaatcaaagtccagggcccctacgatacagaacttcgcgttctaaacacagaagaacgcgactccataacaaaactattctgccgcaaaagtaaacccaacttcgacttcgaagacatcgcaaaagagctggccggcagaaacaactactgctacatcggagacgtcgtcgacaaagcatacaaattcaactatcggatgagccagggcgtcagcggctgcccaaccaccacctatctcataaacgtattcggacaagactggcaaacaggaatcgcagaaagctaccaagccatcgacacaaagctgggccaaaaatccgtagacgccatgatagacgacgtctggaacgtcctctactccttctcgtcaaaggacaaactccgcgacttcggccgcaagaaactccaactgggggataaagaggctgacacattcgctaacataaagctgacccacaaattcgcttcactttccctcaaagctataagaaaaataaacatattcctgcgcatgggcctcgtatacagccacgcagtgacactcgctaatataccaaccatcgtaggcacagacatctggcaacgcaagcgaaacttcatactcgcggagctcctgccactaatcgaaaacttcaaccctaaagagacaaaactgcaagaaaccctagatttctgcgtaaaagacttccttcaaaacaacttcgagctgaaaaacggggccgtggacaaactataccaccctagcatgatagaagcatacccagacgcgggcctgaacagcaatggcatactgcaactcggtagccctagaaccaacgccatcaggaaccccatggcaatgcgcagcctccacgaaatccggaaagtaatcaatcagttactcaaagacaaaataataaaccaagacaccgagatccacgtagaatacgcccgcgagctcaacgacgcaaataaacgaaaagccataagcatatggcagaaatcacaagaaaagctgcacaagaaatacgtcgaagagatcacgaacctatacaaagaggagaccggaaaagcaatcgtgccaacagatacggacatactcaagttcaaactctgggaggagcagaaccacatctgcctctacacaggacagcagataggcatagccgagttcctaggtgcaacgccaaagtacgatatagaacatacgataccgcagtcagtcggcggcgactccacggatatgaacctaaccctctgcgactcaagattcaaccgcgaaatcaagaaagcgcaattgcccacacagctcggtaaccacgcggacatacttgtccgcatcgctggctggaaaaacagctacgaaaaactaagcaaagacatagaccgaatacgcacccatagcggaatggcgaaagacataaaggatcgcctaatacagaaacgccacctcctcaagctcgaaagggactactggcgcggcaaatacgaacgattcaccatgaatgaaataccagaggggttcagccgaagacaaggagttggcatcggcctaatcagcaagtacgccggcctttacctgaaatccctctttcacgacaagaacgaacgcaacaaaggacacgtgttcgtcgtgaaggggacaaccaccgcagagttcagaaaaatgtggggactacaaaacgaatacgaaaagaaatcacgtaacaaccatgtccaccactgcatcgacgcgatcacaattgcgtgcatcgggaaacacgaatacgcacaaatggcgcaatactatcacgacgaagcagaatatctctaccaccacggcataaaacccatcttcccgaaaccctggaaaaccttcacggaagatctcctagacctcgaacactcactcttcgtcgtccaccactcacccaacaacatggccaagcaagcacgcaaacggattataacttcaactggacagcactgggcgcaaggggactccgcacacggctcactacacaacgacacctactacggcgcaatagaacgagacggcgaaatcaaatatgtagtgaggcgggccgtgagctcattcgaacaaatgagcgacgtcgacagcattgtagacgacgtggttaaggaaaccgtcagaaaggcacttgagggcaaaaacttcaaggaagccgtcaacgccccaatatacatgaacaaagagaagggagttttaatcaaaaaggtacgctgctacgccaaatccataaagaaacccatagacatacgtacgcacagagactcatcctcaaaagaatacaaacgcaaattccacgtatccaacgacatcaactatctcatagccatctacgaaggcacagtcaaaggaaaagtcaaacgggacttcgaagtcgtgaaaaacatcgaagcagctaactttttcaaacgatcccaagaccgccgcgattaccctaccatcgtccccgagaaatccatcaaacacggtttccccctcaaaaccaccctgaccaatggaaccatggttatactctatgaggaaaacaaagaagaaatagacttcaccaagaaagaggacatatgtcgcagactatataaattggtcggaatgagttctatgatagtgtccggatgcgagtacggggtgctgtcgctccggcaccatcaagaagcccgccccagtaaggacatcaagtccaaaaacggagcattcaaaaacggagaagcgctccgaccagcaattacgatgctacacacccagttcaacgcactggtagagaacattgactttaacatagacgtcaccggcaacatcgagctcatatga

SEQ ID NO: 6373 - RNA, 3669 nt, synthetic construct
  misc_feature 1..3669: note = Cas9 variant
  source 1..3669: mol_type = other RNA
atgaagaaaagaatcctaggactagactcgggcacgaacagcctcggctgggccgtcgtcgacagagacgaaaacaaccagtattcactaatcaagtatggggaccttatcttcgaagaaggagtcaagatagaaaaaggggtcgaaagtagcaaggccgccgaacgcacctcccatcgagccctcaggaaactttacttccgacgccgactacgaaaaatcgaagtgctcaaagtgctagtaaaatacaacctctgcccccaagtaagcgaagaagaactacacttatggcatacgagaaaactctacccacaaaacaaggacctactccagtggcagagaactgacgaaaaggagggcaaaaacccctacatataccgctacagatgcctccacgaggaactcgacatgagcgtatcggcgaaccgaatgaccgtaggacgcgcaatgtaccacttagcccaacgccgaggcttccttagcaacagattagacaacgaagaggacgaaaatcaaataggagcagtgaaatgcggaatctcaaatctaaccgaagagatacaatcaagcggctgcaaatacctcggcgaatacttctacaaactatacaatgaacacggcaacaccgtccgccttcgtacacgatacacgtcacgagagttccactacaagaaagagttctacgccatctgcgaaaaacaaaaactggacaaaaagctcatcgaagaactagcctccgccctctacttccaacgacctctgaaaagccagcgacacactgtaggccgttgcacattcgagcccaacaagccacgatgcgccgactcccatcccgcctacgaagagttccgaatgctatcattcataaacaccatcaaagtccaaggcccatatgacaccgaactccgggtactcaacacggaagaaagagactccataacgaagctattctgccgcaaaagcaagcccaacttcgatttcgaagacatcgccaaagaactggccggacgaaacaattattgctacatcggagacgtcgtagacaaagcatacaaattcaactaccgaatgagccagggcgtgagcggctgcccgacaactacatacctcatcaacgttttcggccaggactggcaaaccggcatcgcagaaagctaccaagccatcgacacaaaactaggccagaagtctgtagacgcaatgatcgacgacgtctggaacgtcctatacagcttctccagcaaagacaaactccgggacttcggccgaaagaaactccaactcggcgataaagaagccgacacattcgccaacataaaactgacacacaaattcgcgtccctcagcctcaaagcaatacgcaaaatcaacatattcctcaggatgggcctagtgtatagccacgcagtcacactcgccaacataccgacaatagtgggaacagacatatggcaacgcaaacgcaacttcatactcgcagagttactgccgctaattgagaacttcaaccccaaagaaacaaagctccaagagacacttgacttttgcgtcaaagactttctacagaacaacttcgaactcaaaaacggcgcagtagacaaactctaccatccctcaatgatcgaagcctatcccgacgcaggcctcaactccaacggaatcctccaacttggaagcccgagaacaaacgccatccgcaaccccatggctatgaggagtctacacgagatacgcaaagtaatcaaccaactgctgaaagacaaaatcatcaaccaggacacagagatacatgtggagtacgccagagaactcaacgatgccaacaaacgaaaggcaatttccatatggcaaaaatcccaagagaagctacacaagaaatacgtcgaagaaatcacgaacctatataaagaagaaacgggaaaagcaatcgtaccaaccgacacagacatcctgaaattcaaactctgggaggaacaaaatcacatatgcctatacaccgggcagcagatagggatagccgagtttctaggggcaaccccaaaatacgacatagagcacaccattccccaaagcgtcggcggtgacagtacagatatgaacctaacactctgcgattcccgattcaacagggaaatcaaaaaggcacagctgccgacacaacttggcaaccacgcagacattctagtacgcatagccggctggaagaatagctacgaaaaactcagcaaagacatagaccgcatccgcacacacagcggcatggcgaaagacattaaagatagactcatacagaaaagacacctactcaaacttgagagggactattggagaggcaaatacgagaggttcactatgaacgagatacccgagggattctcccgccggcaaggagttggcatcgggctgatatccaaatacgcaggcttgtacctaaaaagtctgttccacgacaagaacgaacgaaacaaaggacacgtgttcgtcgtcaaaggcacgaccaccgccgagttccggaaaatgtggggcctacaaaacgaatacgaaaagaaatcccgtaacaaccatgtacaccactgcatagacgcaataaccatcgcctgcattgggaaacatgaatacgcacaaatggcacaatactaccacgacgaagccgaatacctctatcaccacggaattaaaccaatcttccccaaaccctggaagacattcacagaagacctcttagacctggagcacagcttgttcgtggtccaccacagccccaacaacatggcaaagcaagccaggaaacgcattatcaccagtaccggccaacactgggcacagggagattcagcccacggctcccttcacaacgacacctactacggcgcaatcgagcgagacggagaaataaagtacgtggtccgcagggccgtcagctcattcgaacagatgagcgacgtcgacagcatcgtagacgacgtagtaaaggaaacggtccgaaaggcgctggagggtaagaacttcaaggaagcggtaaacgcccccatttacatgaacaaagaaaaaggagttctaataaagaaagtacggtgctatgcaaaaagcatcaagaaaccgatagacatccgcacgcaccgagatagcagctctaaagaatacaagagaaagttccatgtctcaaatgacatcaactacttgattgcaatatacgaaggcaccgtaaaagggaaagtcaaacgagactttgaagtggtcaagaacattgaagccgcgaatttcttcaaacgctcgcaagaccgacgcgattaccccaccattgtgccagaaaaatcgatcaaacacggtttcccactcaagacgaccctaacaaacggaaccatggtaatcctttacgaagagaacaaggaagaaatagacttcaccaagaaagaagacatctgcagacgcctatacaaattagtaggcatgtcatccatgatagtaagtggatgcgagtacggagttctctcgctccgccaccaccaggaggccagaccaagtaaagacataaaaagcaaaaacggagcattcaaaaacggagaagcgctacggcccgcaatcactatgctacatacacaatttaacgccctcgtcgaaaacatagacttcaacatagacgtcacaggaaacatagaattgatctga

SEQ ID NO: 6374 - RNA, 3678 nt, synthetic construct
  misc_feature 1..3678: note = Cas9 variant
  source 1..3678: mol_type = other RNA
atgtcaaaacgaatcctgggtatagacgtcggcaccaacagcctaggatgggccgtagtagaccgaacggactgcgacaactacacccttgtaaagcgcggcgacgtaatattccaggagggggtaaacatcgaaaaaggcaacatcgagaaaagtcgcgccagcgaacgcaccggccaccgttctacgagaaaacactacttcagacgccgcatgctcaagataaaagtcctagaaatcctggtagaacaccagctatgcccctacctatcacacgaggaactccaccagtggatgacacgaaaagtctacccaaccaacgaagattttcgactatggttgcgcacaaacgacgccaacgaccaaaacccctaccacgaccgccacgtttgccttcacgagagactcgacctccgactccaagaaaaccgataccgactcggccgagcgctctaccacctcgcgcagagaagagggtttctatccaaccggctagaacaaaactctaaaacggacgaaactggagccgtcaaatcagacatctcccaactaaacgaagaaatgaagaaagcaggatcccagtacctcggtgactatttttactggctgtaccaagaatacggaaaccaagtcacattaaggatccgatacacagacagaaaacaacactaccagaaagagttcgaagcgatatgccaacgacaacaactgtcagacgacctcgtggacaagctgcgccgggccatctacttccaacgcagccttaaaagccaacgcgcaggagtaggaaaatgtacctttgagccggataagccccgatgcgccctctcccacccccgctacgaggagttccgcatgctctcattcctaaacaacgtaaaagtcaagggcccatccgacgactccctaagaccactcagcccctcggaaaaagagaaaatcaagcccctcttcctccgaaaatcaaaagcgaatttcgacttcgaagacatcgcaaaagccatagctggcaagggcaaatatgcatgcatacgcgacaaagaaggggcacaaaaaccctaccaattcaactacgcgctcagccaaggcgtgtcaggctgcccagtcaccgcgaaattaatcgcagtgttcggagaatcctgggaacgaaatctagtaaacgcgtaccgctctcgaaatgacatgcggaaaagcgacgaagagatcgtaaacgaagtctggaacgtactttactccttctcaagcaaggaaaagttgcgagcctggggcatggaaaaactaggactggacgaagcctgcgccggcgagttcgccgacattacactccccaccgccttcgccgccctatcactgaaagccgtcaataaaatactcccattcctaaggcagggcttcatctactcacacgccgtaatgctggcaaatatcccgtacatcattgggatggatagatggaacgaaccaagacaacggcaattcatcatggacaacctacaagaactactcgacaatttcaccgctagcgacaaggcactccaacaaaccctcgacttttgcataaaagacttcctgctcaataactatgaactagccccaggtaaagcagaccggctataccacccctcaatgatcgaaacatacccagatgccaaagcagacggacagggtatataccaactggggtcccccgccacaaacgccatacgcaacccgatggccatgagaagcctgcacatcctccgacgtgtagtcaaccaactcctcaaagagaaaaccatcgactcagaaacagaagtgcacatcgaatacgcaagagaactaaacgacgccaaccggagatgggctatcaaccagtggcaacgcaagcaggaaacacagcgaaaagactatgcggagaaaatacggaaggtctacgccgacgaatttgaaaaagtgatcgaaccaacacaagaagaactcctaaaataccaactctgggaagaacaacaacatctatgcctctataccggagaacagatcggtctaacagatttcataggacccaacccaagatacgacatagaacacaccatcccccaaagtatgggaggagactcaacccgaatgaacctcactctgtgtgaacgtacctacaacagaacggtaaaaggcaaccgaatgccgtcacaactcgcagagcatgaaagcatcctaactcgaatcaagccttggaaggacaaatacgaggaactgaccgtgaaaataaacaaactgcgtacacacccgggcatggacaaggcctccaaagacaacatcatccgcaaacgccacctactcgaacttgagcgcgactactggttccaaaaataccaacgcttcaccatgaccgaagtcccggaagggttctccctacgccagggaacaggtatcggcctgatcggcaaatacgccggtctcttccttaaatcactattccaccatgtaaaagaacgaaaccgaaaacaagtctacgtcataaagggaccaatcaccgccgagttccgccgcctgtgggggctccagaacctttatgaacaaaagtcgcgagataaccacgcccaccactgcatagacgcaatagtcatagcgtgcatcaaccccgctgaatacgcaaggatggcaagttactaccggcaggaggaagattttcgactaaacaaaggcaacaagcctgtcttccccaaaccgtggaccacattcacccaagaccttcaagccttagaggcagaactcctagtcgtccacgaaacaagaaacaacctaacaaagaaagcccgcaaacgtgtcaggaccaaagggggtaacgtcctaagcgagtcggactccgccaggggcagcctacacaacgacacatactacggagcaatacaaaaagacggagtcattcgatacgtagtacgaaaagctctctcctcgctcagcgaaaaagacgtcaaagatattgtcgacaagaccgtcagagaaaaagtccaagccgcaatacaagagaaaggcgctaaggaagcattggcaggaaccatctacatgaacgaagaaaaaggcataaccatcaagaaagtacgatgtttcaccaagatcgcctcaccactcgccatcaggcgccacagagacgccagcgcaaaagagtacaagcgaccctactacgtgaccaacgagagcaactatgttatgggcatatacgaaggatgcataaaagagaaaaccaagcgcgaatttatacttgtcaacaacctcgaagctgtacgccaactaaaggcagcccgcaaacaaggcgtggtctcgtccatcctaccgccagtatccgcgaaaagccaattcccccttaaataccgcctatacacaggaacgctcgtactgctctatgagaactcccccgaagagatagactttacaaaccaagtggacatatgcaaacggctctacaaggtaaccggactctcctcaatgactgttacgggcaaccaatacggaaccatccagctgcgctatcaccaagaagcccgacaggcgaaggacttaaaagcccaaaacggtgcgtacaaagagggtgaagaacaccgtcccgccattatgatgctccacacccaattcaaagccctcgtggaaggcaccgacttccggatgaacatcttaggagaaatagaacccctccggaaatga

SEQ ID NO: 6375 - RNA, 3690 nt, synthetic construct
  misc_feature 1..3690: note = Cas9 variant
  source 1..3690: mol_type = other RNA
atgggagaccgaaagtacaacctaggacttgatatcggcaccagcagcatcggcttcgccgcagtcgacgaaaacaaccagcccatacgcgtgaaaggaaaaaccgccataggcgttcggctattcgaagagggcaaaaccgcagccgaccgccgcggattccggaccacccgaaggcgcctaagccgcagacgctggcgtatcaacctactaaacgagatattcgacgcccacctagcggaagtcgaccccaccttcctcgcaagactcaaagaatccaaccgcagcaacctagaccccaaaaagtcgttccaagggtccctgctctttccagaacgtaaggactaccaattctacgaagagtaccccacaatctaccacctacgcaaggcactcatggagaaagatcgcaaattcgatatcagagaaatctacctcgccgtacaccacataatcaaataccggggtaacttcctaaacggaaccccaatgcgttccttcaaggtcgaaaacatagaactcaacaccctcttcgaccaacttaaccagctttacgcagaaatcgtcccagacaacgaactggccttcgacttagcacaagtagcggacgtgaaagatgtattatccagtacaacaatctacaaaatggacaagaagaaacagctagtcaaaatgatgctcctaccagccagcaacaaagccctacagtcagagaacaaaaagatcgtcacccaattcgtaaacgcgatactgaactataagtttaaactcgacgtcctcctccaagtggagaccgacgccgactggtccctcaagctaaacgacgaaggtgctgacgataaactagaagagttcacaggcgacctcgacgaaaaccgcctcgaaataattgacctgctccagaggctccacaactggttctcgctcaacgaaattacaaaggatggtaacagcctctccgcagccatggtcgaaaaatacgaaaaccaccaccaccacctcgggttactcaagaaagtcatcgaaaaccaccctgatgccaagaaagccaaggcactgaaagagacatacacagcctacgtaggcaaaaccgatgacaaaacccaaaaccaggacgacttctacaaagccgttgaaaagaacttagacgactccccagacgcaaagggcataaaacgcttgattcagcttgaccaatttatgccgaaacaaagaacggggcagaacggcgcgataccgcaccagctccaccaacaagaactagaccagataatcgaaaaacaatccaagtactaccccttcctcgcagaacccaaccccaatgtcaaacgccgtaaagatgcaccctacaagctcgacgaactcattgcatttaaaatcccctactacgtcgggccactcgttacccccgaggagcaggcacaaaacaaagaaaacgttttcgcctggatgaaacgcaaagcagcaggtcccataaccccttggaacttcgacgaaaaagtcgaccgcatggaatcagcaaaccgcttcatccgacggatgaccacaaaagacacgtacctctttggtgaggacgtcctaccagcagaatcgatgatttaccaaaagttcgtagtgctgaacgagcttaacaacctcaaaattaacgggcgccacctctccctcaaagacaaacaagacgtctacaacgacctatttaagcaacagaaaaccgtctctatcaaggccttgcaaaattactatgtcacaaagaagaaagcagccacggccccgaccgttggcggccttgcggatcccaagaaattcctatcctcactatcgacatacattgacttcaaaaacatgttcggcgaacgcgtgaatgatccgcaattccaagaggacctagagcaaatcgtggaatggagcaccatcttcgaagaccgcggaattttcaaagccaaattacaagcgcttgggtggctcagcgaaaaacaaattcaacagctggtagccaaacgctataaaggatggggccgcctctccaagaaactcctcacgggcctcaaaaacgcagaaggatactcaatactagacgaaatgtggcgctcaacggagaacttcatgcaaatccaaagcagacccgagttcgccgcactaatccagcaggccaacgaaaaacaattcgaagggaatgaccccgacaacgtatgggaaaacattgagaatatacttggcgacgcctacacaagcccccaaaacaagaaagccatacgtcaggtcgtcaaagtcgtccaagacatcgaaaaagccgtaggcaacccgcccgagaaaatagcaatcgagttcacccgggaagccgccgcaaacccccagcggacgcaatcccgcctacgcaccctagaaaaactgtatgaatcggccgaagaagtggtcgacgcgggactgacagcggaacttgcggagttcaaggaaaacaagcacgtactgagcgataagtactacctatacttcacccagctcgggcgtgacgtctacacaggcgacacgatcagcctagacaaactaaacgattacgacgtagaccacatactcccccaatcctttataaaggacgacagcctagataacagagtcctcacgatccgggcagttaacaacggcaaaagcgacaacgtgccagccaaaatgtttggaaagaaaatgggctctttctggagacatctactcgacaacggaatgatctcaaaacgaaaatataacaacctcatcaccgaccccgacaacatctcgaaatacgcgcagaaaggcttcataaaccgccagctcgtcgaaacctcccaagtcatcaagctcacagccaacatactcaatggcatctatgacaaggatacagaaataatagaggtgcccgcaaaaatgaactcgcaaatgagaaaaatgttcgacctagtcaaagtccgggaagtgaacgactaccaccacgcattcgacgcatacctaacgatattcatcggcaactacctctacaagtgctacccaaaactacggccctacttcgtctacgacaacttcaagaaattcggaaataaagaagacatcggccacaagaggtttaacttcctaggaaaaatagaacgggagaagaaagtagtagccccggaaacaggagagattctttggtcaaacgtcgccccgaacgagacgataaaacaaataaagaaagtatacaactacaaattcatgatagtgagcagggaaatcaccacacgccgagctgaactgtttaaccaaaccgtataccccaagaactatcgcggaaaactcatccccatcaaggaagatcgacccacggacttatacggcggctacagcggcaacacggacgcttatctcgccatagtcgccctagaggacaagaagaaaggcaaatactttaaagtagtgggcattccaacacgagccgcagccaaactagaaaaactcaaacaacaggactcccaacaataccttcaagctctccacgaggtaatagcaccacaattcacaaaaagcacaaagaaaggcataaagaaaaccgaatttgaaattgttctggataaagtccactaccgtcaactcgtccaggatggaccggtcaaaatgatgctaggatcatccacctacaaatacaacgcaaaacaactcgttctatcagagaaagcgttatga

SEQ ID NO: 6376 - RNA, 3696 nt, synthetic construct
  misc_feature 1..3696: note = Cas9 variant
  source 1..3696: mol_type = other RNA
atgatcacccgcatcctagggttggacaccggaacgaacagcctagcatgggcagtagtcgacagagatgcgaacggcaactatacgttagtcaaacggggcgatgtcatattcacagaaggcgtaaaaatagaaaaaggcatcgaatctagtaaagccgccgagcgcacggcacacaaagccctcagggtccactactcacgccgccgtctacacaaaatcgacacactcaaagtcctcgtcgaactggacctctgcccttacctatcaaacgagcagctgaatctttggaaggcgaaaaagacgtacccactcaccgacgacttcatgctatggcaacgctccgggagcgcagaagaaaacaacccttattactgccgccaccggtgtcttacccaaaagctcgacctcacggaccaatcccagagattcctcctcggaagggcattctatcacctcgctcaacgcaggggattcctgtcaaaccgattggacacctctgccgacagcgacgagagcggcaaagtaaaaagtggaatcgcagagctatccgttgagatggagaaagccggctgcgagttcctcggagaatacttctatcagctatacaaacaacacgggaacacgatcaaactgcgttcacggtacacagacagagaggaacactacaagaaagagttcctcgcaatctgtgaaaaacaggaactcgacccaaaatgggtcgaagcactccaaagggccatatatttccagcgcccactgaaaagccaacgcaaaggagtaggcaaatgcaccttcgaaccaaagaaacccagatgcgcagaatcccatcccgactacgaagcattccgcatgctctgcttcctaaacaacgtgaaaatccagacccctaatgatacgtcactcagacctctgaatgaagatgagcgggagaaaatctggccattattcttccgcaaatccaagccaaatttcgacttcgaagacatcgcgaaagccttggcgggcaaaaacaactacgcctggtacaaggacgcaggcgaaaaaccattcaaattcaactataggatgcaacaaggtgtcagcggctgcccggtcacagcgcaactaatcgacatatttggctcagactggcagacagcaatcgccgaaacctacacagccgtcgagaaaaagaacgggaccaagaccatcgacgaaatggccgacgacgtatggaacgtcctctactccttctcaagcaaagacaagctaaaggcatttgctaccgaaaaattgcaactcgacgaagcaagcgcgacgaaattcgccaacgccaagctaccccacggattcgcaagcctttcactcaaagccatccggaacatccttcccttccttcggcaaggattcatatacgcacacgcggttcacctagcaaaaatacccgatatcgtgaccaaggcagtctggaacgacgccgataagagagaaatgatactatcaggcttaatggaaatcatcgaaaactacaaccccaaagacagaggagtagaaggaacaatcgacttctgcataaagagccatctccaagacgtcatcgacctacgccccggggcggctgacgccctataccacccatccatgatcgagacataccccgacgcaaagctaaacaaaatgggagtcttccaactcggcagcccccgcacaaacgcaatcagaaaccccatggcgatgcgtagcctccacatactccgatcggtcgtcaaccaactcctccgcgacggaataatcgaccgaaacacagaggttcacgtcgaatacgcccgagagctcaacgacgccaataaacggaaggccatcgccgattaccaacgcgaacaagaaaagaaaagaaaacaatacagagatgacatcatcgccctgtacaaaagcgaatgccacaaagagatagaacccaccgacacagacatcctcaaatttcaactctgggaagaacaagaccacctatgcctctacacaggaacgcaaataggtatatgcgacttcctcggggacaaccccaaattcgacatagaacacacagtaccacgctcggtcggaggcgactccacccaaatgaacctcacactatgcgacgctactttcaatcgccaggtaaaaggcgcccagctcccctcccaactcagcaaccacgcagacatcctcgtacgaatagaccactggaaatctaaatgcgaagacctacgaaaacaactcgacaaaattcgcacctacgggggcatggaaaaagcaatgaaagacaggctcatacaaaaacggcacaggctgaaaatggacctcgactactggcaaggaaaatactcccgcttcacaatgactgaagtacccgaaggcttcagtcgccgccagggagcaggcattggcctagtatccaaatacgcaggcctctttctcaaaagcctgtttcacaacgaacaaaatcccaacaaatcaaacgtatacgtcgtcaaaggcgtcaccaccgcggagttccgtaggatgtggggactacaaggcgaatacgagaaaaagtcacgactgaaccactgtcaccactgcatcgacgccatcacaatcgcatgcattggcaaagccgaatatgacaaaatggcacaatactaccacgacgaagaacttttccaatggcgcggtacaacaaccaaaccccacttcaacaaaccctggccgaccttcacggaagacgtcctagccatcgaacagtcccttctcgtcaaacaccttacaaaggacaacatgcccaaacaggcgaagaaaagagtcagaaccgcgactggcaagtaccttgcacagggtgacacagcgcgcggcagccttcacaaagacacctactacggggccatagaacaagacggagaaataaggtacgtgctccgcaaaccattaaacaaattcgaaaacgaagccgaactcgagaaaatcgtcgaccaagccgtcaaagaaaagataaaagaagcgatcgcaggcaaaaacttcaagaccgcaatcaccgaaccaatctttatgaacaaagaaaagggaataagaataaacaaagtccgctactacgtaaaagcccaagaacgactaaagatccgccagcaacgagacctaagctccaaagaatacaagcagttcttctgcgtggaaaatgaaagcaactacctactcgccatctacgaaggcgaattaaaaggaaagaaagaacgggatttttgcgttgtcaacaacctggaaagcgcagcttgtctgaaaagaagcaacaaaggaaaagccgcccctctggtccccgaacgatcggaagaacgaaacctcccactactcgccgtcctcaaacgcgggacacaggtgctattctacgaaaattcccccgaagagatactattcgacaatccgcaagatctagtcagaaggctatacaaagtaacaggaataaacaccaagaaagacgtgaaaaatggcaagacctacctctacggcaacatcgaattgcgattccaccaaaatgcgcagaagaaagacgacgtaaaaatgcagagtggtgtatacaaaaataacgaggtcctcagacaaggcatcgtcctgtcccataagcagttcaaagcactcgttgaaggcgtggacttcgagttcaacgtactcggagaaatcaagaagaaagaacgccacgcctga

SEQ ID NO: 6377 - RNA, 3699 nt, synthetic construct
  misc_feature 1..3699: note = Cas9 variant
  source 1..3699: mol_type = other RNA
atgactaaaacacggatacttgggctagacaccggcactaacagcttaggctgggctatcgtcgacagagacgaagtatccggacaatacgaactggtcgacaggggagacctaattttcacagaaggcgtcaagatagaaaagggcatagaaagcagcaaagcctcagaacgcacacaacaccgcgcacttcgtaagcaatacttcagacgacgccttagaaagatcgaagtactccgcgtgctaaccttctaccacctctgcccacccgtaagtgaagaagaactccacttatggcacgtaaagaaaatatacccagtcgaaaatcatgagttcatgatatggcaacgcaccaatgacaatgaaggcaaaaacccatactattacaggcacatatgcctacacaccaaactcaaccttactctcatgaaagaccgatacatcctcggccgtgcactctaccacctcagccaacgccgtggtttcctatccaaccgcctagaccaatcacaggacgaagatgacaaaggcacggtaaaaaccgggatatccagcctctccaaggacatgaacgacgcaggatgcacctacctaggcgactacttctacaagctctacagtgaaaacggcaaccgcgtaagaatccgcaatcattacacggcacgaaacgaacactacctagccgagttcgaagccatctgccaagtccagaagctggaaccagaactcgtcgaagcgctacgaagggccatcttcttccaacgtcccctcaaatctcaaagaaaaggagtgggcaaatgtacctttgaaccgaggaagcctcgctgcgccgactcccaccccgactacgaagagttccgcaagctctgcttcattaacaacatcaagatccagacatcagacgacgacacaatgcgtcccttaaacaaagaagaacgccaacgcatcaactcgctgttctaccgcgtttcaaaagcgaacttctacttcgaagaaatcgccaaactgctaggcggacgcaataactactgttacttcaaggatgaagttcaaaaggacttcaaattcaactatcgcatgtcccagagtgtatccggatgccccaccacagcgcagctgcgaaacatcttcggagaagattggaagacaggcatcgcagaaacctatcaacactccgcgaaaaaggacggaagtttaaaaacagtagacgaaatggccgacgatatctggaacgtattatactcgttctctagcaaggactgcctctacaacttcgcagtcaacaaactacaactcgaggaggacaaagcgaagaaattcagcaaaataaaattatcacatggcttcgcctcaatctccctcaacgccattcataaaattcttccgttcctccgcatgggaatgatctactcacacgccgtgctattcgcgaacatccccacaatcgtcggaatggatgtctggaacgacgaatcgaaaagacagcacataatgacagaactatcagacctagtattcaactacgatcccaaaaaccgcgaagtcgaaggaacgatcgaaatgtgtattaaagacttcctcctcaacaactacgatcttccagcaggcgcagtttgccgcctataccacccatctatgatcgacacctaccctgacgccaaagccaataaatacggagtacttcaacttggatccccggccactaacgccatcagaaaccccatggccatgcgctcactacacgaactacgacacgtagtcaacctactgctcaggaaagggaaaattgaccaaaacacggaggtacacgtcgaatacgcccgagaactaaacgacgcaaacaagcgaaaagccatagccgaccgccaacgcgaactggacaaactacacaaaaagtatcacgatgacatcataaccctctacaaggaggaaaccggaaaagacatcaacccgacacaagcagacatcttaaaatttcaactatgggaggaacaggaacatgtctgcctctacacaggtaggcaaatcggaatcagcaagttcctcggccccgacccagagtttgacatcgagcataccgtaccccgctcagtcggcggggacagtactcaaatgaatatgacactctgcgacagacgattcaacagagacgtcaagaaagcaatgttaccctcccaactacccaactaccaagaaatactaccccgtatagaaaaatggaaaaagaaatacgaaaaactcacaaaagacattgatcattgcatcacccactccggcatgactaaagaagcgaaagatagcataatacaaaaacgacaccgactcacactcgaacacgactactggcgcaacaaatacagccgtttcacaatgaccgaagtgcccgaagggttctctaggcgacaaggagccggaatcggattagtctcaaaatatgccggcctcttcctgaaatcactattccacgaccccacggaccgccgccgcagtcacgtctacgtagttaaagggaccacaaccgcagaatttcgcaaaatgtggggactccaaagcgaatacgagaaaaagtcccgcgataaccacgtgcaccactgcgtagacgcaatcacaatagcctgcataggcaaaaacgagtacaataaaatggcgtccttctaccacgacgaagaagcattcgaacgtggcgaatgtgaaaaaccccacttcgacaagccctggcccaccttcacacaagacgtcctaggactagaaaaacgcctcatcgtagtgcactcaactcaagacaacatgccgaagcatgcaaagaaatacgtgcgtactccacgcggcaaatttatagccaaaggagactgcgcccggggaagcctacatctcgacacttactatggcgccatcaaacataaagacgataccgaaccacgttatgttctcagacgcgaactctcgagtttcgactcagtgaacgatctcgacatcatagtcgacgacgccgtgcgcgagaaaatcaaagaggccgtcaagggcaagtccggcaaagccttcaaggaagccctcgcgaatgtatacatgaacaaagaaaaagacatccgaataaagaaagtccgttgctacgtaccaagtgtcaaacgtcccattgacatacgacaccaacgagacatgagccgcttcgactataaaagacaattccacgtcgcaaacgatggtaactatatgatggcaatatatgagggcgtcgttaaaggcaaattaaaacgcgactttgaacttgtcaaaaacatcgaagctgcctcgtatttcaaagtatcccaagacaacgagagcttctcatcaatcgtcccggaaaagtcgtcaaatggcttccccctcaaagcagtactcaaaattggaactcacgtgctcctctacgaaaacacagcttccgaaatagacttctccgacccagtagacctgacccggcgcctctacaaggtagtcggattgtcgagcgcaatcataaacaactgcagctacggcttcatcaccttacgcttccaccaggaagcacgacaagcgaaaaaccttaaactaacaaaaggtgtcttcaaaaacgttgacaactaccgcggggccataatcctctaccacacccaacttaaagcactggtcgaaggctacgacttcgatatcaacatactaggcgaaattacctcaaagcagtga

SEQ ID NO: 6378 - RNA, 3705 nt, synthetic construct
  misc_feature 1..3705: note = Cas9 variant
  source 1..3705: mol_type = other RNA
atgccgaacttctggtcgatattcacagagaatctccaaacctacctaatgaaaacccgcatcctagggctggacacaggaacgaactccctaggctgggccgttgtcgatcgggacgaaaacaaccaatatacgcccatttgcagaggcgacctcatattcaccgaaggagtcaaacaagagaaggggatagaatttagcctagccgctgaacgaaccagctaccgagcctcacgaagacactacttccggaggcgccttcgaaaggtcgaagtcctcaaagtattggtaaaacacaagctctgcccgcctctctcggacgaggcactcaaccgatggcacaccaagaaagaatacccccttgacgaagactttatactatggcaacggacaaacgaagctgataacaagaatccttaccacgaccgccacatctgtctccaccgcaaactaaacctaaaggacagccaaacagaccgatacacactcgggagagccctataccacctcacccaacgacgcggtttccttagtaaccgcctcgatcaaaacgaagaagcggaagaaaccggcaaagtcaaatccgccatctccgaactgtcgaaagaaatgaaagaggccggatgcgagttcctcggagactacttctacctcctatacaggaccgaaggcaaccgcgtaagaatcagatcacgatacaccgaccgcgaaaagcactacctacaagagttcaaagaaatatgccgtgtacaagaactagatgaagacctagcgaaagccctagagaaaaccatcttctttcaacgcccactaaaaagtcagcgccaaggcgtagggaaatgtaccatggaaaaaggacactcgcgctgcgcagtatcccaccccctatacgaagaataccgcctcctatgctacctaaacaatatccgcatcaagacccccagcgatgaccgcctacggccccttaacgccgaggagcgtgagaaaataaccccactgttctacaaagagaaaaacttcgacttcgaaaagatcgcaaagaaactggccgggaaaaccccattcggctggatacgcgacgccgaagactggccatatcaattcaactaccgaatgacccaagaagcacccgcctgccccaccactgcccagctaataaaagtattcggagaagactggaaggccgccctggccgagacctacacaatgtcggccaaacaggacggcactctaaaaactgaagacgaaatatgcacagatatctggaatgtcctatacagtttctcatcgaaggaaaaactcaaagagttcgggctaaagaaattacaactagacgaagttcaagccaaagcattcagtgaaatacgtctaacacgagacttcgcaagcctctccctcaaggcaatacgcaagatactcttcttccttagaaccggcgaagactactcaaaagccatcttcctagccaatatacccaccatagtcggagaagagatctggaacgacatagaacgccgaagcagactactctacaaggtcgacctagctctacgaccacaagaagaacgagacgccgaggaacaccgaaccatcgccgaacgaataaaagcagcagtcgcagccgaagtcccagacgcgcccattgacttactctaccaccccagcatgatagaagcctaccccgacgccaaacgtaacgaaaggttcgactgctaccaactaggctcccccaaaaccaacgccgtccgtaacccgatggccatgagatccctacatatggttcggaaggttatcaaccacctcctgcgcaaacacattatcgacgagaagacagaaatccatattgagtacgcaagagaactaaatgacgcaaacaagagacaagcaatcgccgactggcagcgagaactaagcaagcgccacacagcctacgcgcaaaacatacgacaactgtataaagcagaaaccgggctagtcatagagccgacaaaggctgacatactcaaataccaactgtgggaggaacaacaacatgtttgtctctacaccggaaagaagatcggtatagcggactttctcggagccaatcccaagttcgacatagagcacaccatcccccgcagcagaggcggcgactcaacccaggaaaatttgactctctgcgaaagcaagttcaacagggacatcaaaagagacaaactcccaacggaactagccaactacgaagaaatcctagcgcggatcgaacattggaagaaacaatgctacgccctcaaactcaaacgcgacgggatacgaacccattcaggcctcgagaaaagcataaaagactcccgaatacgccggcgacacctagtcggtttagaatacggatacctcaaagggaaatacgaccgtttcacaatgaaagaagtcccggaaggattctcgcgaagacaaggggccggcataggcctcatttccaaatacgcgggactcttcctcaaatctctattcaaagaccccaaaaacccaaaccgaagcaacgtctacgttgtgaaaggagcaatcaccgccgagttccggaaactctggggcctccaacaagccgatgaagccaaatcaagggaaaaccatacccaccactgcatcgacgcgtacaccatcgcctgcatagggccatgcgaatacgccgccctagcagcttactatcgcagtgacgaagagttcaaatacggccggcgcagggaaaaaccacaatttgaaaaaccatggcccacatttacagaagacctcctcaagctacaagaagaactgctaatcgtgcaccaaacaaccgataaactcggaaaacgcgacagacgtaaggtaaagacaccccgcggcaaattcctcacagggggcgactccgcccgcggacgcctccaccaagaaacatactacggagccataaactatgacgggaacattaaatacgtagtccgaaagccccttgactccctgaccgagaaagacttagacaaaatagtggatgaaacggtgatggggatcgtaaaaggcgcagtcgaggccaagggcagcctcaaagaggcactcgcagacggtatctatatgaacaaagagaagggtatcctgataaaacgggtacgaattttctcagacgtgagcgagccgattaacctcaaacaactgagggacgtgtcaaccaaagagtacaaacgccacatccacctccgaaaagacgaaaactacctattcgcaatctacgagggtatagacaagaagaaaaataagaaacagactgagaccgccacggtggactacctggatgctgccaaattctacaaagactccaaacgcagagacaaagcaaacagcctcgtaggcgactactccaagaagaacaaactcccactgaaatgcatcctcaaaaagcgccaaatggtcctcttttacgagcactccccagaagaaattcgtttcaaagacaagaaagacctctcacggcgcctgtatatcgtcacatcaatcgcgaaagacggacgcgtcaaattcttgcaccaccaggctgccaccgccacgggcattcaaagcagcccgagcccattcactaacgacggagagcatcaaccgtactaccgcctctccgcatcaaacatcaaagtgcttgtagcaggaattgacttcgacatcaacatacttggagaaatcacccccaaactctga

SEQ ID NO: 6379 - RNA, 3711 nt, synthetic construct
  misc_feature 1..3711: note = Cas9 variant
  source 1..3711: mol_type = other RNA
atgtacttctacaaaaacaaggaaaacaaactgaacaagaaagtagtactcggcctagacctaggcatagccagcgtgggctggtgcctaaccgacatctcccagaaagaagacaacaagttccccatcatcctccacggggtcagactcttcgaaaccgtagacgactccgatgacaagctcctcaacgaaacccgccgaaagaaacgagggcagcgaaggcgtaaccgccgcctgttcacccgcaaacgcgacttcataaaatacctaatcgacaacaacatcatagagttggagttcgacaaaaaccctaaaatcctggtccggaacttcatcgaaaagtacatcaacccattcagcaaaaacctagaactgaagtacaaatcagtaaccaacctgccgataggctttcacaacctgaggaaggcagccatcaacgaaaaatacaaactagacaaaagcgaactaatcgtacttctgtacttctacctatcactgcgcggcgcgttctttgacaaccccgaggacaccaaaagtaaggaaatgaacaagaacgaaatcgaaatcttcgacaaaaacgagtccatcaaaaacgcagagttccccatagacaaaataatagaattttacaagatctccggcaagatccgcagcacgatcaacctaaaattcggccaccaagactacttaaaagaaatcaagcaagtattcgaaaaacaaaacatagacttcatgaactacgaaaagttcgcaatggaagaaaagtcctttttcagccgaatcagaaactactccgaagggccaggcaacgagaagagtttcagtaaatacggcctctacgcaaacgaaaatggaaaccctgaactgatcattaatgagaaagggcaaaagatctacaccaaaatattcaaaaccctatgggaaagcaagattggaaaatgcagctacgacaagaaactataccgcgcccccaagaacagcttcagcgcaaaggtcttcgacataaccaacaaactgacggactggaaacacaagaacgaatatatctccgaacgattgaagagaaagatactactgagccgattcctcaacaaagacagtaagagcgccgtggagaaaatactgaaggaagaaaacatcaaattcgaaaacctcagtgaaatagcgtacaacaaagacgacaacaaaataaacctccccatcattaacgcctaccactccctgaccacaatattcaaaaagcacctcatcaatttcgaaaattacctgatcagcaacgagaatgatctctcaaaactaatgtccttctacaaacagcaatccgaaaaactcttcgtcccgaatgagaaaggctcctacgaaataaaccagaacaataacgtactccacatcttcgacgccatctccaacatcctgaacaaattcagcaccatccaggaccggatccgcatattagaaggatatttcgagttctcaaacctcaagaaagacgtcaaaagctccgaaatatacagcgaaatcgccaaactacgcgaattttccgggacatcctcgctatcattcggcgcttattacaagtttatccctaacctcatatcggaaggttccaagaactacagcaccatctcttacgaagaaaaagccctacaaaatcaaaagaacaacttctctcatagcaaccttttcgagaaaacatgggtcgaagacctcatagcctcccccaccgtcaaaagatcgctgcgccaaacaatgaacctactgaaagaaatattcaagtactcagagaaaaacaacctagaaatcgagaaaatcgtagttgaagtcactcgttcgtccaacaacaaacatgaaagaaagaaaatcgaaggcataaataaatatagaaaagaaaagtacgaagaactcaaaaaggtctacgacctgccaaacgaaaacaccaccctccttaagaaactatggctgcttcggcaacaacagggctacgacgcgtactccctgcgcaaaatagaagcaaacgacgtcattaacaaaccctggaactacgacatagaccacatagtacctcgaagcatctcattcgatgattctttctccaacttagtaatagtcaacaaattagacaacgccaagaaatcgaacgacctctcagccaaacaattcatagagaaaatatacggaatcgaaaagctcaaggaggccaaagagaactggggcaactggtacctcagaaacgccaacggtaaagcattcaacgacaaggggaaattcataaagctctacaccattgacaatctcgacgagtttgacaacagcgacttcataaatcgaaacctcagcgatacctcttacatcaccaatgcgctagtaaaccaccttacgttcagtaactccaaatataaatacagcgtcgtatcagtgaacggcaaacaaacatcaaacctacggaaccagatcgcctttgttggaatcaaaaacaataaagagaccgaacgcgagtggaagagacccgagggcttcaaatctattaacagtaacgacttcctcatccgcgaagaggggaagaacgacgtcaaagacgacgtgctaataaaagaccgcagcttcaacggtcatcacgccgaagacgcgtacttcataacaatcatcagccaatatttcagatcattcaaacgcatagaacgattgaacgttaactacaggaaagaaacccgagaactcgacgacctcgagaaaaacaacatcaagttcaaggaaaaggcatcgttcgacaacttccttctcatcaacgcactggatgaactcaacgaaaaactcaaccaaatgcgcttctcccgaatggtcatcaccaaaaagaacacgcaactcttcaacgaaacgctctacagcggcaaatacgacaaaggcaagaacaccattaagaaagtggaaaaactaaacttactggataacagaacggacaagataaagaagatcgaagagttcttcgacgaagacaaactcaaggaaaacgagctgaccaagctccacattttcaatcacgacaaaaatctatatgaaacattaaaaattatatggaacgaggtaaaaatcgaaatcaaaaacaagaacctcaacgagaaaaactacttcaaatacttcgtcaacaagaaactgcaagagggtaaaatatcgtttaatgaatgggtcccgattctagacaacgacttcaaaatcatacgcaaaatacgatacatcaaattcagctccgaagagaaagaaactgacgagataatatttagccaatcaaattttctgaaaattgaccaacggcaaaactttagcttccacaacaccctatactgggtgcagatctgggtctataaaaaccaaaaagaccaatactgcttcatctctatcgatgcacgaaactctaaattcgagaaagatgagataaagatcaactatgaaaaactcaaaacccaaaaagagaagctacaaataatcaacgaggaaccaatcctcaaaataaacaagggcgacctattcgaaaacgaagagaaagaactcttctacatcgtcggtcgagatgaaaaaccccaaaagctcgagatcaagtacatcctaggaaagaagatcaaggatcaaaaacaaatccagaagccggtaaagaagtacttcccgaattggaaaaaggtcaacctcacttacatgggagagatcttcaaaaagtga

SEQ ID NO: 6380 - RNA, 3717 nt, synthetic construct
  misc_feature 1..3717: note = Cas9 variant
  source 1..3717: mol_type = other RNA
atgacgaaagtcctcggcctagacttaggtgccgctagtgtgggctgggcgatgatagaagaagaagagaaatcccacaagatcctggggctcgggagcaggatcatcccgtacgaaggcacggaaggcaacgacttcgccaaaggtaccggcgaaagtcgaaacgctctaagaaccaaagcacgcaccgcccggaagggatacgaccgttaccagctacgacgcaagtacctagtcgacacactcgtcaaaaatgagatgatgcccgacgagtacctgcggaaactgccaaaaatgcagctatgggaactccgtagcaaagccgtgacaaccgagataaccaaacaagagctagggagactgttcctctggctaaaccagaagcgcggctacaagagtagtaggagcgacgccaatctggacaaaaaggacaccgaatacgtcgtagaagtgaaaagccgacacgagaaaatcaaagaatcgggattcacgatcgggcagtacttctacagtgaactaaaaagcaatgaatacttcagggtaaaggaaaacatcttcccacgggaggcctacatcgaggaatttgacgccatatgcaaacaacaaaagcggcacctaacagacaaactcatctcacgaatccgcaacgaaatcatctactaccagcgccccctcaagagccaaaaaggcttagtgagcgtatgcagattcgaaggcttcttcaagaagggcatcaacggaaaagaatacttcgtaggacccaaagtcgcaccaaaatccagtcccctcttccagacagtcaagatctgggagaacataaattccatcagactctccgaccggaatgggaaagaaatcatgctaagcctggagcagaaaaagtgcatcttcaaccacctagacaacaatgaaaagctaaccccgaaagacttattcataatcataggagtaaagaaggaaaactgcttcgtaaacaagcagctcgaaaaggggatccaaggcaacgtcactaaatcaacaatactcaagtgtttcggcgaaaacaacgattacgacaagtggctgaaactcgaccttaacatcatcgtcaagaaggacaccttcggatacttgtacgacaagaaaacaggggaaatcattggggaaaagctgatcaagcacgtggacagcgccgtagagcgtgaaccgctgtatcaactgtggcacaccatctacagcatcaacaacacggacgaatgcagcgccgccctgcaaaacaaatttggcttcgacagtgagacagccgacaaactcagcaatatcgacttcggaaaggccggctttggaaacaagagcgccaaagtaatccgcaaaatactgccatacctaatggaaggcgacgactactcacagagcatgagctacgccggctttaaccacagcgacagcctaaccaaggacgaaaacctaaagcggaaattactcgacaagctaagacccatcgaaaagaactctctgcgacagcccatagtcgagaaaatcctaaaccaaatggtaaacgtggtaaacgcgatcatagacaaatacggcaagcccgacgaaatacgtatcgaactcgcccgggaactcaaacaaaacaaggaagaacgcaataaaacggacaaagacatgagcaaaagacaacgagaaaacggcgaaatttcgaaaagactcgcggaatacggattacgggcaaccaggaataacataatcaaatggcgcctgtatgaagagatcgacaaccaagacaagaaactcaacgcaatttgcgtatactgcggccagcctatctcgctgaccgaagccatcaaaggcaacgaagtcgacgtagaacacataatcccgaaatccaaactcttcgacgactcgcaaagcaacaaaaccttagcccaccgccgctgcaactccaccaagggagacatgacagcctacgactttatggaaaacaagccagcccaagtcttcaatgcctacatagaacgcgtcaacatgctttacgacaacaaaatcatacgaaaggtaaaacgcgacaaactgctcatgcccgagtcaaaaataccagataatttcatcgaccgccagctgcgcgagtcccaatacatcgcgagcaaagcccgagaaattctacaaacaatatgttacaacgtgtggagtacgtccggaaccgtcaccgcacgactaagacatctctggggatgggacgacgccacgatgagcctgcaactcccgaagtacagggaacttggactaaccgagatggtcgaatgggagtctgaacacgggaagcaaaagcacagcaaggaggtcataagcgactggtcaaagcgagacgaccatcgacaccacgccgtcgacgccctcacaatagcatgcacgaagcaggggtttatccaacgctttaacaccctaaattcctctaaaaccaaggaagacatggagttcgaaatagcaaagtgttccatagaataccgggaaaacctgagcaagctcgaaaagtacatcatcgcgctccgcccgataccggtgtcagaggtagaggacgcagtcgccaacatcctcatatccttcaagagcgggaagaaagtggccgtcaaagggaaaagaaagatcggcaaacgcgggaacaagaagatcatacagaccgacatcatcataccgcacggaagcctgagcgaggaatccgtttacggcaaaataaaaactatcgaacgggaaaaacctctgaaatatctgttccaaaacagccaactcatattcaacaacaaaataaaaatcctcgtcgaagaaagactcgccacattcgagaatgacaccaagaaagccctcgcgagcctaaagaaagtgcccgtatacctggatgaagagaaaacaatagtgctggaatacgccacttgcttcaaagaagagtacgtcaagaaatacgatgtagacaccaatttctcaaaaacagacaaagtgatcgacgacaaaataaaagaaatcctccaacatcgactaggcaaattcggaggcaaggccaaggagaaagaagccttcaaagacgttcagcaaggggacaaaaccataaaatggtacgaggacgaaggcctcgaacgacccatccactcagtgcgctgctttaccggactatccgccatcgtccccgtcaaaaaggacgaaaacgggatagacatcgggttcgtgaagccggggaacaaccatcacatagcaatctactccgacaaagacggcaatagatacgaacacatctgcaccttctggcacgccgttgaacgaaagaagtacgacatacctgtcgtcataaaagacagcaacgaaatatggaataaaatctggtccaaacccgaagggagctacccacagtcgtttctggacaagctcccccaggaaaacttaaccctagacctaagcatgcaacaaaacgagatgctaatcctaggcatgtcgtacgaagacatcaagaccgcgatcgataactcagactacaagcaattatcatcgaacctctaccgcctacaaaaactggcaaacgcgaactacatgttccgtcatcacctagagactcaaatcatagacgacaacaacagcaaagcctcgcgacgattcatcaacatccacagcctaaaagccttgttcgcatggaacccctataaagtgaacataaattgtctaggagacatacaaaccaactcgaggtga

SEQ ID NO: 6381 - RNA, 3720 nt, synthetic construct
  misc_feature 1..3720: note = Cas9 variant
  source 1..3720: mol_type = other RNA
atgacggaaaaacgcaaattcgacatcagggaggtatacctcgcaatccaccacatagtaaaatatcgaggtaacttcctaaacagcgcaactgtagacagctttaaaacctccaacatcgactttacctcccaattcgaccgcctaaacgaactctaccgccaagtcatccttgaagaacctttccagatcaatatgaaccaagtggacaaaatgaccaacaaactactagacaatgacgcactaaaactggacacgcagaaacaagtagctaaactcctaccagtcatctacaacgacaaacccgtcgacaagcaatatacaagactcgcaacagagttctccaaggccattttaggctataaaacaaaactcgacgtaattctcaacctggacacacaaaacgccaaggactgggccatacgcctagacgacgaagacattgacgacaaactcccagcccttgtagaaaacctcgatgagtcccgtcaagaaatcgtaactatcatccgcgatctatacgcacaaatcacactaaacgcgatcgtacccaaaggcaagtccttatctgagtccatggtggacaaatacaacgaccacaaagaccacctcgacttactgatgggcttaatccacgaattaggggacgactccgcaaaaggaataaagctgcgtgaagcctacacacaatacgtagggaaatcaggagacaagacgctcaaccaagacgacttctacgcagccattaaaaagaacctcgacgaagattccaagagatcccccaagatccaacgccttatcgaacaggcctctttcatgccaaagcaacgtacctcagcaaacggcgtaattccccaccaacttcaccaactggaactggatcgcataatcgaaaaccaaggacgctactacccgttccttaaagaacccaacagcaacacccacaagcccaatggcggcaaatacaaactcgacgagctcgttgcattccgtatcccgtattacgttggacccctcatcaccaagcaagaccaggaaaagacatccggagccgacttcgcttggatgatcagaaagcccggccaaggaggtgagatcactccgtggaactttgatcaggaggtcgaccgcatggcttcagccaacactttcataagacgtatgaccaccaaggacagctacctggtggcagaggacgtcctgccagactcgtccctaatctacgaaaaattcaaggttttaaacgaactcaatatgctcaaagtcaacgacaggcggctttccatcagccaaaaacaggacctattcaacaacctcttcaagaaacaaaagaccataagaacaaagaaactccaaacttacatccgtaccaaatgggaactgccaagcgtaatgatcagcggactctccgaccccgacaaatttaacagttccctagccacctatatagacttcagagacgtatttggagagaaagtagacgaccctaaccgccaggcagactacgaaaagataatcgaatggtccaccgtcttcgaagatcgtaaaatataccaggccaaactcaaccaactagactggctcaccgaatcccagtcaaaggcgctcctcacaaagcactacacgggatgggggaggctctccaagaaattactcaccggcctgaaagaccaaaatggcgactctatcctcgaccaactctggaaaacaaacgacaatttcatgcaaattcaaagtcgcgacgagttcgccaaacagatacacgacgagaacgcaaaacaattccatgaagccaacaacgtagacgacatactagacgatgcttttacaagcccacaaaacaagaaagctatccggcaagtagacaaagtagtccaagacgtagtgaaagccgtgggatacgcccccgacaaaatagccatagagttcactcgctcaccccaagatagaccccaacggaccttcagccgccaacgccaactccaatccacatatctaaatgttgccaaagcactgatgaaaagcaacctcaaccaagagctaaaatccgtgattgacagtcaacaaacgctaaccgacaaactttacctatacttcactcaactcggccaagacatgtacacaggaaaagaaatcaacttcgacgaactggtgaactaccaaatagaccatattctcccccaagcattcatcaaagatgactctctagacaatcgcgtcctagtatccgcccctattaataacgcaaagagcgacaacgtccccgtcaagaaattcggcgccaaaatgggctacttctggaaacagctagcagaaaaccacttaataagcaaacgcaaacttaataacctaacgaccgaccccgacaagatagggaaattcaccgcacagggctttatacaccgacagctcgtagaaacttcccaggtgatccggctcgttgcgaacatactcggaaacgagtacggacacgacggcaccactatcatcgaggtcaccgccaaaatgaaccaccaaatgcgaaaagacttcgatcttatcaaaatacgagacgttaacgactatcaccatgccatggatgcctaccttactgcatacgtgggagactatctctacctacgataccccaaactccgatcctacttcgtgtacggggacttcaagaaactgaaagaccaaagtctcaaaatacgcaatttcaacttcttacacgacctcacaaacgacgaagccggtgacaaaatcgtagaccaagagacaggcgaaatcatctgggacaaacacgaaagcgtgaaacaactcaagaaagtttaccactacaaattcatgctcgtgagccaagaggtgtatacgcgccaagacgcactgttcaaccagacaatttacccagcctctgacgcggacaaaagaaaactaatcccgatcaaaaacaataaacccgtggacgtatatggaggctactcaggcaacgtcgacgcctatatggccatagtacgaatacacggtaagaaagaagacaaatacaaagtagtgggggtacccatgagagcagtcgctgacctaaagaaagccgaatcaaaaggccgcgacaactaccttaacgccgtgcacgaggtactgaaaccgcaattcacgaaaaagaagaaagaccgcaaaacaggcgaaatcacagaaatgatggacgacttcgacgtactcctcggcaaagtctattaccgtcaactaatagtcgacggaaataagaaattcatgctcggatcctccacctaccagtacaacgccaaacaactcgtactatccgacaaagccatgcaagttctctcgaaagacgacaaactcaaaaatcaagatgaaaaccagaacctcatagatgtctacgacgaaatcctcgagaaagtcgatcaatacttcgaactgtacgacataaacaaattcagacagaagctccacgacggccgtaagaaattcatcgaactacctgtcgacaacgacttcaacggaaagaaacttatctcatacggaaaaagagctaccatcatctctatactaaacggactccacgccaacgccacaatgtcgaacctcaaatacctcgggatcagctcgcctttcggaatgctgcaagtcccgaacggcataatattatcacccgcctcgcgcatctgctaccaatctccaacaggcctgttcgaaagaaaagttaaactatccgatctatga

SEQ ID NO: 6382 - RNA, 3738 nt, synthetic construct
  misc_feature 1..3738: note = Cas9 variant
  source 1..3738: mol_type = other RNA
atgatcatctacttcatcttcgagaaaatcgtcaacaccatacttgttatgaaaaagatagtaggtctagacctaggtacaaactcaattggctgggccctaataaacgcatacatagacgaatacaacaaagaacacctgtatgggatcgaagcgtgcggctcgcgcataatcccgatggacgcagcaatcctcggcaacttcgacaagggcaactccatctcacaaacagccgaccgcacaagctaccgaggaatacgacggctgcgtgagcgacacctactgcggcgcgaacgactacaccgaatcctcgacctactcggctttctcccgaaacattacagcgacagcctcaaccgatacggcaaatttctcaacgacatcgaatgcaaactcccgtgggtcaaagacgaaaccggcagttacaagttcatattccaggagagcttcaaagaaatgctagcagacttcacagaacaccaccccaagctcatagctaacaataagaaagtgccatacgactggactatatactacctccgcaaaaaggcgctcacccagaaaatatcaaaagaggaactcgcatggatcctcctaaacttcaaccaaaagcggggttactaccaactacgcggcgaagaagaagaaacacctaacaagctagtcgaatactacagcctaaaagtcgaaaaagtcgaagacagcggcgaaagaaaaggcaaagacacctggtacaacgtccatctcgaaaacgggatgatctaccgaagaacctcaaacattccactggattgggaaggcaaaacaaaagagttcatagtcacaacagacttagaggcggacggatcccccaaaaaggataaagagggaaatatcaaacgcagtttccgagctcccaaagacgacgactggactttaatcaaaaagaaaaccgaggcggacatcgacaaaataaaaatgacagtcggcgcctacatctacgacacgctcctgcagaaacccgaccaaaagatccgcggcaaactcgttcggacaattgaacgaaaatactataaaaacgagctataccagatcctaaaaacacaatcggagttccacgaggaactacgtgacaaacaactctacatcgcatgtctcaacgaactatacccaaacaacgaaccacggcgcaactcaatatccacgcgggacttctgccatctcttcattgaagacatcatcttctaccaacgtccacttaaatcgaaaaagtcactaatagacaattgcccctacgaagagaaccgctacatagacaaggagtccggagaaatcaaacacgcctcaatcaagtgcatcgccaagagccaccccctataccaagagttccgactatggcaatttatagtcaacctacgtatatacaggaaagaaaccgacgtcgacgtaacgcaggaactcctgccaacagaggccgactacgtaacactgttcgaatggctgaacgaaaagaaagaaatcgaccaaaaagccttcttcaaatatcccccatttggcttcaaaaagaccacttccaactaccgttggaactacgtcgaagacaaaccatacccttgcaacgaaactcacgcccaaatcataacacggctcgggaaggcccacattccaaaagcctttctgagcaaggagaaggaagaaactctctggcacatactatactccatagaggacaaacaagaaatcgagaaagctctccattcgttcgccaacaaaaacaacctctctgaagagttcatcgaacagtttaaaaactttcccccattcaaaaaggaatacggcagctactccgcgaaagccattaagaaattattgccactgatgaggatggggaaatactggtctatcgaaaacatagacaacggaacacgaatacggatcaacaaaatcatagacggtgaatacgacgaaaacatccgcgaacgggtccgacaaaaggccataaacctcacggacatcacgcacttccgcgcactccctctctggctcgcctgctacctcgtctacgatcgacactccgaggtgaaagatatcgtaaaatggaagacacccaaagacatcgacttgtacctgaaatccttcaaacaacactcgctgagaaacccaatagtggagcaggtcatcaccgaaacactcagaactgtacgggacatatggcaacaggtaggacacatagacgaaatccatatcgaactcggtagagaaatgaagaacccagctgacaagcgggcgcgaatgtctcaacagatgatcaaaaacgagaacacaaatctccgaataaaagccctcctcaccgagttcttaaaccccgagttcggcatcgaaaacgtacgtccctacagcccctcgcaacaagacttactccgcatttatgaagaaggagttctcaactctatcctagaattacccgaggacataggcatcatcctaggcaaattcaaccaaacagacactctcaaacgccccacgagatcagaaatactccgctacaagttatggctcgaacagaaataccggagcccctacaccggcgaaatgatccccctatcgaaactcttcaccccagcgtacgagatcgaacatatcataccccaaagccgctacttcgacgattccctctcaaacaaggtaatctgcgaatcggaaataaacaaactcaaggaccgcagtctcggctatgagttcatcaaaaaccaccacggagaaaaagtcgagctagccttcgataaaccagtcgaagtactctccgtcgaggcctacgaaaaactcgtacacgagtcatacagccacaaccgcagcaaaatgaagaaacttctcatggaagacatccccgatcaattcatcgaacggcagctcaacgactcccgctatatctcaaaagttgttaaaagcctactctccaacatagtgcgggaagaaaacgagcaagaagctataagtaaaaatgtcatcccgtgcaccggagggatcacggaccgcctcaagaaagactggggaatcaatgatgtctggaataaaatcgtcctgccccgcttcattagactaaacgaattgaccgaaagcactagattcactagcataaatacaaataacacaatgatcccctctatgcctctagagttgcaaaaaggcttcaacaaaaagcgcatagaccaccgccaccatgctatggatgcgataatcatcgcgtgcgcgaaccgcaacatagtaaactacctaaacaacgtctccgcctccaagaacacaaaaatcacccgtcgagacctacagacacttctctgccacaaagacaaaacagacaacaacggaaactacaaatgggtaatcgacaaaccctgggaaacattcacacaagacaccctcacagccctccaaaagatcaccgtcagcttcaaacaaaacctacgggtaatcaacaaaacaacgaaccactaccaacactatgagaacggtaagaaaatcgtatcaaaccaatccaaaggagactcatgggccatccggaagtctatgcacaaagaaaccgtccatggggaagtgaacctccgcatgatcaagaccgtctccctaaacgaagcactaaagaaacctcaggccatcgtcgaaatggatctcaaaaagaaaatcctcgctatgctcgagctaggctatgacaccaaacgtatcaaaaattacttcgaagaaaacaaagacacatggcaatga

SEQ ID NO: 6383 - RNA, 3741 nt, synthetic construct
  misc_feature 1..3741: note = Cas9 variant
  source 1..3741: mol_type = other RNA
atgcgcctggtctacctagccctggcgcacatgataaaattccgagggcacttcctatacgaaggcgaccttaaagcagagaacaccgacgtccaagcactattcaaagatttcgtagaagaatacgacaaaaccatcgaggagtcacacctctcagagataacagtcgacgccctatccatactaacggaaaaagtgtccaaatcatcccgactcgaaaacctcatcgcccactacccaacggaaaaaaaaaacaccctcttcgggaacttaatcgcactctcattaggtctccaggccaatttcaagacgaactttcagctcagcgaagacgccaaactccaattctccaaagatacatatgaggaggacctagaaggcctcctgggtgaagtcggggacgagtacgcggacctattcgtcagcgccaaaaacctgtatgatgccattctcctatccggaatcctcaccgtcgatgacaatagcaccaaggcccctctatcggccagcatggttaaacgctataaagaacacaaggaagaattggctgcgttcaaacggttcatcaaagagaaattacccaaaaaatacgaagagatcttcaaagacgacaccaaaaacggatacgccggatacgtaggcgccgacaaaaaacttcgaaagcgctctggcaaactagccacggaggaagagttctacaagtacgtgaaagggatactcaataaagtagaaggcgccgactacttcctcgacaaaatcgaccgagaagacttcctccgcaaacaacgaacattcgacaatggctcgatcccacaccaaatccacctccaagaaatgcacgctatacttcgccgtcagggtgaacactacccctttctcaaagaaaaccaggacaaaatcgaaaagatcctcaccttcagaataccatactacgtaggcccgctcgcccgcaagggatctcgatttgcgtgggcagagtataaagcagacgaaaaaataaccccttggaacttcgacgacatcctagataaagaaaaatccgcagaaaaattcatcactaggatgaccctaaacgacctttacctccctgaagaaaaagtcctcccaaaacacagcccactctatgaaaccttcaccgtttacaacgaactaacaaaggtaaaatacgtcaatgagcaaggcgaagcaaaattcttcgacaccaacatgaagcaagaaatctttgaccatgtgttcaaggaaaaccgaaaagtcacgaaggacaaactgctaaactacctcaacaaagaattcgaagaattccgaatcgtgaacctaaccggcctcgacaaagagaacaaggcgttcaacgcctcgcttggcacataccacgacctacgcaaaatactggacaaaagcttccttgacgataaagtaaatgaaaagatcatcgaagatattatccaaaccctaacactattcgaagaccgcgaaatgatacggcagagactgcaaaagtactcggacatctttacgacccaacaactaaaagagctcgaaagacgccactataccggctgggggcgactcagctataaactaattaacggcatacggaacaaagaaaacaaaaaaacaatacttgactacctcatcgacgacggatacgccaaccgaaacttcatgcaactcataaacgacgacgccctgagcttcaaggaagagatcgcccgcgcccaaatcataggagacgtcgacgatatcgccaacgtcgtccacgacctgccgggctcacccgcaataaagaagggtatcctgcaaagcgtcaaaatagtggacgagctcgtaaaagtcatgggccacaaccccaccaacatcatcatcgagatggcccgcgaaaaccagaccacggacaagggccgaagaaactcccaacagcggctcaaactactacaagactcccttaagaacctagataaccccgtaaacatcaaaaacgtcgaaaatcaacaactccaaaacgaccgcctgttcctctattacatccagaatgggaaagacatgtacacgggtgagacactggacataaacaacctatcccagtacgacatcgatcatataataccccaagcgttcataaaggacaacagcctcgataatcgcgtcctcacacgcagtgacaaaaacaggggcaaaagtgacgatgtccccagcattgaggtcgtgcacgagatgaagagcttctggtccaagctactctccgtgaagctaatcactcagaggaaattcgacaacctaacgaaagcggaacgtggcggtctcacggagaatgacaaagcaggcttcataaaacgccaactcgtcgaaacccgacaaataactaaacacgtagcccaagtactagacgcgaggttcaacgcaaagcacgacgagaacaagaaagtcatacgcgacgtgaaaatcatcactctcaaatcgaacctcgtatctcagttccgcaaagacttcaagttctacaaagtgcgcgaaattaacgactaccaccacgcccacgacgcctacctcaacgccgtcataggaaccgcgcttctcaaaaagtacccgaaacttgcaagcgaattcgtttacggtgagttcaaaaagtacgacgtacgaaaattcatcgccaaaagcgacaaggagataggtaaagccacagccaaatacttcttctactccaacctcatgaacttcttcaaaaaagaggtgaaattcgccgacgggacagtcgtggaacgaccagacatcgaaacatccgaagacggcgaaatcgcctggaacaaacaaaccgatttcaaaatcgtacgcaaagttctaagctaccctcaagtcaatatcgtcaaaaagacagaagtacaaacccatggcttggacaggggcaaaccccgcggcctattcaacgcgaacccctcacccaaacccaaacccgacagctccgaaaatctagtgggcatcaaacgcaacctagacccgaaaaagtacggtggatacgccggcatctccaactcctacgccgtccttgtcaaagccatcatcgaaaagggagttaagaaaaaagaaaccatggtactcgaattccagggaatatcaatactcgacagaatcacgttcgagaaagacaagcgtgctttccttctagggaagggttacaaagacatcaagaagatcatagagctccccaaatacagcctattcgaacttaaggacggcagcagacggatgctggcaagcatactgagcacaaacaacaagcgcggagagatacacaaaggaaatgagttgttcgtgccccaaaaattcaccactctcctgtatcacgccaaaaggatcaacaaccctataaacaaagaccacatagaatacgtcaaaaagcaccgtgacgacttcaaagaacttcttaactacgtcctagaatttaacgagaagtatgtgggtgcaaccaagaacggcgagcgcctaaaggaggcagtcgccgacttcgacagcaaatccaacgaagagatatgcacctcgttcctcggagcagtgaactctaaaaatgccggcctcttcgaactaaccagcctcgggtcagcctcagacttcgaattcctgggcgtgaaaatcccccgctaccgggactacacaccatcgagcctcctaaaggatagcatcctaatccaccagagtataacaggcctctacgaaacccgtatcgacctatcaaagctaggcgaagattga

SEQ ID NO: 6384 - RNA, 3747 nt, synthetic construct
  misc_feature 1..3747: note = Cas9 variant
  source 1..3747: mol_type = other RNA
atgaagaaaatcctaggcctagacctaggatcagcaagtatcggctgggcagtaataacggaaaacgtcgaaaacggtatcaccaaatgcgacatcttgggtatggggagtcgcatcatcccatacgagggcaccgagggtaaagacttcaccaaaggaaccggcgagtcacgaaacagcctaagaactaaagccaagacggcacgcaaaggttacgacagataccagctccgccgcaagtacctggtagacacactcatcaagaaccagatgtacccagacgaagcaacccgcaacctaccaaaaatgaagttatgggaattacgggacaaagcagtccacagccccgtctcgctcatggaactcggccggctgctcctctggctcaaccaaaaacgcggatataaatcctcccgctcagacgccaacctaggaaagaaagacacagaatacgtagcaacggtaaaatcccggcacgagaaaatgaaagaactcgacgtcacaatcggacaatacttctaccgcgaactcagtgcgaacgaatttttcaaagtgaaggaaaacatcttcccccgcgaagcgtacatcgaggagttcgacgccatctgtaaaacacaacaaatagcgcacccaatgatactccgctcagaactgatcgacaagatcagaaacgaggtaatatactaccagcgcccactcaaaagccagaaagggcttgtttcagtctgcgagttcgaagggttctggagaatcggaaaagacgggaaggaatacttcgtgggccctaaagtagctccgaaaagcagccccctctttcaactagccaaaatgtgggaaaacataaacaacatcaaaatagggagccgcaccggggaagacctgaagctgacaaccgaacaaaagtgggcaatctttcaacacctcgacaacaacgaaaaactaaccccaacggacctcctaaagatcctaaaccttaaaaaggaaaattgttacgtaaacaaacagatgggcaaaggactcaacggaaacatcacgaaacacgcaatactgcaatgtctcggaggctcagacaaatacgagaatctgctgaaactcgaactcaaaatggtcgacggagacaaggaaggatacctgtacgaccgtaaaacaggcgaggtactcaacagcaaaatgataaagttcatagatcctatggtcgaacaagagcccttctaccaactctggcacataatctacagcatacacgaccaagaagagtgtagcagagtcctccaagcgaaattcgacatcgaacagccgatcgcagacaaactagccgccatcgacttcagcaagcacgcctttgggagcaaatccgccaaagtaattagaaaaatcctgccatacctcatggacggagacgggtactcggaggcgatgtcatacgcaggttatgaccacagcaactcccagacaaaagaagaaaacctacagcgaaagctattagacctcctaaagccaatcccgaaaaactcactacgccaaccaatcgtcgagaaaatcctaaaccaaatggtcaacgtggttaacgccatcatcgaaaagtacggaaacccagacgaaattcgcgtcgaactcgcacgcgaactaaagcaaagcaaggaggaacgcaatgatgctgacaaagccatgtctaaacgacagagagaaaacgacgcgataaccaagcgcctcgaagagttcggcttacgcgcgacccgaaataacatcataaaatggcgactgtatgaagaaatagacaaccaggaaaagaaactaaacgcaatgtgcgtctactgcggtcagcccatcagcctcaccgaagccctgcggggaaatgacgtcgacatcgaacacatcatccccaaaagcaaactattcgacgacagccaatccaacaagaccctagcacacaggcattgcaacaagaacaaaaacgacctaaccgcatacgattttatgaagggcaaaccagaagcagttttcaacgaatacgtagagcgcgttaacctgctgtacgacaaccatatcatcaggaaagccaagcgggataagctcctgatgactgagagcaaaatccccgacaacttcatcgaccgtcagcttcgagaaagccaatacatcgccaagaaggcacgcgaaatcctacaaactatctgccacgatgtgtggtcaaccagtggaaccgtgaccgcagaactcagacacctgtggggctgggacgacgtaacgatgaacttgcaaatggcgaagtaccgcgaactcggactcacacaccaagtagagtgggaatcagaacacggaaagaacaaacacgagaaagaagtcatcacggactggacaaaacgtgacgaccacaggcaccacgcagtcgacgcactaaccatagcatgcacgaagcaaggcttcatccaaagatttaacacactgagcgccgcaaaaacgcgagaagacatgatgttcgacattgaacaacggagccacgagttcaaagagaaaagatccctcctggaaaaatacataatcagcgaacagccgctgaaagtcgacgaagtagaaaaggccgtatctaacatcctcatcagcttcaagagcggaaagaaagtcgccgtgtggggcacccgcaagatcggcaagcgcggaagcaagaaggtgatccaaaagaaaatcatcgtaccacgcggcagcctctcagaagaatcggtatacggaaaaatcaaaaagcaagaagagaaagattacaagtacctcttcgaaaaccctcaactcatcttcaaccctacgatcaaagcaaaggtcgaggaacggctactaatgttcgacggagacgtcaagaaagcaatcacttcactcaagaaaatccctatttacctcgacaacaacaaaaccgtcgtattggagaaagccatctgcctcaaagacgagttcgtcatcaaatactctgtggatataaacttcaataaggtagacaaagtcgtagaccccaagatcaaagaaatactacaaaaccgactgaaaaagttcggtggaaaggaaaaagaggcctttaaagacgtacagctcgaggacaaaatgattatcaagtggtacgaagacgaaggcctcgaacgacccatcaaatcagtcaggtgcttcacaggcctcagcgcggtcgtccccgtgaagaaggacgaaaacggcaatgacatcggcttcgtcaaaccaggcaataaccaccacatcgcgatctacacggacacggaagaaaacaaacaacaacacgtatgcacgttctggcatgcagtagaaagaaagaaatatgacattcccgtcatcatcaaaaacacaaacgaagtatgggacaaaatacaatcacaaccggacggcacttacccggactcgtttcttgaaatgctcccgccacccaatttaaacctcctcgtcaacatgcagcagaacgagatgttcatcctcggcaccacaaccgaagacataaaactcgccatcgataaacgcgactacaaaattattggcgacaaactataccgacttcagaaaatgtcgatcaaaccatccagcggccaaatagacatcgtcttccgacatcacctcgaaactcagctcatcgacgacgagaactcgaagaaaagcaaacgcttctacaacgtacaaagcctgggagccttgttcgccctcaacccgttcaaggtacggatagacaacctaggcaacctagtcaaagaaaaatga

SEQ ID NO: 6385 - RNA, 3762 nt, synthetic construct
  misc_feature 1..3762: note = Cas9 variant
  source 1..3762: mol_type = other RNA
atgaaggcacggggaaacttccttcaccaagacaccccaggactcacagcagccaacgcaaacatgggagacgcagtagagaaactctgcgtcgccctggaggattggtgtacacttcgaaacctcgaatgcaacatacgcaaaaaccaaaagaacatacaaaaccttctagaaggaaagaccgtggaagtatccgccgaaaacgccctgaaagaaagttttgactcatcccgagcaagtcgcaaggacaaagccaccatcctgagcacatggatcgcgatccaacccggggaatacctagatgcgaagcaggcaaaagacgcatcaaaggagatagccaacgtcctctttggcctgcaagggaacatgaagaaaatattcatcgagttcgaagaagaccagaaaataaggctcgacaacgacgaacaagtcgaagccttctactcgctatgcccggatgacggagtggccctcttcgaatcattccaatcaatatactcggcgtacatcctcatgggcatactcaagaacgcaaacggcgggtcgatatcaagctgcaaggtagccgcgtacgaccagtacaaagaagacctaaaactcctcaaagacctcgtccgcgagttcgcctcagaaaaatatgacgagttcttccgcggggacatctttgactcatcaaagggtttcagggcccgcaactacaaccccgcaacagctaaaggatacacgaaatacaacagtgtgcgaggcgccagctacgacgacttcaagaaagaagtggagaaaatcttcaaaggaaccgtcgccgaagaagacattagatatgtggatatgatgcagcgattcgcggaaggcacctttctacgccgcctcaaaaccagcgacaacggcagcataccataccaactgcacctcgaagaaatggacgccattgtagaaaaccagaaacaattctatccatttctggaaagcgaaaaggagaaactcgagtcccttgtcacattccggatcagctactacgtcggcccgctaacccaaaagaacgctagactcgacaaccacaacaacgcaaggttcgcatggagccagcggaaggaaggcaaagaacatgcacgcgtatacccctggaattgggaagaagtcattgaccgaaaacagagcgcagccaaattcatggaacggctgacagggacctgcacatacattctcgacgagcccgtcctcccacgctgctcgctactctacgaagagtactgcctcctcaatgaactcaacggaagtaaatggcgagacatgggcggcgactggcaccgattcgattatgagaccagaatggaaataatagagaacctattcaagaaaaagaaagggtcagtgaaatacgccgcggtcgaggactggctcaaatgcgaaaaacacaaatcatgcgcggaagtaaaaggaggccaaggagaaacgggattcgaaagcaagctgtcgagctacgtgttcttcaaagaagtcctccacgtggacgaaatcgacgaggcagacataccaatgatagaggaactgatttggtggaacacactattcgaagacagaagcatcctcaaggaaagcatagaggacaagtacggcgaccgcctcaccgatgaccagataaaagccatctgcaagaaacggttcaccggctgggggcgcctatccaaggagctcctatgcggcatcaaaacccacactgacaacggaccatacagcatcatggacgtcctacgagagggcaaccccaataacaacgcacgctccgaaacgatggtattcatggagatactccgagacgacaaattcgggttcgacaaattaatcgaagaagagaacatgagacgcgtgtcggaggtcgacaacttcgacgtcaacgacctaccgggatccccagcggtacgccgcaccgtaaaccaggccaaacgcattgtcgatgaaatagtcggcatcgcaggatgcgaaccgcaaaacatctttatcgaggtcacccgcgacgaggacggacgcaacaagggccgcagaacaaaacgccgctacgataacatcaaaaatgcgatagcggccctcaagaaagaacagaaagaatatttcaacaaagacgtcagcgattccctcaacaaaacgaaccccagcgacctagacaacgagcgcctagccctctacttcatgcaaaacgggaaatgcatgtactgtggcaaggaccttgacataaagcaactcgacaaataccaagtcgaccatatactaccccagagctacgtgaaagacgactcgttcgagaataaagccctagttcacatggaggacaaccaacggaaaagcgcttcgatgctcctcgacgatagcatcatccggaaaatgaaaccttattgggaagcgctaagagcagcaggcctgatcggggaaaagaaatttaaaaacctaacgcgcgttcgtgtcagcgacaaagagcttggaggattcatcgcacgccaaatggtcgaaacgtcccagagtatgaaactaaccagcctcgtgctagagaaaacataccccaacaccaacgtccgcccggttaaggccgggttctcaagcgaccttcgcaaaagactagacctaatcaagtgcagagaaattaacgactaccaccacgcgcacgacgcgtacctcgcgtgcgaaatcggacagttcataacgatgcgtcacaacaagctatacgaaaaccccatatcatactcccatgccgtcaaagacttcattgctaaacgcgcaaaatacgccaacgaccacggcacaccaatgagtacatatggaatgcccggaagctcctctttcgtaatttcttcgttcctgacgtccggattcgatgaagaaaccggagaaatcttcaaagacgcgtggagcgccgaagtcgccgcggttcgaatcagggagagcttaaaccggaaagactgctacatatcgcggatgcccgaagaaaccagcggcgcattctggaaagaaactctcatcagtccacgcgatccaagcctgggtaaaaatctgtctctcccgatcaagaaaggactcgaccccagaaaatacggcggttacaatgaacagaaattcgcctacttcttcgtatatgaagccgtcaagatcaaaaagaaaggcgaagtcaaagaatatgtattcgcagcagtccccgtccaggtcgcagccatagtagccagagacccaaacgccttaaccggtttcgcaaagaaagacgcggaagctcgaaaaatcaaattcctccgcatcatccgggaaaaggtatacaaatatcagctaattgaagtcaacggcgaacgactatacatcaccgggctaaaaagcgtccgcaatgcccgacagatcgcactatcacaagacatgaccaccgtttttctcaaagccataaacgacaaagacgtcgccgaagacgagttaaagtcactcttcgaagagatcgtccaacgttaccggctgtgcgccaacagactaggaaatcaactaaaaatcttctccctcagcgactccttcaactccgccaactctgaatccaagaaacgcgcactcgtgagcctcgtcgcaattatcgacgccaagacgaacaagatagatctttccggcatcggatcgggaaaagcagttggcaacatgagactatcattctccaaagagatgtcaaacagcaaaaaccacttcgccttcatcgaccagtcagtcacaggaatgttcgagagaaagacctacctctga

SEQ ID NO: 6386 - RNA, 3777 nt, synthetic construct
  misc_feature 1..3777: note = Cas9 variant
  source 1..3777: mol_type = other RNA
atgaccgaggaaaacccggacatcagaaaagtcttcctcgccattcaccacatactcaagaaccgcggccacttcctcctccaaggacagagcttcaaagagggaaacctcaacaacctgataaaagaactactgaacctggacatcctacacatcagcatagaaattaccgaggagaacataaacaagataacagagatagccctcgagaaaaagactctcaccgacaaagtcaacgaccttaagaagatctacccaaaggaaaaacaactcctcgaagcattccggctaatcttcggaggaaagaccagcctggacaaactctttgccatcgacgagtataaggagctcgacgcctcggtaaagtcagtctccttcaaagagaagatctacgaagaagtcaggcacgactacgaacaagtcctatccaactacatcgaactcctggacttagcaaaactcgtgtacgatagcatcatactcagcgacatcaagaaggaaggaaagacgctgagcgaatccaaagtcgaactgtatcacaaacaccgcgaagacctcacgaagctcaaaacgctagtaaagaacgatagcaaactgtcagaagacaagaaagtcgaactatacagcgccatattcaaagaagataaagacaaaggcacaaactacgtgaactatatccgcaaaagcgaagaaggaaagggatgcaactacgaggatttcaagaaattcctagtaaaagagctcgccaagctagaagagtcctcggccaaggaagagatcctcagagacttggagctcgaactcttcctgcctctacaacgcactaaagacaattcggtggtgccctaccaaatacacaaggaagaactcgtcaaaatattagacaacgctgccaaataccataagtttctcaacgaaaaagacgactccggctactccatcatagagaaggtcatccaactcctcgagttcaggataccatactacgtgggaccattaaatagctccaagaaagccaaagttgacggctttgcatggtccgtacggaacaaaggctacgaaaacacgcccgtcacaccctggaactacgaaaaggtaatcgacgagtcggcgagcgccgaaaaattcattactaacttaaccaacaaatgcacttacctcaaaggagaagacgtcctccccaagtccagcctgctatactcggagttcgcgcttctcaacgaattgaacgcattaaaatacgacggtaacagaatcagtctagaagcccggaacgtaatcatcgaaaaactcttcaaagagcaaggaaagaaagtcaccaaaacgagcattaaaaacctgctcaaagcggagggatatatcgacggcaagggagaaataaccggcatagacatcaccgtcaaaaacgacctcaaatcttaccgagacttcaagaaaattctaggcgacaagttcaacacagaacacgtagagaatatcattctatggatcacgctctacggcgagtcacgcaaattgatcaaagccaagatagaagcagtctacggggacatatactctaaggaggagatcgccaaaatgtcccgcctggtatacaaggactggggtcgcttctcccgcaaactcttaaccgagctagtatctaaaaagctgtacaacgaagaaacaggagaatgcctaaacatcataggagcaatgagacaaaacaacatcctcttcatggaactgctagcggacagattcgactatagccagcaaataatcgactataacaaggaactccaaaaagaagtcaccgaaataacgccagagatactagatgatctgtacgtcagcccttccgtcaaacgcagcatctggcaaactgtccgcatagtcgaagaactcaagaaaatcataggctgcgctccggccaaaatctttgtggaaaccacccgatccaaccaggacaaaaagaaacccaccgacagccgaaagaaacagctggaactcttctacaaagcagtcaagaaagacgtgaaagacctcgagaaagaaataggatcgctgaattttgacaaattaaacgaacgactgagctcagttgagccgtccaaactgaaagcaaagaaactgtatctctactacacacagctcggtcgctgcatgtacagcggggagaccatagacatcacccaattgaacaccacagcctacgacatagaccatatatacccccaaagtaaagtcaaagatgacagcttcaccaacacagtgctcgtcaaacgcgagtacaacgccgcgaaaacagacagataccccctcggcagcgacatccagacgccttcaaaccgacgcttctggaaattcttaaaagaaaagggcctcatcactgacgagaaatataatcgcctcgtacgcacggaggagttcagcgacgaggaattgactggcttcatagcccgtcagctggtagaaacatcacagtccgtgaaggcagtcgcgggcatcctcggcgaactcaaccccaaaacaagcatatgttactcaaaagctgagaacgtaagctccttccgccagaatttcgggaaaataaaggaagggaaccgcaagtctgacaataccgaacagctaatcaaagttcgcgagatcaacgactaccatcacgccaaggacgcatacctaaacgtggtcgtcgggaacgtatacgacacaaaatttacacgcaacgtattcaacttcataaaagacaaaaaggatggccgtaaatactcgctcaataatgtgttctacgaaaacgtaagcaactcgaataacgtcgcctgggagctcaataagaccgtccatcaggtggaaaaagtcatgaacaacaacaatatcctggttacccgtcgcacctcagaacagaaaggcggtctgttcgacgcaacagtttacaaagcaaaggtcgccgccaaggcgaaagaaggagtgtactaccccctcaagacctcggaccccgtagtaaacgacgtcaccaagtacggcggattcaccaaggtcaagatcgcctactacagcatattcgaatacaccctagtaaacaagaaaggcgaagagaaaattacccgcatcatcccaatacccatctacgtcagccaaaacatcaaagacgactccactctcctcgagttcggaaaaacccaaatcaacatcaaatccggggaagaagtcaaagactttaaactcaaatacagaaagctatgcattggggacctcgttaagataaacaacttcttcaacttcattgggggcaagaccaacgactcattcgtatacgacggagccgtacaggtgactctggacaccgaatccgaacggtacatcaaaacgctgagcaagtaccagaactggaagaaagagaataaagacggtgaactatgggaatcaatcaccaaagaaaagaacaccgaactctacaacctcctagtcgagaaaatgaactccggaattttcatcaaaaagaaaccaaacaaattcaacgaactcaacagcgaagaaatacgcaacaacttctcctccatctccctcgaggaacaagcaaaagtgctcctagaagtcctcaacctcctgacaaataagaaatcaatcttcgatctcaaatcaataaacatcaccgcggcacgggggaaaatcagcttcaacctcagtaatctgtcccaattcagcataatagaacaaagcgtagcgggcttctacgaaaaagaaatcactatcatcggcgacaaagagaacgacatggaaaacaacaactgctga

SEQ ID NO: 6387 - RNA, 3780 nt, synthetic construct
  misc_feature 1..3780: note = Cas9 variant
  source 1..3780: mol_type = other RNA
atgaaatatatcctgggccttgacctcggcgtcgcatcaatcggatgggcagttaccgagataaacgagaaaggagagcccgtaggcctgatcgacgccaactccgtcatattcaaaccgctggataacgacaaggggaaactctacaacgtggaacgacgcgacaagcgcggcagccgccgtatcctgcggcgcaaaaagcaccgggtcgagaggacgaaaatgctcctagtaaacagctcattcctaacaaacgaagagatcgataacctctacgtcggcaagctcgacaacatatacgaggtccgcctgaaaggtctgaaggaacaactgagcaaaaacgagatagcccgactaatgatttactactgcaagaaccggggtttcaaatccaaccgaaagacggaggacctcgagatcctcaagagcctcggcgagaaaatcagtgaaaaggactccgacgaaaagaaactcaagcccataatcgccaaaaacaccgaactgatagaatccaaaggcctcaccccgatcgaagtaatatacatgatccgagaaaacgacaactcgatcctcggcttcaaaaacaaagaaggtaactataaattcggtttcaaaagaaaccaagtcatcgacgaagtgcgaaaaatactaggaacccagcaaatactctcaaaagagatagtggacgagtacatagacatcctctcttcccagcgggacttctcagacggcccgggcggtgactctaagtacaaaatagattacacaaaacttgcagggaaatgtaaatacacaggagaagtccgagcggtaaagagcgcgccaagttacgagatcttcacaatgctacagaagctgaacgacatcagatacgtgaaatttaccagtgaagacaagatagagaagaagaagctctcaaaagaggtaatacacaagctgtacgacctagtagtggagaaaaataaaactctaacctacgacctcatagaaaagagcattgacgaagagaacatcaaactactcaacattccgaagctcagcaagtcgaaatacgtggaactccgcaagagctacttcaaggagcgaaacgacaatgaaaacttaaccgaagaagaaatcaacgctttcaacgaaaagctaaacaacgagcgcatgaaacaggaactgatacgcaacaacctcaaagcctacaaagaactcaaaagcaaattcaaaaagaacaacatagacgagaaccgaataaaggaactaggagggatatactttttagacctcgtggccgaactccttacatatagtaaaacagacgagaagctggagtacttcgtagaaaacgtcgaacgctacagcctgttcaaggaacaaagggacatcgtagagatcataaagaccttccccaactacactaaaaacgggaacctgtcccttagcctcgtaagagaactgaacaaactcctcatggaagggcacgattacgagtccagcctcagcagcctgaactactacatagacaccgacgtcgactgggaaaaatttcccacaataagtgagatcgaagacagcctatccaccaaaattaccaatccaaacgtcaagcatatactcgtcatcctccgaaaactctacaatacgctgctattcaagtatggtcggcctgagaaggtccacctggaactgtctagagacttcagcaacgacttctcgacccgaaacaagatccaaaaggagcaactggagaataaagtccgtcgcgaagtcgcagcgttcgagatgtacggagcaaacaaagacatagtcgcaggaaaagaccgactctcgaacgacgacttcgtccgcataaaactctgggaagaacaaaataaagtatgcatgtactcaggccgcacgatcgagaaatatcagctaacgagcgcagaggtgcagatcgaccacatcctcccctacagcaagtcctttgacaacagctacagcaacaaagtgctagtgttttccaatgaaaaccaggacaaaaaggaaagaaccccttatcagtggcttaaggggacggagaaatggaacgagttcaaacaacgcgtaaggctcaacctcaacatctcaaacaaaaagaaagagaacctgttattcgaagatgaagtggtgaacaacgagttcctagaaagagagctgcacgctacgagctattccagccgcctcgcactaaacatcttccaacgtctgataccagtaagcgacgaggacaaatacgacgaacacggaaacgaaaaggtaaagtacctgtacaataggaacgtaatcgccttccagggcaagatgacgagtatgctccgcaacctatacagcctgaataagtacacacactcgttcgagagcgacacgctggatattgacaacaaagccttcatcctcaaagagttcgagattaataaggacaacctaaaaatgaccgcatacaacgtcaacacaggcctcgagatcacctcagaaacgaaggtggaaaagaacaaatccggcgagttcaaaaccattaaggacgaactgctcaagaaggaactcgacaagaaagagaacctaatcgagatcagcgactacttcaaagacaaggtgttattcgacctcaaaatcgttgactttgaagaaatagacacagtggaacccgaaatcatatcaatcctatacaaaatgatcacagccttaaaagaagaggtctacagcaaaaaccgagaaaaccacctacaccactcccttgatgctttcctcttaaccataatgaacaggagtatgcagatgaaactcatcaaatacaaccagctaatctccgtcctcaaaaacaaggaaatagagatcttcaacgaagagaagggcgagtatatagattccaaggagttcgccgaagaactccaaaaacagaaaataattgacatagacggaaacgaacggggaatcaagttcaacgtcaacggaaagacccaccgcctgaatctagttaagccctacgagaacttcctcgacgacataaagaacaaaatcttcgacaaacgcgaaaacaacaaactgccctaccacgtcgttaagagcaaagtaagcggagcactgcacgcagaaacaatactgggagaaagtaaaggcgaaatcacaaaacgcatatcggtattcgacatcaactacaaaaacctcggcaaaatattcgacaaagacggatcacaaaaagagatttacgaaacattagtaaaatggctcgaagcaaaaagcaaagactaccccaaactcaaaaacggaaacataattaagaaggttaagatcgtcgatgggaacaaggacaaactaatcaaactcggcaacaagaggtacgtcgaaatgggcagaaccaccgtgaaaatactggtattgaagaaggaagccgaggaaggtctgaaatttgcaagcatcggccggtacaaatacaacctattaaagtcagagaaagatgtcaacatatcaatatggaaggacgccatacacttctgcaaggtcagatacaacaagctgaaagagaacggatacagactcatccacgaacttatacccggagagacaatcgaactcgaactcaacaaaggtaacatttcgaagtgcctcgtggtcggcttctccggcggaaagatcgagatcagctcagtcatcggagacgccctcgacctgatcaacgacaaaataagcaccagaatcaaggaacgatactacatcaccgttagcacaatcaagtcaattaagaaaataaacaaaaacatactgggagactga

SEQ ID NO: 6388 - RNA, 3792 nt, synthetic construct
  misc_feature 1..3792: note = Cas9 variant
  source 1..3792: mol_type = other RNA
atgcacaaaaataatcccgacatccgagaactcttcctggcgatccatcacatactcaaataccgaggacatttcctgttcgccggtcagcaattcaaaggaagtgagatcaaggacaacatccgggaactcctccagtacaattccttgaacatcaaaatcgacatcaccgacgagctcataaacaacatcgctgaaatcctactcaaaaagaaaaacagcaccgacaagataatagagttcaagaaactcttcgccgacgagaagcaactcatagaagcactgagacttgcactgggcaacaaaacccaactggccaaactattcgacatcgaggcgtacaaggaactggacatctccataaagaccatatcctttaaagaaaagatctacgaggacgtccgcagcaactacgaggagatcttaggagaatacatcatcgtcctagacacggcaaagttaatatacgacgcgataatcctctcagaaatcaagattaaaaatatgacgataagcgagtcgaaagtcataagctacgaaaagcacggaaaagacctcaagcaactaaagcagctcataaaagaagacagcaaactctccaagaaggagaagcgtcaactcttcgaaaacatctttgtaaaagaggacgaaaaggaggcaaactacgtaaactacataggcaagaataatgtaggttccagcaagagttcctgtagttacgaagacttcaagaaatcgcttataaaagagttaaaatactgcgaagagagcaaacttaaacaagacatcctcgcagagctcgaactagaaacattccttcccagacaacgaaccaaagacaacagcgtgatcccgtaccaaatccacaaggaggagctggagaaaatcctcaacaacgcagtacaataccaccccttcctaaacaacacagatgagtatggcatctccataaaggaaaagataatccaactcttagagttccgtattccttactacgtcggcagcctgaataccagccacaaagtcggcaacggcggcttttcctggagcgtgaggaacaagggctacgaaaggaccgcagtcacgccgtggaacttcaacaaggtcataaataaggaagagtcagccaaaaacttcatagagaacctgaccaaccaatgcacctacctcctgtacgaagacgtgctgcccaaacacagcctcctctacagcgagttcacgctcctaaacgagcttaactcaataaactacggcggcaaacgcctgaccgtagaacaccgtaacctcataatcgaaagattcttcaagcagtcagccccaaaggcaactggcaaggaactcaaaaagttcttaatgagcgagggcgtgatagatggcaaggacgaactatccggcttcgacatctcaataaagaacgatctgaagtcgtaccgagacttcaaaaagatcctgggagagaagttcgactctgagaaggtcgagaaaatgatcagatggatcacactcttcggagagtctaaacaactgctcgtagacaagataaccaaggagtacggagacatatatagctcggaggaaataaagaaaataagcggcctaacctataaggactgggggcgccttagcgaaaagctactcaccgagatcgtaagctcccaactgtatgacgagtccaccggcgaatgttttaacataattaacgccatgaggaacaacaccctactcttcatcgagttgctgggaaccaactacgattacttcgagaaaatcaatacgtacaacggaaaacttagaaaggaaatcaccgagatcacgccccacatcctcgacgacctctacgtctccccggcagtgaaacgctccatctggcaggttgttcgcatagtcgaagaactgaagaaagttatcggtagcgaacccaaacgcatttttgtcgaaacaacacgcagcaacaaagaaaagaaaggcgacgatgggcgcaaagacagccgaaagaaagccctactggaactatataagaaaatcaaaaccagtgacatcgcggagctagagaaagcacttggccacacagtagacttcgacaaaaagaaacaggacctcacggacatagacaacaacaaactcaaagccaggaaactctatctatactatacccaacttggtcgatgcctttataccggcaaagcaatcgacctgaacaacctgttcggctccaacagcgaatatgacatagatcacatctacccacaatccaagacgaaggacggaagctggaacaatctcgtcctagtaaacaaaacagaaaacagcaaaaagtcaaatggcctcatatcggagtccatccagcgcaaaaacaaacacttctggagattcctcaaagctaaaaacctaatctcggaagagaagtataaacggctgacccgcacagaagacttcaccgatggcgagctgtcgggctttatagcgcggcagctaatagaaacctcacaaagcgtgaaggtcgtgagcaaaatactccagaatctaaacccaaccacagagctatgcttctccaaagcggaaaatgtatcggacttccggcaagagttcggaaagataaaggtgggcaagcgcaaaaacctgaccgaagaagaacagaagaaagccaaagaaggccagctcatcaaagtaagagacctgaacgacttgcatcacgcgaaagacgcctacctgaacatcgtcgtcggcaacgtctaccacatcaaatttaccaggaaccccaaaaacttcatacgcaaaaacttcaagaaccgcgaatacaccctcaacaccttattttactcagacaaagtcgagaggaacggagaagtggcctgggagaagggcaaaacagaagagatcgtctcctcagtaatgtgcaacaacctgatcaacgtcacgcgacgcaccagcgagcaaaaaggcgcgctctatgaggcaacaatctataaagccaacgccgcgaaggaaggaagctattatcccgtcaaaaccaacaataaaaatctcaaaaacgtcaccaggtacggcggcttcacatccatcaaaatcgcatactactccattttcaagtacgatatccgaaacaaggacaaggtcaaggaaaacatcaagatcatcccgatacccatctacataagccaaaacataaaaacagacctggacctaatcaacttcgctgaaaaacagatcaaacttaagaaaggggagaacatcgaaaacctgcaattaatatataagaaactcaacataggtgctctggtaaaaatagaccactacccatactacatcggtggaaaaaccgacgacaacttctacgtagacggggccgtacaagtactgctcagtagcgacatagaacgctacctcaaggaagtagtcaagttcgtgaacttccaaagagaaaacaaggaggctaaagtctcgaaagaacacatctctctcgaagagaacatcaaactctacaacacgttggtatgtaaaatggcaacaaaaatattcacgcacaagaaaaataacaaatacaacgacttgactcaagacaaagccaaaaacaccttcaacaagctaagcctcgaggaacagtgtaaagtcctcctagaaatcctaaaccttctcacaaataagaaaaccacctttgacctcagcttgataaacgagaagaccagccgggtcaagtgcggcttcaacctacttaaccaaaaacagttcagcataatcgaacaaagcgtaacaggcctctacgaaaaggaaattaaaataatcgaggactga

SEQ ID NO: 6389 - RNA, 3795 nt, synthetic construct
  misc_feature 1..3795: note = Cas9 variant
  source 1..3795: mol_type = other RNA
atgaaaaacgtcctgggcctcgacctgggcactaactcaatcggatgggcgctcatagaggtcgacgagaacaacctccccatccggatcatcgccatgggctcacgaatcataccacttagcacctcagacaaagaagagttccagcgggggctctcaatcactaaaaaccaaagccgaacagtctcgcgcacccagagaaagggctacgatcgcaaacaactcaaaaagagtgacctaaagaagatcctcaacaaatacaatatcttcccatccgaagaattactacggctaccaatgctagatctctggaagctacgctccgactcagccaacccagacgaaaacatctcagccgaacagctgggccgaatactttacatgctcaaccagaagcggggatacaaaagcgcccgctccgaggccaacgcggacaagaaagactccgactacgtccaagccgtaaaagggcgatacgaccaactcaaagaccgcaaacagaccatcggccaatacttctacgacgagctatacaacgccaatgcaaataactcgtacttcagaatcaaagaggaggtgtacccccgagaagcatatatagaggagttcgacaccattatttctgcacaaagggaaaaacacgacttcctgacagacgaagtagtccatcagctcagaaacgaaataatctacttccaacgaaaactgaagtcacagaaaggcctcgtgtccatctgcgagtttgagggcttcgaaaagacagtattcgacaaagagaaaaataaaaacaaagtcgtattcgtcggcccaaaagtcgcaccaaaaacaagccccctatttcaactctgcagaatatgggaagtcgtaaacacgatcacactcaagatcaaaaacccggaaggatccaagtataaatggggcgagaaaatacccgatatcaaagaaaaagaaatcctcgccgactacctcttcaagaacgaatcgctgagcttctcgaaactcttagaaatcctagaattgaagaaagaaaatgtatacgtgaataaacagatactaaaaggcatcaaaggtaatgaaacttactccgcccttcactcaatactaggagacaacgaactcctgaacttcgatgtgagcataatgacaagcaaccaaaccgccctcctcgtagaccggaaaaccggcgaaatcctagaagaaagggccggactcgaattagacgcaagcctagagaaagagcccctctaccaactatggcacactatctactcattaaaagatctagacgaatgcaaaaacgcactgataaaacgatttgacttcgacgacgagacggccgagaaactcagcagaatagacttcaacaagcaagcattcgggaacaaatcgaacaagtcaatgcgcaaaatactcccattcctcatggaagggtacgactactcccaatctagcagcctagccggttacaatcactccaacagtctaaccaagaacgaacgcgagcaacaaatcaccctcgaccgtctagaactccttccgaagaacagcctgagacagccaatagtggagaaaattctcaaccagatgatcaacgtagtcaacgcaatcctagacgaatacggcaagccatccgaaatccgcgttgaactggcccgcgaactcaagcagtccaaagacgaaagaaacgagaccgacctgcagaactcgaaaaacaagaaactaaacgacgaaattggcaaacggctcgaggagctgggactaccagtgacaaaacgctacatccaaaaatacaaattcatattcccctccctcagtaaaaacctcaaggaggcaaaggtaaacaatcagtgcatatactgcggcgagaccttcaacctgaccgaggcgctgtccggagacgcgtacgacgtagaccacatagtccccaaagccctactcttcgacgactcccagactaacaaagtactggttcacagaaagtgcaactctaccaaaacgaaccagaccgcctacgattacatagcaacgaaaggggacgagcacctcaagctctatagtgaacggcttgatgactggtttgaacgcggaatcatatcgtattccaaaatgcaaaggctgaaggtaagccacaaagaatacctagagcgtaagaaactaggaaaagaaacagaaaccgacaagaaactgtgggaaaactttatcgaccgccagctccgcgacacgcagtacataagccgtaaatcccgcgaaatactacagaaaatctgtaacgatgtgaaaacgacggagggtggagtcaccgccaagctcaggaacctatggggctgggacgacgtcctcatgaacctccaaatgcctaagtacaaagagcttggccaaaccatcaccaaagaatggacctcggaacacggcaagcgcaaacaccagaaagaggaaatagacaactggaccaaaagagacgaccaccgacaccacgccatcgacgccctggtcatagcctgcacaaaacagggcttcatacaacgcatcaacacgttaaactccagcgacacgaaagacctaatgataaaagaagtcgaagaggcgaagatagaatttaacgaaaagactacactgctggaaaagtacctcaaaacccagaaacccttctccacacaagaagtcatgaaagaagccgacaagatattagtgagcttcaaagccgggaagaaggtcgccacaatcacaaaattcaaagcaaccggcaaaaacaaagagacaggcgttatcgtgccccggggcgcgctacacgagcaatcggtctatggaaagataaaagtcatagaaaaagacaaaccactcaaatacctcttggaaaactcagacaaaatagtcaacccgcggatcaaaaacctcatagagatcaaactctcagagaacaaaaatgaccccaagaaagccctcctagcgctcaagaaaatacccatcttcctggacgaagaacaaagcataaccctagaaaaagcatcctgctacaacgacgccactgtactcaaatacaaacttcaaaacctcaaagccgcccaagtagacgacatagtagacgagaaggtaaagaaaatcgtgcgcgagcgcctctctcaattcggtaacaaagagaaggaagcattcaaagacacactctggttcaacgaagaaaagaaaatcccaatcatcacagttcgcctcttcgcacgccccgacgccaataacctccagaccatcaagaaagacgaaaacggcaacgggatcggattcgtcgtcacgggcaacaaccaccacatagcgatctacgaagacaaagataacaaaccagtgcagcacagctgcaccttctggcacgcagtcgaaagaaagaaatataacatacccgcggttattcgagacagctcagaggtctggaacgacctactccgaaaagaactccccgaatcctttctgaataaactccccgctgacaacctaaacctaaaatttagcatgcaacaaaacgaaatgttcatcctgggactttcacaagacgaatttgtgaaggccatcgcaaacaacgacaaaagcctactatcaaaacacctctacctcgtgtggagcatatcagaaaacaactactggttcagacaccacctagaaacaaagaactccgacctaaagaaaacagacggcgtcaaagaatccaagagactctacaacatccgatcgctcggctccttgttctccctgaacccaatcaaggtaagactgaactacctaggagaaatcacaaagataggcgagtga

SEQ ID NO: 6390 - RNA, 3801 nt, synthetic construct
  misc_feature 1..3801: note = Cas9 variant
  source 1..3801: mol_type = other RNA
atggcgaagtacatcctagggctcgatctgggaactaactccatcggatgggctcttatagaagtggacgagaacaacatcccaatccgaatcatcgtaatgggctcccggatcatccccctcagtagcaacgaccgcgaggagttccaacgaggcctctcgatcacgaagaaccaaaaccgaacaatcagccgaacgcaacgcaaaggatacgaccgcaagcaactaaagcgcaacgacctaaacaaagtactcaacaaatacaatatattcccaagcaaaatgttacttaatctaccgatgctagacctctggaaactccgctcagattcagcaaactccaataaggacatctcagcagaacagctcggcaggatcctttacatgctcaaccaaaaacgaggctacaaaagcgtacgaagcgaagcgaactcagacaagaaagacaccgattacgtacaagcagtgaaagggcgctatgcccaactaaaagatcggaaccaaacgatcggccagtacttctacgaggaactgtacaacgcaaacgtgaacaatagctacttcaaaatcaaagaggaagtatacccccgtgaagcctacatagaagagttcgacactataataaacagccagaaaacgaaacacgagttcctcacagaccaattcgtacatcaactccgcaatgaaatcatatacttccaacgtaaactaaaatcacagaagggactcataagcatctgcgaatttgaagggttcgagaaaacagtattcgacaaagagaaaaacaaacacaaaatcgtgttcgtcggccccaaggtcgctccgcgctcggcaccactgttccaactctgtcgcgtttgggaagttatcaacactataagcatcaaagtaaagaacccagaaggatcgaaatacaaatggggagaacgtatcccgagcatcaaagaaaaagaaatactcgctgattacctcttcaagaacgaagtactatccttcaccaaattactcgaaatcctcggcctcaacaaaaatgacgtctacgtgaacaagcaaatattgaaaggcataaaagggaacgaaacatacgctacactatacaacatacttggggaaaatgagttcctcaacttcgacgtaagcatcataccatcaaaccacacgtcgatgcttgtggacaagaaaacaggagaaatactcgaagaacgcgcaggcctcgaactggacgtgtccctagaaaaacaaccgttctaccaactctggcacaccatctactccctgaaagatctagatgaatgcaaaaacgcgctcataaaaaggttcgacttcgatgacgagaccgccgagaatctatcccgcatcgacttcaacaaacaagccttcggcaataaatccaacaaatcaatgagaaagatcctccccttcttaatggaggggtacgactacagccaatcgtgcagcctggcgggctataaccacagtaacagcctcacaaaggacgaacgagaacaacaggtaacgctggacaggctagaactcctcccgaagaacagtctacgacaacccatagtggagaaaatcctcaaccaaatgataaacttggtcaacgccatcctcgaccaatacggcgagctcagcgaaatccgggtcgaactagcccgggaactgaaacaatccaaagatgaacgcaacgacgccgacctccagaacacaaagaacaaaaagctgaacgacgaaataggcaaacgcttggcagagctaggactgccgattacaaaaagatacatccaaaaatacaaattcatattcccatccctctctaaaaacctcaaggatgcccatgtcaacaaccagtgtatttactgcggcgaaaccttcaacttatccgaggccctctccggagatgcctacgacgtcgaccacatcgtcccaaaggccttactctttgacgactcccagacaaacaaggtcctcgtccatcgcaaatgcaactccaccaagactaaccagaccgcctacgactacatctccacaaagggagacgaacaagtacgaatctacttcgaacgcgtcgacgactggttcaaatcaggaatcatatcctacagcaagatgcagcgtctaaaagtatcccacaaagaatacctggaaaggaaaaagatcggcaaagagaccgaaacagacaaaaagctctgggaaaacttcatagaccgccaactgcgagacactcagtacatatcccgaaagtcccgcgaaatactgcagaaagtttgcaacaacgtcaccaccacagaagggggcgtaacagcaaagctaagaaacctctgggggtgggatgacgtcctcatgaacctccaaatgccaaaataccgtgaactcggacaaacagtgatcaaggaatggacatctgaacacgggaaacgcaaacatcagaaagaggaagtcgaaaactggacaaagcgcgacgaccaccgccaccacgccatcgacgcacttgttatagcctgtacgaaacagggctttatccaacgaattaataccctaaactcatccgacactaaggacctcatgctcaaggaggtagaagaggcaaaagtcaaattctctgagaagacaacacttttagaaaagtacctacgaactcaggagcccttcagcacccaagaagtaatgcgagaggcagacaaagtcctagtatcattcaaggcaggaaagaaagtggccaccattacgaaattcaaggcgatcggcaaaaacaaagacagcggcgtcatagtaccccgaggggcgctacacgagcagagcgtatacggcaagatcaaggtcatagaaaaagacaaacccctcaaatacctcttcgaaaattccgacaggatcgtggaccccaaagtaaagaaactggtcgaagtcagactatcagaaaacgagaacaactccaaaaccgccatcagcacactaaagaaggcccccatcttcctcaacgaggagaaaaccgaagtcttagaaaaagcctcctgctacaacgacgcgactgtcctgaaatacaaactccaaagtataaaagcctcacaggcagacgatatcgttgacgaaagggtcaagtttctggtaaaggaacgattagcccaattcggcaataaagaaaaagaagcctttaaagacatcctttggttcaacgaggaaaaacaaatcccaataatcagcgtccgactgttcgcaagacccgacgcaaacaacctccaagtaataaagaaagacgaaaacggaaagagcatcggcttcgtcctaacgggcaacaaccaccacatagccatctatgaagacaaggacaacaagctcatccaacactcttgcacattctggcacgcagttgaacgcaagaaatacaacatcccggtggtgatcaaaaactcatcggacgtttggtcgcaattactggacaaacagctaccggagtcccttctgaacaagctaccgacggacaagctcaaccttaagttctccatgcaacaaaacgagatgttcatcctcggactctcccagaaagagttcgacgaagccatcaaaaacaaccacaaatcattcctctccaaatatctctacctagtctggagcatatccaacaacgactactactttcgacaccacctggaaactaaaaacacagagctgaaaaacataagcacagccaaagaatctaaaagatacttccgattcaaatccgtaggtgctctcgtcggcaccaacccaatcaaaatccggctaaaccacctaggtgaaattaacaaagtgggagagtactga

SEQ ID NO: 6391 - RNA, 3807 nt, synthetic construct
  misc_feature 1..3807: note = Cas9 variant
  source 1..3807: mol_type = other RNA
atgaccaaaaacatattggggctagacctgggaaccaactcgatcggctgggcactgattgaagtcgacgaaaacaatacgcccatacgcatcatcgcgatggggtcccgaataatacctctcagtacgtccgacaaagaggaattccagagaggcctaagcataacaaaaaaccaatctcgtacagtaagcaggacccagagaaagggctacgaccggaagcaactcaagaaaagcgacctcaaaaaaatcctgaataagtacaacatattcccctcggaagagctactgaagctacccatgctagatctctggaagctccggtccgacagcgcaaaccccaacgagaatatctcagcggaacagctaggacgcatattgtacatgctaaaccaaaaacgaggatacaaatcagcacgatcggaagccaacgcggacaagaaagacacagattacgtccaagcggtaaagggccgttacgcacaactgaaagaacgcaaccaaactatcggccagtacttctacgaagaactatacaacgccaacacgaacaacagctactttcgtatcaaagaagaggtctaccctcgcgaagcatacactgaagaattcgataccatcatcaacgcccagaaaaacaagcacgactttctaacggatgaggtcgtccaccaactccggaatgagattatatacttccaaagaaaacttaaatcacaaaaggggctggtatcgatctgcgaattcgaaggctttgaaaaaacggtcttcgacaaagaaaaaaacaaagacaaagtggtgttcgtagggcccaaggtcgcgcccaaaactagccccttattccaactgtgccgcatctgggaagtagtcaacaccatctccctcaagatcaaaaacccggaagggtctaaatacaaatggggggagaaaattccaaaccttaaagaaaaacaaattctcgcagactacctatttaagaacgactccctcagcttcactaagctcctggaaatcctagacctcaacaagaatgacgtctacgttaataaacagatcctgaaagggatcaagggcaacgaaaccttttcgaccctacacaccgtcctcggtgacaacgagttgctcaacttcgacgtgagcataatcccctccaaccataccagcatgctcgtcgacaaaaagaccggcgagatcctcgaggaacgcgcgggactcgaactggacgcaagtctggagaaagaaccactctaccaactgtggcacaccatttacagcctcaaagacctcgacgaatgcaagaacgccctcataaaacgcttcggcttcgatgacgagaccgccgaaaaacttagtcacatagatttcaacaaacaagcattcgggaacaagtccaacaaaagcatgcggaaaatacttccgttcctaatggaggggtacgactactcacaatcctgcagtctagccggctacaaccacagcaacagcctcacgaaagatgagagagagcaacaaatcacactagaccggctagagttgctaagcaaaaactctcttcggcaaccaatcgtggaaaaaatcctcaaccaaatgatcaacgtagtgaacgccatcctagaacagtacggaaagctctcggagattcgtgtcgaactagcccgtgagctcaaacagagtaaagacgaacgcaacgacgcagacctccagaatagcaagaacaaaaagctcaacgaagaaatcgggaagcgactcgccgaactcggcctaccagtcacaaaacgatacatccaaaaatacaagttcatcttcccaagccttagcaaaaatctgaaggatgcccacgtgaacaaccaatgcatctactgcggcgaaacgttcaacctaacagaggcactaagcggtgacgcattcgacgtggaccacatcgtgccgaaagccctgctcttcgacgactcccaaaccaataaagtactagttcaccgcaaatgtaactcaacgaaaaccaatcaaacagcatacgactacattggcacaaagggcgaagaacaagtgcgagtttattccgaacgaatcgacgactggttcaagcgcgggataataagctactcgaaaatgcaacgcctgaaagtcagccacaaggagtacctagaaaggaaaaaactcgggaaggaaacagaaacagacaaaaaactatgggaaaacttcatcgacagacaactccgcgacacacagtatataagccgaaaggcccgcgaaatactccaaaaagtctgcaacaacgtcaccacgaccgaaggaggcgtcacagcaaagctgcgcaacctctggggctgggacgatgtactcatgaatctacagatgccaaaatacaaagaacttgggcagaccgtaataaaagaatggacttccgaacacgggaaacgcaaacatcaaaaggaagagatcgagaactggacaaagagggatgaccaccgacaccacgcaatagacgctctagtagtcgcatgcacgaaacaaggcttcatccaacgcataaacaccctcaactcctccgacacgaaggacctaatgcagcgagaaattaaagaggccaaaaagctcctaggcgaaaactacaacgagaaagaattcgaaaacgacaatgaattcgtaaagaaccacaaagaacgcctcagccaactcgacgattacctcagattgcaaaaacccgtaaaatttgacaccaaatacgtcgaacaagaggcagacaaagtactcgtctcattcaaagcaggcaaaaaagtagccacaatcacaaaattcaaagccactggcaaaaacaaagacaccggtgtcatcgtgccccgcggcgccctccacgaggccgggctctacgggattcgcaccatctatagcaagggcggcatcgcggagaaacacatcatcaaaaagtacaaagtgggcgtttcagcacaagaccacatcttcacgggaaaagagacatatagcgttaagaaggacaagaacggaaacgaaaaagtcgatgataaaatcaaaatcgtccttgactcaatagtcgacaacaaggtcaaagaagtcgtgcttaaccgtctaaacaggggattcaacaacgaagaagattacagaatagacgtaaaaaaggctctgaataacttcaaaaacctagacgaggacccactctggtacaacgaatccaaaggcataaagatcctatcaatcaaactaaagacaggactcaaagactccgtagtgccgcttcgcttaaacgagaaaaacgaagtgatcacactcgtaaaaacaggcaacaaccaccatatcgcaatctacgaagacaacgacggcaagctaatccaatatagctgcacgttctggcatgcggtagaacgcaaaaaatacaacatcccgactgtcataaagaattccagcgaggtatggaatcaagtactggacaagaagcttccagaatcgttcctcaaccggctccccgcggacaaactcaacctgaagttcagcatgcaacaaaacgaaatgttcatcctgggactccttgaagaagagttcgacaaagccataaaggacaatgacaaaagcctcctctcgaagtatctctacctggtctggagtatagcagaaggagactactggttccgacaccacctggaaacaaaaaacaccgaactgaaaaaaacaaacggcgccaaggaatccaaacgctatttccgcctaagcacaaaagggcttatagacctgaacccggtaaaagtaagactcaaccacctgggcgagattacgaagataggagagtactga

SEQ ID NO: 6392 - RNA, 3810 nt, synthetic construct
  misc_feature 1..3810: note = Cas9 variant
  source 1..3810: mol_type = other RNA
atgaacaactcaattaagtccaaacccgaagtgaccatcgggctcgacctaggcgtcggctccgtgggctgggcgatcgtagacaacgaaaccaacatcattcaccacctaggctcgcgactcttcagccaagccaaaaccgccgaggaccgcagatccttccgaggcgcacgcaggctgatccgcaggcgaaaatataagctaaagcgcttcataaacctaatatggaaatacaactcatacttcggcttcaaaaacaaggaggacatcctaaacaactaccaggagcaacaaaaactccacaataccgtcttaaacctaaaactggaggcccttaacgccaagatagacccgaaagccttatcctggatacttcacgactacctaaagaacagaggccatttctacgaagacaaccgagattttaacgtgtaccccaccgaggaactcgccaactactttggcgagtacggctactataaaggcataattgactcgaaagaagataatgacgacaaactcgaagaagggttaacgaagtacaaattctcaaaccagcattggctagaagaaatcaaaaaggtcctaagcaaccaaaccggccttcccgagaaattcaaagaagaatacgaaagccttttctcttatgtacggaactattcggaaggccccggctcaataaactctgtaagcccatacggcatataccaccttgacgaaaaggaaggaaaagtggtccaaaaatacaacaacatctgggacaagaccataggcaaatgcagtatctttccagacgaataccgagccccaaagaactcaccaatcgccatgatcttcaacgaaatcaacgagctatccacaataagaagctactcgatatacctaactggatggttcataaaccaagagttcaagaaggcctacctgaacaaactactcgacctgctgataaaaaccaactccgaaaaacccatagacgcccgccagttcaagaagctgcgcgaggaaaccatcgccgagagcatcggaaaggaaaccctcaaagacgttgagcgagaagagaaactagagaaggaagaccacaaatggaaacttaaagggctgaagctcaacaccaacgggaagatccagtacaacgacctgtcgtcactcgccaaatttgtccacaaactcaaacaacacctaaaactagatttcttactcgaagaccaatacaccacgctcgacaaaatcaacttcctccagtcccttttcgtgtacctaggtaagcacctaaggtacagtaaccgagtggacagcgccaacctaaaagagttctcggatagcaacaaactatttgaacgagtcctccaagaacaaaaagacgacctcttcaaactcttcgagcagaccgataaggatgacgagaaaatccttgcccagacgcacagcctcagcacaaaagccatgctcctcgcgattacacgaatgaccaacctcgacaacgacgaagacaaccagaaaaacaatgacaaagggtggaatttcgaagcgatcaaaaacttcgaccagaaattcattgacatcactaagaaaaacaacaacctctccctgaagcaagacaaacgctacctagatgaccgattcatcaacgacgccatcctatcacccggagttaaacgcatcctccgggaagcgaccaaggtatttaatgcgatcctgaaacagttcagcgaagaatatgacgtaaccaaggtcgtcattgaactcgcccgcgaactaagcgaagaaaaagagctggagaacaccaaaaactacgaaaaactcataaagaaaaacagcgacaaaatatcggaacggctggaagccctcgacattgctgaggacaaaatagaggacatcttgaaatcccccaccaaatcgtacaaagtactgctgtggctccaacaagaccacatcgacccatactcccaaaaagagatcgcgttcgaggacatcctgaccaaaactgagaaaacagaaatagaccacatcatcccatactctatctccttcgacgactccagctctaacaaactcctcgtgctggccgaatcaaaccaagccaaatcaaatcaaacaccatacgagttcattaccagcgggaatgccggtatcaaatgggaagactatgaggcatactgtaggaaattcaaagacggagacacctcactcctcgactcaacgcaacgcagcaaaaagtttgccaaaatgatgaaaaccgacacgagtagcaaatacgacatagggttcttagcacgcaacctcaatgacactcgctacgccacgattgttttccgcgacgccctcaaagactacgcaaacaaccacctcgtcgaggataaaccaatgttcaaagtagtctgcataaacggaggagtaaccagtttcctccgaaagaactttgacaaaagttggtacgcgaagaaagaccgcgataaaaatatacatcacgccgtcgatgcatctataataagcatcttctcaaacgaaaccaaaaccctcttcaaccaactcacacagttcgccgattataagctgttcaagaacacggacggatcctggaagaaaatagatccaaagaccggagtagtcaccgaagtcacagacgaaaactggaagcagatacgagttcggaaccaagtctcagaaatcgcaaaagtcatcaataaatgcatccaagactctaacatcgaacggaaagcacgctacagcaggaagatcgaaaacaagacaaacatcagcctattcaacgacaccgtatactcagccaaaaaggtaggatacgaagaccagatcaaacggaaaaacctaaaaaccttagacatacacgaatccgcagaagaaaacaagaactctaaagtgaaaaagcaatttgtctacagaaaactggtaaatgtgtccctcctaaacaacgacaaactagccgacctgttcgccgaaaaagaagatatactaatgtatcgggccaacccatgggtgataaacctggccgagcaaatctttaacgaatacacagaaaacaagaaaatcaaatctcaaaacgtatttgagaaatatatgttagacctcaccaaagagttccccgaaaagttctccgaagcgttcgtcaaaagtatgctccgcaataaaacggcaatcatctacaacgtagaaaagaaagtcgtccacagaatcaaacgcctaaaaatcctatcatcagagctcaaggagaacaaactatctaacgttataatcaggtccaaaaatgaaagcgggaccaaactgtcctaccaagataccataaattcgatcgcactgatgatcatgcgatctatcgacccaaccgcgaaaaagcaatacataagggtccccctcaacacactgaatctccatctaggcgaccaggactttgacctccacaacatcgacgcatatcttaaaaagccgaagttcgtcaagtaccttaaagcaaacgagattggagatgaatacaagccttggcgagtcctcacatccgggaccctcctcattcacaaaaaggacaagaaactcatgtacataagctccttccagaacctgaaagacgtcatcgagatcaaaaacctcatcgaaaccgaatacaaagaaaacgacgactcggacccgaagaagaaaaagaaagcaaataggttcttaatgacgctatcaaccatactcaacgactacattctcctcgacgccaaagataatttcgacatcctcggcctgtccaaaaaccggatcgacgaaatcctcaatagcaagctcggcctagacaaaataaccaaatga

SEQ ID NO: 6393 - RNA, 3810 nt, synthetic construct
  misc_feature 1..3810: note = Cas9 variant
  source 1..3810: mol_type = other RNA
atgaacaactcgattaaatccaagccagaagtgacaatcgggctcgacctgggagttggatcagtaggttgggcgatcgtcgacaacgaaacgaacataatccaccatctcggcagcagactgttttcacaagccaaaacagcagaagaccgtcgctccttccgtggggtcagacgactgatccgccgtcggaaatacaagttaaaaaggttcgtgaatttaatatggaagtacaatagctacttcggctttaagaacaaggaggatattctcaacaactaccaggaacaacaaaagctccacaacaccgttctcaacctcaagtcagaggccctcaacgcaaaaatagacccgaaggcccttagctggatccttcacgattacctcaaaaatcgaggccacttttacgaagacaatcgcgacttcaacgtgtaccccacaaaagaacttgccaagtacttcgacaagtacggctattacaagggcataatagactccaaagaggacaacgacaacaagctagaagaagaactcacgaaatacaagttctccaacaaacactggctcgaagaggtaaagaaagtcctaagcaaccaaacgggcttacctgaaaaattcaaggaagagtacgaatccctcttctcctacgtccgcaactactccgagggccctggcagcattaactccgtatcgccatacggcatttaccacctcgacgaaaaggaaggcaaagtagtgcagaagtacaacaacatctgggacaagacgatcggcaagtgcaacatcttccctgacgagtacagagccccgaaaaactccccaatcgccatgatattcaacgaaatcaacgaactcagcaccattagatcctactccatttacctaacagggtggttcatcaaccaggaatttaaaaaggcatacctcaacaagctcctcgacctccttatcaaaacgaacggtgaaaaaccaatagacgcccgacaattcaagaaactccgcgaagaaacaatagctgagtccatcgggaaagaaacgctcaaggatgttgaaaacgaagagaaactcgaaaaagaagaccacaaatggaagctcaaaggacttaagctgaacaccaacggaaaaatccagtacaacgacctctcgagccttgccaagttcgtacacaagctaaagcagcatctaaaactagacttcctgctcgaagaccagtatgccacgctcgacaagatcaatttccttcaaagcctcttcgtctaccttggaaagcatctacgctataacaacagggtagacagcgccaacctaaaggagttctcggacagcaaccggctctttgaacgggtattgcaggaacaaaaagacggactctttaaactattcgaacaaacggacaaagacgacgagaaaatccttgcacaaacacacagcttatcaaccaaggccatgctcctagcgataacccgcatgacaaatctagacaacgacgaagacaaccagaaaaataacgacaaaggctggaacttcgaagccatcaaaaacttcgaccaaaaattcatcgacataaccaaaaccaacaataacctatccctaaagcaggataaacgctacctcgacgaccgtttcatcaacgacgcaatactctcgcctggcgtgaagcgtatacttcgcgaagccaccaaggttttcaacgccatcctaaaacagttctcccaagagtacgacgtaacgaaggtcgtcatcgaactagcacgcgaactcagcgaggagaaggaactcgaaaataacaaaaactacaaaaagctcatcaagaaaaactcggataaaatcagcgagggtctgaaagccctagacatagccgaggacaaaatcgaggatattctaaagtctcccacaaagagctacaaagtactgctctggctacagcaagaccacatagacccttacagccagaaggagatcgctttcgaggatatcctgaccaaaacagagaaaacagaaatagaccatataatcccgtactcaatctccttcgacgatagcagtagcaacaaacttctagtcctcgcagaatcaaaccaggccaagagcaaccagaccccctacgaatttataacgtctggaaacgcaggaattaagtgggaggactatgaagcctactgccgcaagtttaaagacggcgacacctccctgctagactccacacagaggagcaagaaattcgcgaaaatgatgaaaacagacacttcatccaaatacgacataggcttcctggccaggaatctgaacgacacacgctacgcaacaatcgtcttccgagacgcactcaaagactacgccaacaatcacctcgtagaggacaagcctatgttcaaagtcgtctgcatcaacggtggggtcacatcattcctacgcaaaaactttgacaaatcctggtacgcgaagaaggaccgcgacaaaaacatccaccacgccgtcgacgcatccatcatcagcatattttctaacaaaacgaagaccctattcgaccaactcacacagtttgccgattacaaactgttcaaaaacaccgacggatcctggaagaaaatcgacccaaaaaccggggtagtcacggaggtcacagacgagaactggaaacaaatccgcgttcgcaaccaagtcagcaaaatcgcggaagaaatcgacaaatgcatccaggattctaatatcgagagaaaagcgcgctactcgcggaaaatcgaaaacaagacgaacatttcccttttcaacgacaccgtgtactcggctaagaaagtcggctatgacgaccaaataaaaaggaaaaacctgaaaaccctcgatattgacgaatccgtcgaggagaacaaaaactccaaagtgaagaaacaattcgtataccgaaaactggttaacgtgtccctcctcaacaacgacaaactagccgacctctttgcagagaaagaagacatactcatgtatcgagccaacccctgggtaataaacctcgccgagcaaattttcaacgagtacaccgaaaaccgtaaaatcaaatcccaaaatgtcttcggaaaatacatgctcgacctcacaaaagagttcccagagaaattcagcgaggcttttgtcaaatcaatgctacgtaataaaactgcaataatatacaacgtggaaaagaaagtcgtccacagaatcaaacgcctaaaaatcctgtcctccgaactcaaagaaaataaactctccaacgtgattatccgaagtaaaaacgaatccggcaccaagttgtcctaccaagacaccataaactctgtcgcccttatgataatgcgctccatagaccccaccgccaagaaacaatacatacgggtccccctgaatacgctaaatctccatcttggagaccacgacttcgacctacacaacatcgacgcctacctcaagaaaccaaaattcgtaaaatacctgaaagccaacgaaatcggcgacgaatacaaaccctggcgagtacttatctcggggtcgctcttaattcacaaacgcgataagaagctcatgtacatctcttccttccagaacctcaacgacctcatcgaaatcaaaaacctaatagagaccgagtacaaagaaaacgtcgactccgaccccaaaaagaagaagaaagcctcccaaatactgcgctctctctcaactatcttaaacgactacatcctccttgatgccaaagacaactttgacatccttggactctccaaaaaccgcatcgacgagatccttaattctaaactcgacctagataaaatcgccaaatga

SEQ ID NO: 6394 - RNA, 3822 nt, synthetic construct
  misc_feature 1..3822: note = Cas9 variant
  source 1..3822: mol_type = other RNA
atgaagaaaatactcggccttgacctcggcactaacagcataggatgggcactcatagaagtggatgaaaacaacttcccaattagaatcatagcaatggggagccgcatcatacccctaagctccaacgacaaagacgagttccaaagaggcttatccatcaccaaaaaccaaagcagaacagtaagccggacccagcgcaaaggctacgaccgcaaacagctaaagaaatccgacgacttcaaatacagtctccggcgtatactcaacaaatacaacatcttcccgtcggaagaacttctcaaactccctatgctggacctctggaaactacgctcagacgcagtaaaccccaacgaaaacatctccgccgagcagctgggccgcatactatacatgctcaaccagaaacgcggatacaaaagcgcccggtccgaggccaacgctgataagaaagataccgactacgtactagccgtgaaaggccggtacgcacaactcaaggacagaaaccaaaccataggtcagtacttttacgaggagctgcataacgccaaaaccactaacagctacttccgcacaaaagaagaagtctacccacgcgaggcatatatagaggagttcgacacgattatcaacgcacaaaagagcaagcacgacttcctgacggacgaagtagtccaccagttacgaaacgagatcatatacttccagagaaagctcaaaagccaaaaaggcctcgtgagcatctgcgagttcgaaggcttcgagaaaacaatattcgacaaagaaaaagacaagaacaaggtcgtattcgtcggccccaaagtcgcgccaaaaacctcaccgctattccagctgtgccggatatgggaagtcgtgaacacaatcacgctaaagatcaaaaacccggaaggctcgaagtacaaatggggcgagaagatacccaacataaaagagaaggaagccctggccgactacttgttcaagaacgaaacgctcagcttcaacaagctcctcgacattctcgaactaaagaaggagaacgtgtacgtaaacaaacaaatcatcaagggaatcaaaggaaacgagacctattccgctctccaccgcatactcggggacaacgagctccttaaattcgacgtgtccataatcccatcaaaccacacctcgatgctagtcgacaagaaaaccggggagatactggaggaacgggcaggactcgaactcgacgtctctctcgagaaagaacccctctaccagttatggcacacaatatacagcatcaaggacctcgacgaatgcaaaaacgccctaatcaaacgcttcggatttgacgacgaaatagcagagaaactctcacacctcgacttcaacaaacaagccttcggcaacaagagcaacaagtccatgcgaaaaatattgcccttcttaatggaaggttacaactactcgcagagctgcaccctagcgggatataaccacagcaactcgctgaccaaagacgaacgagagcaacaagtgacactcgacaaactagaactacttcctaaaaattccctgcgacaacctatcgtcgagaaaatactcaatcagatgataaatgttgtcaacgccatacttgaggaatacgggaaaccatcagaaatacgcatcgaactcgcgagagagctgaaacaaagcaaagacgaacgacacgacgccgacctgcaaaactccaaaaacaagaaactgaacgaagaaatcggcaaacgcctcacggagctggggttaccagtcaccaaacgctacatccaaaaatacaaattcatattcccatcactctccaagtcattaaaagacgcccaagtcaacaatcaatgtatatactgcggcgaaacgttcaacctcacggaagcactatctggagacgcctacgacgtagaccatatagtcccaaaatccctcctattcgacgacagccagacgaacaaggtgctcgtccacagaaaatgcaacagcaccaaaactaaccaaaccgcatatgactacatcgctagcaaaggcgaggaagaagtgcaaatctacagcgctcgcgttgacgactggttcaaacggggaatcatatcctactccaagatgcagcgtctcaaggtcagccacaaagaatacctggagagaaagtcactaaacaaggaaaccgaaaccgataagaaactatgggagaacttcatagatcggcaactgcgagacacccaatacatctcccggaaatccaaagaaatcctgcagaaggtgtgcaacaacgtcacgacaacagaagggggcgtcacagccaaactccgagacctatggggatgggacgacatactgatgaacctacagatgccaaaatacaaagagctccgacaaaccgtcatcaaggagtggacttcggaacatgggaagcgaaagcaccagaaagaagaaatagagaactggaccaaaagggacgaccaccgacaccatgccatcgacgccctcgtcatagcctgcacaaaacagggcttcatacagcgcatcaataccctaaactcttccgaaacaaaggacctcatgcagcaagaaataaacgaagccaagaagctattaggggaaaactacaaagacaaggaatttgagaactcgaacgagctagtcaaaaaccacaagggccgtttatccaaattagacgactacctccgcctacagaaaccgatcaaattcaacacaaaatacgtcgaaaaagaggcagataagatacttatcagcttcaaggctggcaagaaagtcgcaacaataaccaaattcaaggccaccggcaaaaacaaggacaccggagtaatagtgccccgaggtgccctacacgaagccgggctatacggtgtaagaaccatatactcaaaagggggcatcgccgagaaacacatcataaagaaatacaaagtcggcgtcagcgcacaagaccacatcttcacaggcaaagagtcatactccgtaaagaaagacaaaaacgggaacgagaaagtagacgacaaaataaaagtagtgctggactcgatcgtcgactccaaggtgaaggagatcgtcctaaaccgcctcaatttcggcttctcggacggcgaagactacaaaaataacgtcaaaaaggcattgaacaacttcaagaatttggacgagtaccccctgtggtacaacgagaacaagggcataaaaatcctatccatcaagttaaagaccggcttaaaggactcagtcgtcccactccggctaaacgagtcaaatgaggtcataacgctcgtcaagaccggcaacaaccaccatatcgcaatctacgaagacaaaaatagcaaacctgtgcagcatagctgcaccttctggcacgccgtcgaaaggaagaaatacaacatccccgcagttatcaagaaatccagtgacgtctggaaccaactactcgacaaagaactcccagagagcttcctgaacaacctccccgaagacaacctaaacttgaaattctccatgcaacagaacgaaatgttcgtactcggcttatcccaagaagagtttaaggaagcgatagagaacaacgacaaatccctgctcagcaaatatctctacctagtctggagcgtaagcgaaaacaactactggtttaggcaccatctcgaaactaagaacagtgacctcaagaaaacggaaggagccaaagagtcaaagcgcttatacaacatacgcagcgtatccagcctattcagtctcaaccccgtgaaggtgcgtctcaatcacctgggagaaatcacgaagatcggcgaatactga

SEQ ID NO: 6395 - RNA, 3825 nt, synthetic construct
  misc_feature 1..3825: note = Cas9 variant
  source 1..3825: mol_type = other RNA
atgacgaagcacatcttagggctggacctcggcaccaactcaataggctgggccataatccaagtagacaacaacaacaacgtcccaatccaaatcatcgctatgggcagccgcataatcccgcttgacagtaacgaccgcgatcaattccaaaaaggccaggccatatccaagaacaaagaccgaacgaccgcccgaacccagcgaaaaggctacgaccgaaaacagctcaagaaatctgacgacttcaaatactcactaaagaaaatactcgaaaaactggacatcttcccaaccgaagaattgatgaaattacccaccctggacctctggaaactccgctccgacgcagtcagcaatattgaggacatcacacccaagcaactcgggcgcatcttgtacatgcttaaccagaaaagaggatacaaatccgcaaggtccgaggcaaacgccgacaaaaaggacaccgactacgtagccgaagtcaaaggacggtacacacagctgaaagacaaaggacagaccctgggccaatacttctacaaggaactctcagacgccaaccaaaacaacacctactatcgggttaaagaaaaggtctacccacgcgaggcctatatcgaagagttcgacgcaatcatcaacgtccaaaagagcaaacactcgttcttaaccgacgaggtaattcactccctccgtaacgaaatcatatactaccagcgcaaactcaaatcacaaaaaggcctagtatcgatctgcgagttcgaaggctttgaaacaacatactttgataagaaaacacaacaggacaaaaccatatttacaggacccaaagtggcacctcgcacatcccctctgttccagttctgcaaaatttgggaagtggtaaacaacataagcctcaaaactaaaaacccagaaggcagcaaatacaaatggtccgaccgcatccccaccatcgaagaaaaacagacgatcgccaactacttgcaggaaaacgaaaacctcagcttcatcgagctacttaaaatcctccaactaaagaaagaacaagtctacgcgaacaaacaaatcttaaaaggcatacaagggaacacaaccttctccgcgatacacaaaatcatcggaaacagcgaacacctcaaattcgacattgagaccataccgtccaaacacttcgccgtgctcgtagacaagaagactggagaaatacttgacgagagggactccctcgagcttaactccgccctagaacaagaaccattctaccagctctggcacaccatatactcgatcaaagacctagacgaatgcaagaaagcactaataaaacgattcaacttcgaagaagagattgcggagaaactgagcaaaatcgacttcaacaaacaggctttcggcaataagagcaacaaggccatgcgcaaaatgctgccataccttatgctcgggtacaaccaatcagaagcagaatcattcgcaggctataaccggcgccttaccaaagaagaaaagtccaaaaatgtcagcgatgagccgctccaactgttagccaagaactcactacggcaacccgtcgtagaaaagatcctcaaccagatgatcaacgtagtaaacgcaattatcgagaagtacggcaagccggaagaaatccgggtcgaactcgcacgggagctaaagcaatcgaaagacgaaagggaagacgcagataagcagaacggcttcaacaagaaactgaacgagctagttgccacaaagttgacggaactcggcctcccgaccaccaaacactacatccagaaatacaagttcattttccccgcgaaagacaaaaactggaaggaagcccaggttgcgaaccaatgcatctactgcggtgacacattcaacctaacggaagccctaagcggggacaatttcgacgtagaccatatcgtccctaaagcactacttttcgacgactcacaggccaacaaagtgctagtccaccgcagttgtaactccaccaaaaccaacaacaccgcctacgactacataaccaagaaaggttcccaagctctaaacgactacgtagcccgtgtcgacgattggttcaaacgcggcataatctcatatggcaaaatgcagcggctgaaagtctcattcgaagaataccaggagcgaaagaaaatcggaaaggagaccgaagccgacaaacggatctgggaaaactttatcgacagacagctccgcgaaactgcctacatagcaaagaaggcaaaagaaatacttgaaaaagtatgccacaacgtgaccagcaccgaaggcaacgtcacggcaaagctccgacaactgtggggctgggacaacgtgctcatgaaccttcaacttccaaagtacaaagaactcgaaaagaaaacgaaacaaaccttcacacagctgaaggaatggacctccgaccacggaaaccgcaaacaccaaaaggaagaaatcatcaactggaccaaacgagatgaccacaggcaccacgccatagacgccctcgtcatcgcctgcactcaacaggggtttatacaaagaatcaacaccctgtcgtccagcgacgtaaaagacgaaatgaagaaagaactcgaggaagacaaaactgtgtacaatgaacgactgacactactagagaactacctcctcgaaaagaaacccttcagcacggaggaaatagagaaagaagccgacaaaatacttgtctccttcaaagcgggtaagaaagttgccacactctcaaaatacaaggcgacaggaataaatgagatcaaaggagtcctagtgccccgcggcccgttacacgaacagagtgtctatggaaaaatcaaagtgatagaaaaagacaagcccctcaaatatctcttcgaaaactccgacaaaatcgtcaaccccctcatcaaacacctagtgaagacacgcctactagagaacgagaataacgcacaagccgcgctcgtaaccctcaaaaacaagccaatactcctgaataacaaacaaaccgaaatcctcgaaaaggcatcctgctacaacgaggccacagtcctgaagtacaaactacaaagcctaaaggctagccaaatagacgacatcgtagatgagaaaatcaaattcctcatcaaagaaagactgagtaaattcggcaacaaagagaaggaggccttcaaggacatcctctggttcaacgagaagaaacagatccccatcacaagtatccgactgttcgcacgcccagacgccaacaacctgcaagtaatcaaaaagcacgagaaggggaagaacatcggattcgtccttagcggaaacaatcaccacatcgccatttacgaggacaaaaataacaaactgatccagcacatctgtgatttctggcacgcggtcgagcggaagaggaacaatattccagtcctgattgaagacacctcgaccatctggaaccacctaataaacgaggacttcagcgagagtttcctcaacaaattacccaacgattcactgaaactcaaattctctctacaacagaacgagatgttcatactaggcctcccgaaggaacagtccgaggaggctataaaaagcaacaacaaatcccttctctcaaagcatctctaccttgtatggtccataaccgacggcgactacttcttccgtcaccacctagagaccaaaaacaccgagctcaaaaagatagacggatccaaagagtccaaacgctacctccgtctcagcacaaaatccctagtcgacctcaaccccatcaaagtacgcctaaatcacctcggcgaaataactaaaataggggaatga

SEQ ID NO: 6396 - RNA, 3846 nt, synthetic construct
  misc_feature 1..3846: note = Cas9 variant
  source 1..3846: mol_type = other RNA
atggaagacgacagccagcacgacataagggaaatctacctggccatccaccacatggtcaaatacaggggaaacttcttagtcgaaggaacgctagaaagttcgaacgctttcaaagaagacgaactgctaaaactcctgggaagaataacacgctacgagatgtcagagggcgagcaaaatagcgacatcgagcaagacgacgaaaacaagctagtagcaccggcaaacggacagctagcagacgccctctgtgcaacacgcggatcccgcagcatgagagtagacaacgcactcgaagcactgtccgctgtaaacgatctgagccgcgagcaacgggcgatagtgaaagccatatttgcaggtttagagggaaacaaattagacctcgccaaaatctttgtcagcaaagaattttcatcggaaaacaaaaagatcctcggcatctactttaacaaaagcgactacgaggaaaagtgcgtgcagatcgtcgactccgggctcctagacgacgaggaacgtgagttcttagaccgcatgcaaggccaatacaacgccatagccttaaaacaactcctgggaagatcaactagcgtatcagatagcaaatgtgcgagctatgacgctcacagggcaaactggaacctcataaaactccaacttaggacgaaagaaaacgaaaaagacatcaatgaaaactacggcatcctagttggctggaagatagacagcggccaaaggaagtcggtacggggagaaagcgcgtacgaaaacatgcgcaagaaagcaaacgtgttcttcaagaaaatgatagaaaccagtgacctctcagaaacagacaaaaatagactcattcacgacatcgaagaagacaaactcttccctatccagcgcgacagtgacaatggggttataccccaccaactacaccagaacgaattaaaacaaataattaagaaacagggaaaatactacccgttcttactcgacgcattcgagaaagacggcaaacagatcaacaaaatcgagggcctattagcgttccgtgtaccatactttgtcggaccattggtagtgcccgaggacctacaaaagtccgacaacagcgaaaaccactggatggttcggaaaaagaagggcgagatcaccccatggaacttcgacgaaatggtggacaaagacgcatcaggccgcaaatttatagagcggctggtgggaaccgatagttacttgctcggcgaacccaccttaccgaaaaacagccttctgtaccaagagtacgaggtgctcaacgaactcaacaacgtaaggctctccgtacgaaccgggaaccattggaacgataaaaggagaatgcggctcggccgcgaggagaagaccctgctatgccaacgtctcttcatgaaaggccaaacagtaaccaaacggacagcggaaaatttgctcagaaaggagtacggacgcacatacgagctatcaggactaagcgacgaatccaagttcacaagcagccttagcacctacggaaaaatgtgtagaattttcggcgagaaatacgttaatgaacaccgagacctcatggaaaagatcgtcgagctgcaaacagtattcgaagacaaagagacactactgcaccagttgcggcagctggaagggataagcgaagccgactgcgcgctattggtcaacacccactacacaggttggggaaggctatcgcgcaagctcctgaccaccaaggcaggcgaatgcaagatatcagacgacttcgccccaagaaaacatagcattatcgagatcatgcgggctgaagaccggaacctcatggagatcatcaccgacaaacaactaggcttctcagactggatcgaacaagagaacctaggcgccgagaacgggagcagtctgatggaagtagtcgacgacctcagagtgtcccctaaagtaaaaaggggaattattcaatccatacggctaatcgacgacataagtaaagccgtcgggaaacgcccctccaggatattcctagaactggcagatgacatccaaccaagcgggcgaaccattagccgcaaatcgcgtcttcaggacctataccgaaacgcaaatcttggcaaagagttcaaaggcatagccgatgaattaaacgcatgctcagacaaagacctacaagacgacagactattcctatactacacccaactgggaaaagacatgtacacgggagaagaactagacctcgatcggctctccagcgcgtacgatatagaccacataatcccccaagcggtcacgcaaaatgacagcatagacaaccgagtcctcgtagcacgcgccgaaaatgcccgaaagacagactccttcacgtacatgcctcagatcgcggaccggatgcggaacttttggcaaatcctgctcgacaacggcctaatcagcagagtaaaattcgagcgacttaccaggcagaacgagtttagcgagagagaaaaagaaagattcgtccaacggtcactcgtggaaacgcgccagatcatgaaaaatgtagccaccttgatgagacaaagatacgggaacagtgcagcagtcatcggcctaaacgcggaactcaccaaggaaatgcatcggtacctaggcttctcacacaaaaaccgagacatcaacgattaccaccacgcgcaggacgcactctgtgtagggatcgcaggccagttcgccgcaaaccgaggattctttgccgacggcgaagtcagcgacggcgcacaaaattcatacaatcaatacctacgcgattacctacgaggctatagagagaagctctcggcggaggatagaaagcaaggacgggcgttcggcttcatagtcggatcgatgcgctcgcaggacgaacaaaaacgggttaacccgaggaccggagaagtagtctggtccgaggaagataaggactacctacgcaaagtgatgaactaccgaaaaatgctcgtaacgcagaaagtaggagacgacttcggagccttgtacgacgaaacgagatacgcggcaaccgatcccaagggaatcaaaggaataccattcgatggcgcgaaacaggacacctccctatacggagggttcagcagcgcaaaaccagcgtacgcggtactgatagaaagcaagggcaagacccgactcgtcaacgtcaccatgcaggaatattcactgttaggagaccgaccgtcagacgacgaactccgtaaagtgctcgccaaaaagaaaagcgaatatgccaaagccaacattctactccggcacgtccccaagatgcaactcatccgttacggaggcggactaatggtaatcaaatcagctggcgaactcaataacgcacaacaactctggctcccctacgaagaatactgctactttgacgacctgagccagggcaaaggttcgctagaaaaagacgacctgaaaaagctcctagacagcatattaggatcggtgcaatgcctatacccatggcacaggttcacggaagaggaactcgcagacctacacgtggcattcgacaaactcccagaagacgagaagaaaaacgtgatcacagggatcgtgagcgcgctccacgccgacgccaagacagctaacctgagcatcgtagggatgacgggatcgtggcggcgcatgaacaacaaatcaggatacacctttagcgacgaggacgagttcatcttccagtcccccagcggattattcgaaaaacgggtcacggtcggggaactgaaaagaaaagcaaagaaagaagtgaactccaaataccgtacaaacgaaaaacggctccccactctgagcggcgcatcacaaccatga

SEQ ID NO: 6397 - RNA, 3861 nt, synthetic construct
  misc_feature 1..3861: note = Cas9 variant
  source 1..3861: mol_type = other RNA
atgactaaaaacattctcgggctcgacctcggcaccaactccatagggtgggccctgatcgaggtcgacgagaacaacacacccatcagaatcatcgccatgggcagcagaataatcccactaagcaccagcgacaaagaagagttccaacgaggcctaagcatcaccaaaaaccagtcgcggacagtaagccgaacacagcggaagggttacgaccggaagcagctaaagaaatcggacctgaagaaaatcttaaacaaatacaacatattcccaagcgaggaactcctcaaactaccgatgttggacctgtggaaactgagaagcgactccgcgaaccccaatgaaaacatctccgccgaacaactaggccggatcctgtatatgcttaaccaaaaacgaggctacaaaagcgcccgcagtgaggcaaacgccgacaagaaagacacagactacgtccaagcagtcaaaggccgatacgcccaactaaaagaacgcaaccagaccatcggccaatacttctacgaggaactttataacgccaacaccaacaacagttacttccgaatcaaagaggaagtatacccaagagaagcatacacggaagagttcgacacgatcattaacgctcagaaaaacaaacacgatttccttaccgacgaagtcgtacaccaactccgcaacgaaataatctacttccagcgcaaattaaagagccagaaaggactggtctccatctgcgagttcgaaggcttcgagaaaacagtcttcgacaaagaaaagaacaaagacaaagtcgtcttcgtcggaagcaaagtagcacccaaaaccagcccactctttcaactctgccgaatatgggaagtcgtcaatacgatatcactcaagatcaaaaaccccgaaggcagtaaatacaagtggggcgagaaaacccccaatctcaaagaaaaagaaatcctggcggattacctgttcaaaaacgacagcctgagcttcaccaagctcctcgaaatcctagacctgaacaaaaacgacgtctacgtcaacaaacaaatactcaaaggaattaaaggaaacgaaactttctcagcactccacacggtactcggggacaacgagcttttaaacttcgacgtgagtatcattcccagcaaccatacatcaatgctcgtcgataaaaagaccggcgaaatactcgaagaacgcgcgggcctcgaactagacgctagcctcgagaaagaacccctataccaattgtggcacaccatctactcgctaaaagtcctggacgaatgcaaaaacgcgctaattaagcgattcggcttcgacgacgaaacagccgaaaaactgagccacatagacttcaataaacaggccttcggaaacaaatccaacaaaagcatgcggaaaatactgcctttcctcatggaggggtacgattacagccaaagctgctccttagccggctacaaccattccaacagcctaacgaaagacgaacgagaacagcagataaccctcgataggctggaactcctctctaaaaactcgctgagacaacctatagttgagaaaatactgaaccagatgatcaacgtggttaacgccatcctcgaacaatacggaaaactaagcgagatccgcgtcgagctcgcccgcgaactaaaacagtccaaggacgagagaaacgacgcagacctacaaaactccaaaaacaaaaagctcaacgaagaaatcggtaaaagattagcagagctcggcctaccagtcaccaaaaggtacatccagaaatacaaatttatattcccaagccttagcaaaaacctcaaagacgcacacgtcaacaaccaatgcatctactgtggcgaaacgttcaatctcacagaggccctctccggcgacgcctttgacgtggaccacatagtgcccaaagctctgttgttcgacgactcccagactaacaaagtcctcgtgcaccggaagtgcaactcgactaaaaccaaccagaccgcatacgactacatcggaaccaaaggcgaagaacaagtacgaatttactcggaacgcgttgacgactggttcaagcgcggcatcatatcctacagcaaaatgcaacgcctaaaagtaagccacaaagagtacctcgaacgcaagaaactggggaaggagacggagaccgacaagaaactttgggaaaacttcatcgaccgccaactacgagacacacaatacatctcgcgaaaagccagagagatcctccaaaaggtatgcaacaacgtcacgactaccgaaggcggaatcacagcaaagctccgaaatctctggggctgggacgacgtcctcatgaacctacaaatgcccaagtacaaagagcttgggcaaacagtcatcaaagagtggacaagcgagcacggcaaacggaagcaccaaaaagaagagatcgaaaactggacaaaacgagacgaccacagacatcatgcaatcgacgcactcgtcgtcgcgtgcacgaaacaaggcttcatccaacgcatcaacaccctcaactcaagcgacacgaaagacctaatgcaacgggagataaaagaggctaaaaagttactgggcgagaactataatgaaaaggagttcgagaacgacaacgaatttgtgaaaaatcacaaagaacgcctcagccagctggacgactacctaagactacaaaaaccggtaaaattcgacacaaagtacgtagaacaggaggccgacaaagtcctagtctcgttcaaagccggtaagaaagtcgcaacaatcacaaaattcaaggccaccgggaaaaacaaggataccggcgtcatagtgctacgaggagcactgcatgaacagtctgtctacggcaaaataaaagtaatagaaaaagataaacctctcaaatacctgttcgaaaacagcaagaaaattgtgaacccaaaaatcaaagtcctcgtggaggagcgactagccgagaacgaaaacaattccaaactaagcctgagtaccttaaagaaaaaccctatattcctcaacgaagagaaaaccgaaatactagaaaaagcaagctgctataacgacgcaacggtgctcaaatacaaactccaaagcctcaaggcaagccaagccgacgacatcgtcgacgatagagtcaaattcctcgtcaaggaacgcctagcacaatttggcaacaaagaaaaagaggccttcaaggacacactatggctaaacgaagaaaagcaaatacctatcatcaccgtgcgcctgtttgcccgcccagacgccaacaacctgcaggcaatcaagaaagacaaaaacgggcgggatattgggttcgtcctcaccgggaacaaccaccacatcgcaatctacgaggacaaagacaacaagctggtgcaacacagttgtacattttggcacgctgttgaacggaagaaaaacaacgtacctgctgtcatcaaaaacagctccgacgtttggaaccaactcctggacaaagagctcccagagtcatttctcaacaaattgccaattgacaagctcaagttaaaattcagcctacaacagaacgaaatgttcgtcctaggcctcctccaggaggacttcgaagccgccatcgaaaacaacgataaaaccctcttatcaaagcacctctatctagtatggagcataacagacggcgactacttcttccgccaccacctcgagaccaaaaacacagagctgaaaaagacagaaggcgccaaagaaagcaaacggtactttcgcctctcgacaaaaggactaatagacctaaatcccgttaaagtacgccttaaccacctaggagagatcacaaagatcggagaatactga

SEQ ID NO: 6398 - RNA, 3864 nt, synthetic construct
  misc_feature 1..3864: note = Cas9 variant
  source 1..3864: mol_type = other RNA
atgaaaacggtcttagggctcgacctcggcaccaactccatcggatgggcgcttatcgaactcgacgaaaacaacatcccaatcagaatcgtggcaatgggcagccgcataatcccgctgtccacttccgacaaagaagagttccagcggggcctgagcataaccaaaaaccagtcccgcacagtctcgcggacacaacgaaaagggtacgaccggaagcaactcaagaaatcctacctcaagaaaatcttaaacaaatacaacatctttccatccgacgaactcctaaaactcccaatgctagacctctggaagttacgaagcgacagcgcaaacccgaacgaaaatatcagcgcagaacagctcggtcgcatcctttacatgctcaaccaaaagagggggtacaagagcgcacggtcagaagctaacgctgataaaaaggacaccgactatatccaagccgtcaagggccgctacgcacaacttaaagaccgcaaccaaacaatcggacaatacttctacggggagctgaacgacgccaacgaaaacaacagctacttccgcatcaaagaggaagtgtaccccagggaagcctacaccgaggagttcgacaccatcattaacgcccaaaaagacaagcacgacttcctgacggacgaagtaatccaccaactgcgtaacgaaataatctacttccaacgaaaactaaagagccaaaaaggcctagtcagcatctgcgaatttgaaggattcgagaagaccgtcttcgacaaagagaaaaacaaggacaaagtagtcttcgtaggcccgaaggtggccccaaagacgtccccacttttccaactatgccgcatctgggaagtcgtcaacaccatcaccctcaaaataaagaatcccgaaggctccaaatacaaatggggcgaaaagatccctgatgtcaaggaaaaagagatacttgccgattatcttttcaaaaacgaaagcctgagctttaccaaactcctcgagatcctcaagctcaacaagaacaacgtgtacttcaataaacagatcctcaagggaattaagggaaacgaaacgtattcaatcctccactctatcctaggcgactcggaactactgaacttcgatgtctcaattatcccatcgaaccacacgagcatgctaatagacaaaaagacaggcgaaatcctcgaggaacgagccggacttgaactcgatacttcactcgagaaggaacccctaaaccaactatggcacacaatctacagcatcaaggaccttgatgagtgtaagtccgccctaatcaaaagattcggattcgacgacgagacggcggacaaactgtcacgtatagactttaacaaacaagcattcggaaataaatccaacaaaagcatgcgaaaaatcctcccgttcctcatggaaggctacgactactcccaatcatgctcgcttgccggatacaaccactcaaattccttcactaaagacgaacgcgaacaacagatcactctcgacaaactcgagctactccccaagaacagtctccgccagccgatcgtcgagaaaatcctaaaccagatgatcaacgtagtaaacgcaatactcgaacgctacggcaagccaagcgaaatacgcgtcgaactcgccagggagctaaagcagtcgaaagacgaacgcaatgacactgacctacaaaactccaaaaacaagaaactcaacgaggaaatcggtaaaagattagccgagctaggcctcccactcacgaaacggtacatccaaaaatacaaattcatcttcccatccctctccaagaacctaaaggatgctcatgtgaacaaccaatgcatatactgcggcgagaccttcaatctcacagaggcgctatccggagacgcatttgacgtagatcacatagtccccaaagcgctactcttcgatgactcacagactaacaaggtactggtccaccgaaaatgcaactccaccaaaacaaaccagacagcttacgactacattgccacaaaaggcgacgaacaggtccgcgtctactccgagcgggtcgacgactggttcaaacgagggatcatctcatactccaaaatgcagcggctgaaggtaagccacaaagagtacctagagcgaaagaagctaggcaaagaaacagaaacagataagaaactctgggagaacttcatcgaccgccaactaagggacacccagtacatcagccgaaaatcacgggaaatcctccaaaaagtgtgcaacaacgtagcaaccaccgaaggcggcgtgacagcaaaactgagaaacctatggggctgggacgacgtgctaatgaacctccagatgccgaaatacaaagaactcgggcagaccgtcgtcaaagagtggacgtcagagcacggcaagcgcaaacaccaaaaagaagaaatagagaactggacaaaacgagacgaccaccgccaccacgccatcgacgcccttgtagtggcttgcactaaacaaggattcatccaacgcatcaacaccctgaactcctccgagaccaaagaccttatgcagcaagagataaaagaagcaaagaaactactaggagagaactacaatgaaaaggagttcgaaaacaacaacgaaagcgtaaagaatcataaagaacgattatcacaactagatgactacctccgactccagaagcccgtcaaattcgacacgaaatacgtcgaacaagaggctgataaggttctagtgtcattcaagagcggcaagaaagtcgcaaccataacaaaattcaaagccacggggaaaaacaaagacaccggcgtcatcgtcccccgtggcgcactccacgaacagaacgtatacgggaagataaaggtaatcgaaaaagataaatcattaaaatacctattcgagaacagcgagaaaatcgtaaaccccaaaattaaaaacatagtcgaaatcatcctaagcgaaaacgagaataacagcaagatggcgctatcaacattaaagaagaaccccatcttcctaaatgaagagaaaaccgacctactggagaaggcaagctgctacgaatacgtaaccgtacgcaaataccctctcaacaccatcaaagcgtcgcaagcggatgacatcgttgacgaacgagtcaaattcctggtcaaagagcggctgacacaattcggaaacaaagaaaaagaggctttcaaagacaccctatggttcaacgaagaaaaacaaatcccgataatcacagtccgtctcttcgcacggccagacgcgaacaacctccaagcaataaagaaagacgaaagcggaaaagagatagggttcgtagtcatgggcaacaaccaccacatcgcgatttacgaggacaaagacggaaaactcgtgcagcattcatgcacgttctggcacgcagtcgagcgcaagaagtacaacatttctaccgtaatcaagaacagttcagacgcatggaaccagttccttgacaacgaactgcctgagccatttcttaacaaactccccgctgataacctgaacttgaaattcagcctgcaacaaaacgagatgttcattctcggtctcagccaagaggagttcgacaaagccctaaaaagcaacgacaagtctctactgtctaagcacctgtacctcgtatggagcatcagcgaaaacaactactggttccgccaccacctagaaaccaaaaactcagatctcaagaaaacgaacggcgtcaaagaatcaaaacggctctataacatacgaagcctcggaagcctcttctcgctgaatcccatcaaaatacgactgaaccacctgggggagataaccaaaattggcgaatactcatga

SEQ ID NO: 6399 - RNA, 3867 nt, synthetic construct
  misc_feature 1..3867: note = Cas9 variant
  source 1..3867: mol_type = other RNA
atgaggctattcgaagaaggccatacagccgaagacaggcggctcaaaaggacagcccgccgccgcataagccgtagacgcaaccgccttcgctacctccaagccttcttcgaggaagctatgaccgacctcgatgagaacttcttcgcgcggctacaggagtcattcctagtccccgaagacaagaaatggcaccgacacccaatcttcgccaaactagaagacgaagttgcctaccacgaaacgtacccaaccatctaccacctccgtaaaaagctcgcggactccagtgaacaggccgacctacgcttaatatatctggccctcgcacacatcgtcaaataccgcggtcacttcctaatagaaggaaaactcagcaccgaaaacacgtcagtcaaagaccagtttcaacaatttatggtgatctataaccaaaccttcgtgaacggcgagagccgactcgtaagtgcgccactaccagaatccgtactcatcgaggaagaactaaccgagaaggcaagccggacgaagaagtccgaaaaagtccttcagcaattcccccaagaaaaggccaatggtctcttcggccagttcctaaaactcatggtcgggaacaaagcagacttcaagaaagtctttggcctcgaagaagaggccaaaatcacctacgccagcgaaagctatgaagaggacctcgaaggaatcctagccaaagtcggagatgaatactccgacgtattcctcgcggcaaagaacgtgtacgatgcagtggaactatccaccatacttgcagactcggacaagaaatcacacgccaaactgagctcctccatgatagttcgcttcaccgagcaccaagaagacttgaagaaattcaaacgattcatcagggaaaactgccccgatgaatacgacaacctcttcaaaaacgaacagaaagacggctacgctggctacatagcccacgccggaaaagtaagccagctaaaattttaccaatacgtcaagaaaatcatccaagacatcgctggtgccgaatacttcctagagaaaatcgcccaagaaaacttcctccggaaacagcgcaccttcgacaacggcgtaatcccacaccaaatacatctagccgaactccaagccataatccaccgccaagctgcctactaccccttcctaaaagaaaatcaagaaaagatcgaacagctggttaccttccggatcccatactacgtcggacctctgagcaaaggcgacgcctcaaccttcgcctggctcaagagacaaagcgaggaacccatacgcccctggaatctgcaagaaacagtcgacctagaccagagcgccactgccttcatcgagaggatgaccaacttcgacacctacctaccgtcagaaaaagtgctcccaaaacactcgctcctatatgaaaaatttatggtattcaacgagctcaccaaaatctcctacaccgacgaccgagggatcaaggccaacttcagcggaaaagagaaagagaaaatcttcgattacctcttcaagacccgacgaaaggtcaaaaagaaagacataatacagttctaccggaacgaatataataccgaaatcgtcacactatcaggactcgaagaagaccaattcaacgcctctttctcaacgtaccaagacctcttaaagtgcggactaaccagagccgaactcgatcacccagacaacgcagaaaaactagaggacatcatcaaaatcttgacaatattcgaagaccgccaaaggatccgaacccaactcagcacgttcaaaggacaattcagcgccgaagtgctcaagaaactggaacgaaaacactacacgggatggggccgcttatccaagaaactcataaacgggatctacgacaaagaaagcggcaagaccatcctcgattacctcgtcaaagacgacggcgtctcaaaacactacaaccggaactttatgcaactaattaacgactcccagctcagcttcaagaacgctatccagaaagcgcaatcgtcagaacacgaagaaacactatcggaaaccgtaaacgagctcgcagggtcccccgcaatcaaaaagggaatataccagagccttaaaatagtcgacgagctagtcgccatcatgggctacgcacccaagcgaatagtcgtagaaatggcacgcgaaaaccagaccacaagcaccggaaaacgtcgcagcatacaacgcctaaagatcgtggaaaaggcgatggcagaaatcggcagcaacctgctcaaagaacaaccaaccacaaatgaacagctcagagacacgcgcctcttcctctactatatgcaaaacggtaaagacatgtacaccggcgacgaactctccctccaccgcctctcacattacgacatagaccacattatcccccagtccttcatgaaggacgactccctagacaatcttgtcctcgtcggcagcactgaaaaccggggaaagagcgacgacgtgccgtccaaggaggttgtcaaagatatgaaagcatactgggagaaactatacgcagccggtctcatctcacaaaggaaatttcaacgattgaccaagggcgaacaaggaggactgaccttagaagacaaggcgcacttcatacagcgacagctagtagaaacacgtcaaatcacgaaaaacgtagctgggatcctagaccaacgctacaatgcaaaatccaaagagaagaaagtacaaataataacactcaaagccagcctcacatcccagttccgtagcatcttcggactctacaaagtgcgcgaggtcaacgattatcaccacggccaagacgcatacctcaactgcgtcgtggcaacaacgctactaaaagtctaccccaacctcgcgcctgagttcgtgtacggcgaatacccgaaattccaaaccttcaaagaaaacaaagctactgcgaaagcaattatctacaccaacttactccgcttcttcacggaagacgaaccgcggttcactaaggacggagagattctatggagcaatagctaccttaagaccatcaagaaagagctcaactaccaccaaatgaacatagtcaagaaagtagaagtacaaaaaggagggttcagcaaagagagcatcaaaccaaagggacccagcaataaattaatccctgtcaaaaacggcctcgacccacagaaatatgggggattcgacagcccagtagtggcctacacagtcctattcacacacgaaaagggcaaaaagcccctcatcaaacaagagatactgggaatcaccataatggaaaagacacgattcgagcaaaaccccattctcttcctcgaagaaaaaggcttcctacggcctcgagtcctcatgaaactaccgaagtataccttgtatgagttccctgaaggcagacgacgactactagcctcagccaaggaggcacaaaaagggaaccagatggttctccccgaacacctacttaccctactataccacgccaaacaatgcctcctcccgaaccaatccgaatccctagcctacgtcgaacagcaccagccagagttccaggaaatcctcgaacgcgtggttgacttcgcggaagtgcacaccctcgcgaaaagtaaggtacagcagatcgtcaaactattcgaagcaaatcagaccgctgacgtcaaagagatcgccgccagcttcatccagctcatgcaattcaacgccatgggagccccatctaccttcaagtttttccaaaaggacattgaacgcgcacgatatacctccatcaaggagatattcgatgcaaccatcatctatcagagcccgaccggcctgtacgaaacccgccgaaaggtggttgattga

SEQ ID NO: 6400 - RNA, 3903 nt, synthetic construct
  misc_feature 1..3903: note = Cas9 variant
  source 1..3903: mol_type = other RNA
atgtggggagtcagcctattcgaagccgggaaaaccgccgcagaacgcagaggctacagaagcacccgacgccgcctcaaccaccggaagtttcgtttacgcctcctcgaggatatgttcgagaaagagatactatccaaggacccctccttcttcatccgactaaaagaagccttcctgtcaccaaaggacgaacagaagcaattcaaagggaacatcctcttcaacgataaagactataccgacgcagactactatgaacagtacaaaacgatttaccatctgcgctacgacctcatctctcaacaccgccagttcgacatacgcgaagtctacttagccatacaccacctcatcaaataccgaggccacttcatctacgaagaccaaacatttaccacagacggaaaccaattacaacatcacataaaagccattataacaatgatcaactccactcttaaccgaataatcataccagagaccatcgatatcaacgttttcgagaaaatactcctcgaccggatgatgaaccgctccagcaaagtcaagttcctcatcgaactaaccggcgaagacaaacaagacaaacccctactcaaagaactatttaacctaatcgtaggattaaaagccaaaccagcatccatattcgaacaagagaacctagccactatcgtcgaaacgatgaacatgagcacagagcaagttcaactcgacctactgacactagccgatgtcctcgccgacgaagaatacgatttactattaacagcccagaaaatctacagcgccatcatactcgacgaaagcatggacggctacgaatacttcgccgaagcgaagaaagaaagctaccgcaagcaccaagaggaactcgtcctagtcaagaaaatgctgaagtccaacgccatcaccaacgatgaaagagcaaaatttgagtatttttacacagactacataggcgcaaagtcatccaactatgaagaaagcaaaaacattaagaaaggactctcagcagcctacggcaaatactcaaaagaagaacgcctgttcaaacacatcgagctacttttggccaaagagaacgtcctcacaaccgtagaacacgcccttcttgaaaagaacatcaccttcgcttcgctcctcccattacaacgttcgtcccgaaacgccgttataccctaccaagtacacgaaaaagagctagtcgccatcctggaaaaccaggctacgtactaccccttcctactagaacaaaaagataacatccacaaactactcacatttcgcataccttactacgtcggaccactagccgaccaaaaagactctgaatttgcctggatggtacgtaaacaggccgggaaaatcacgcctttcaacttcgaagaaatggttgacatcgacgcaagctcagaagccttcatcaagcgaatgactaacaagtgcacctacctaatccacgaagacgtcataccgaagcactccttctcctatgccaaattcgaagtactaaacgagctcaacaaaatccgactcgacggcaaacccatagacataccactcaagaaacgcatcttcgaaggcctatttctcgagaaaacgaaagtgacgcagaccagccttaagaaatggctagccgaacacgagcacatgacagtgagcgtagtgcaaggaacgcaaaaagaaaccgaatttgccacgtcactccaggccttccaccgcttcgtaaaaatcttcgaccgagaaaccgtatctaaccccgccaacgaagaaatgttcgagaaaatcatctattggagcaccgtcttcgaagacaagaaaataatgagacggaaattatctgagtaccctcagctcacagaacaacaacaagtgcagctcgcccaggtaagattcaggggctggggccgcctatcgcaaagacttataaacagaatcaagacgcccgtctcaggcgacgaagaccacaaactgtccatcaacgagatcctatggcagacaaacgaaaacttcatgcagatcataaggaacaaagactacctcttcaagaaaattatcgaagaacagttcgagaacgaaactgcccttctaaataaacaacggatcgacgaactcgctgctagcccggccaataagaaaggcatatggcaggccataaagatcgtgaaggaactcgaaaaagtcctccaacaaccagcagagaacatcttcattgagttcgcgcgatcagacgaggagtccaaacgctccacgccacgcgataaattcatagagaaagcgtacgcccagctcaaaaaggagaccgacacgttcaacctcgaacacttaaaagaactgaagcaacgtagcaaacagctatcatcccaacgcctcttcctatatttcattcaaaacgggaaatgcatgtacagcggagaacacctagacatagaacgcctagactcatacgaagttgaccatatcctcccccaaagctacatcaaggacaacagcattgaaaacctagcactggtcaagaaagtcgaaaaccaaagaaagaaagacagtcttctactaaacagcagcatcataaaccaaaactattcccgctgggagcagctcaaaaacgccggcctaatcggcgaaaagaaattcagaaacctaacccgaactaaaataaccgaccgagacaaagaaggattcatcgccagacaactggtcgaaactcgccaaattacgaaacacgtcacccagcttctccagcaagaatacaaggatacaaccaaagtattcgcaatcaaggccaccctcgtttccggcctccgtcgaaaattcgagttcatcaaaaatcgcaacgtcaacgactaccaccacgcccaggacgcctttctcgtcgcattcctcgggaccaatatcacctccaactacccaaaaatagaaatggagtacctcttcaaaggataccagcactacctcaacgaggtaggcaagtcggctgcaaaacccaaattcacatttatcgtagagaacctaagcaaacaacagtacaacagcaccaccggtgaagtgaaatggaaccccgaagtcgatatcgccaaactcaagcgaatcctcaacttcaaacaatgcaacatcgttcggaaggtggaggagcagtcaggtgccctattcaaagagacgatctacccagtagaagaatcctcctcaaaaaccataccattaaagaaacacctagacacagccatctacgggggctataccgcggtaaactacgcatcgtacgcccttatacaatttaagaaaggccgcaaactaaagcgagagatcattggaatacccctcgcggtccagacacgtatagacaactcagaaacaagcctacaagcatatatcgccgaacaaataaaatccgaagtcgaaatcctcaacggccgcatactcaaataccaactaatttcaaacaacggaaacaggctgtacatcgctggcccctccgaacgacacaacgcacgccagcttatagtttcggacgaagctgccaaggtcatatggctgatatcgacaaagcaagcggacgaggcgatgttcctaaagtattaccgactcgaacacttagaagcagtcttcgaagaactaatccgtaaacaagccgccgactaccaaatattcgagaaactgatcaagaaaatcgaagttaataaagtctacttctactcatgtacatacaacgaaaaagtcaaggtcatagaggaactgctcaaaatcacacaagccaacgcaactaacggcgaccttaaactacttaaaatgagcaacagagagggccgcctcggatccgtaagtgtcgcgctcgactttaaaatcatcaaccagtcagtcacgggcctctaccaatccatcgaagactacaataactga

SEQ ID NO: 6401 - RNA, 3930 nt, synthetic construct
  misc_feature 1..3930: note = Cas9 variant
  source 1..3930: mol_type = other RNA
atggggagcgtcggcttcgccgggatcgataaccaatacaacctagtccggacaaaggggaaaaacgtcatcggcgtaaggctctttgacgaagcggacagcgcagccgaacgacgaggtcaccgcaccaacagacgaagacttcaacgtagacgctggcgcttgcgcctactagacgacattttcgccaagcccctccaagcagtcgatccgaacttcctagccaggctgaagtacagctacgtcaacaagaaagaccagggccagcaggaccactactacggcggctacgtctttggatctaccgcagcggaccaagcataccaccaagcctatccgaccatctaccacctccgaaaacgactgatggaagacgaccagaaacacgacttacgcgaagtgtacctcgctatacatcacatcgtcaagtatagaggcaacttcctcaacccccagtccagcctcgacatcgatcaacaattcgacgtaacagacttcgcccaagcactagcacgcttcgcggaccaccaagcactaagctgggctctcgaagcacccatccgatttctcgaggcagaactggctaccggacttagcaatagcgcccgggtggacgctgcaattgaagcattctcgtttgacactaaagtagaccgcgcagcgatcaaggaaatgctaaagggcctaagcggaaaccaaatagactttactaagctctttgtcaacgtcgacagtgccgactgggaccaggaggagcgcaaacaatggaagatgaagctcagcgaagaagatttcgacgaacaggctctacccatcctagaacgcctgagtcaagacgaaacagagttcttcctcgcaatcaagcgcgcatatgacggaatcgccctgatgcgtttcctgggagacgaacaaagcctgtcctccgccatgataaaagcctatgaagaccacagacgggaccttactttccttaagacacaagtccggacaccccaaaatcgacaagccctaagcgaaggctataccaactacctcagcgtagacgacaagaaacacaaacgcggcgcaaaagaactcgctcaactaatagaagccagtgacgcctcagaacaggacaaagcaaccatgttagaccgcatcgccaacgatcagttcgcacccaaacagcgaaccaaggcaaacggtctcatcccttaccaacttcacctcgctgaactcaagaaaattctcgcaaaacaaggacaatactacccattcctcctggacacctttgccaagcaaggtcaatccgtcaacaaaatagaggagctagtacagttcagggtcccctattacgtgggcccgatggtccccaaatcagaaacggccggcaacgcagaaaaccactgggtagaaaagaacgacggacagaccaaagtatctgtgacaccctggaactttgaccaagtcttcaaccgcgacagggccgctaaatcatttattgaccgtctaacaggaacagacacctacctcataggtgagcccaccctcccccgccacagcttaacatacgaaaccttcaccgtgctcaacgagcttaacaacatccgcatcgatggcaaaagattgcccgtagaaacaaaacaggcgatcgtagaagacctcttcaagaaataccgcctagtaaccaagaaacgactacaagattacttcgccagcttcggtaaacgagaagtcgaactcacaggtttagctgacgaaagccgcttcacttccagcctcacatcataccacgacctacaagggctcttaggcaccgacttcatcaccaaccctcaaaaccactcactcctagagaaaatagtagaaatccagacagtcttcgaagacagtgacatcgccgaaagagaactcggcaaacttggcctcgaacaaaaactcatcccccgcctcgcaaagaaacactatacagggtggggcaacctctccagaaaactactcgatactagcttcatccacgaccccgaacgcccagaagaaccggtctctataatggacttactctacaccaccaacaaaaacttcatggaaatacttcacgacagcgaatacggagtcgaagaatggctcaaaagccaaaacatgatagacgaccaaaaagatatacagatgagaatagacgaactaaccaccagccccgcaaacaagaggggaatcaagcaagcatttaacgtcctcgatgacatcacgcaagcaatgggcgaagaacctgcctacgtctacctggagttcgcgcgcgaaaaacaagcgagccgacgcacagtgtcccgcaagaagcgcctcgaaacattatataaaaacgcagcactcaaaacggagttcaaagcaataaaagaagcattagcggaagaaagcgacgaccgaatgcaagacgaccgcttatacctgtactacgcacagctcggtcgagacatgtacacgggacagtccatctcaatcgaccagctgagttcacactacgacatcgatcatattgtcccccgcgccttcatcaaggacgacagcctcgaaaataaggtgctcgtaaaccgaacggacaacgcccgaaagaccgactcggccacattcaccgccgacgtaaaagccaaagccttccccctctggcaacagctcaaaaagctaggactgatcagcgcaaagaaattccgcctcctcacacgaacaggcgatttcaccgaaatggaaagagaacggttcatcgcacgccagctagtagaaacacgacaaatcatcaagaacgtggcagccctcatagaaggccatttctcccagacacaagccgtcgccatccgcgccgaagtaaccggcgagctaagacaactaacacaaataaagaaagaccgcgacataaatgactaccaccacgcccaagacgctctcctagtcgccacggccggcacatacctccacagacacttcccaaaaagggacgcccgtttcatctacaacgagttcgactactacacccaacattggcttaaaaaccaaggagaaaaccggcgccggcatccctattcgttcgtggtgggaaccatgtcaaaaggaaatgaggactggacgccagacaacctaaactacctacgaaaagtcatgcagtacaaaacaatgctcatgacacgcaaaccggtcggtcctgagggagcactgtacaaagaaacgcttatcgccgcggaccccaagaaacgcctcgtaggggccagcaaggaaagacaagacccaactatctacggcggttacacaaaagagtcatccgcctacatgagcttagtccgagcaggcgggaaaaaccaactggtgaaaatcccggtcagaatcgccaacgaaatacacagcggtcaacgcaaactcgatgattacgtccaagccaaagtaaagaagttcgaacggatcctcctccccaaaatatcgctcggacaactggtagaagacgaaggccaacgattctacctcgcaaccaacgaaatgaaacacaacgcgaaacaactctggctcgaccagaaagtagtaacgacatacaagagactcacagcagagtctccagtcgaagacttccttacggtattcgacgccctaaccagctccgcaacgatacaccacttcaaattctaccaacgcgatctcgaacttttaagagacaacagagccggattccaagacttggctaaggccacccaacttaaagtcctaaaagatgtgctctacgaacttcacgataatgccggatggcgcgaccccatcaaacagtatttcaaagaaatcggcctaaaagtccgcatgtggaccaaactacaaaaagaaggtgggataaaactcactgaccaagccgagctcatctaccagtccccatccggcctcttcgagaaaagacggcgagtgcaagaccttctctga

SEQ ID NO: 6402 - RNA, 3939 nt, synthetic construct
  misc_feature 1..3939: note = Cas9 variant
  source 1..3939: mol_type = other RNA
atgcaaaacggattcctgggcattaccgtatcttcagaacaagtcggctgggcagtaacaaacccaaagtacgagctagaacgagccagccggaaggacctatggggagtgcgtctcttcgacaaagccgagaccgccgaggaccgccgcatgttcaggaccaacagaagacttaaccaacgcaagaaaaaccgcatacactacctgcgcgacattttccacgaagaggtcaaccagaaagacccaaacttcttccaacagctcgacgaatccaacttctgcgaagacgatcgaaccgtagagttcaacttcgacaccaacctctacaaaaatcaatttccaacggtataccacttacgaaaatatctcatggaaaccaaagacaagccagacatccgcctggtatacctagcattctcgaagttcatgaaaaatcgggggcacttcctctacaaaggcaacttaggagaggtaatggacttcgagaactcgatgaaaggcttctgcgaaagtctagaaaaattcaacatcgattttcccacactctcggatgagcaagtcaaggaagtccgagacatactgtgcgaccacaagatagccaagacagttaaaaagaaaaacatcataacaataacaaaagtcaagagcaaaacggccaaagcatggatcggcctattctgcggatgctccgtaccggtcaaggtcctcttccaagacatcgacgaggagatcgtgacggatccagagaaaatatccttcgaggacgcgtcatacgacgactatatcgcaaatatagaaaagggcgtcggcatctactacgaggcaatagtcagcgcaaaaatgttattcgactggtcgataatgaacgaaatactgggggatcaccaactactctcagacgctatgatcgcagaatacaacaagcaccacgatgacctcaaacgcctgcaaaagataataaagggaaccggcagccgagaactgtaccaagacatcttcatcaacgacgtcagcgggaactacgtctgctacgtcggccacgctaagacaatgtcctcggccgaccaaaagcaattctacacattcctcaaaaaccgccttaaaaatgtcaacggcatctcatcagaagacgccgagtggattgacacggaaatcaaaaacgggaccctactaccaaagcagacaaaaagggacaacagcgtaataccacaccaattacagctaagggagttcgaactgatcctagacaacatgcaggaaatgtacccattcctcaaagaaaaccgtgaaaagctactcaaaatcttcaacttcgtaattccctactatgtcgggccactcaagggggtcgttcgcaaaggcgagagcacgaactggatggtcccaaagaaggacggagttatccacccctggaacttcgacgagatggtcgacaaagaggccagcgccgaatgcttcataagccgcatgaccggtaactgctcctacctgttcaatgaaaaagtcctgccgaagaactcactcctctacgaaaccttcgaagtactcaacgaactcaaccccctcaagataaacggcgaaccgataagcgtcgaactaaagcaacgcatatacgaacaactattccttaccggaaagaaggtcaccaagaaatctctaaccaagtacttaattaagaacggatacgacgaggacatagaactatccggcatcgacaatgagttccacagcaacctgaaaagccacatcgatttcgaagattacgacaacctctcggacgaagaagtagaacggataattttgagaatcaccgtcttcgaggacaagcaactcctgaaagactacctaaaccgggaatttgtaaaactgtccgaggacgaacgcaaacaaatctgctctctgtcatacaaaggatggggaaacctatcagaaatgctcctaaacggaatcacagtcaccgactccaacggcgtagaggtgtccgtaatggacatgctctggaacaccaatctgaacctcatgcaaatattgagcaagaaatacggctacaaagccgaaattgaacgttacaataaagagcacgagaaaaatatatataaccgagaagacctaatggactacctcaacataccaccagcgcaacggcgaaaagtcaaccaactaataaccatagttaaaagcctcaagaaaagatgcggagtccccaacaagatcttcttcaaagtatcaagagaacaccaggacgacccgaaacgcacttcctccaggaaagaacagctgaaatatctctataagagcctcaaatcggaagatgaaaaacacctcatgaaggagctagacgaactaaacggacacgaactgagcaacgacaaggtgtacctctacttcttgcaaaaaggacggtgtatctactcgggtaagaaactcaacttgtccaggctccgcaaatccaactaccagaacgacatagattatatctaccccctatccgccgtcaacgaccgctccatgaacaataaagtcctgacgggaatccaggagaatcgggccgacaaatacacctacttcccggtagaccctgaaatccagaaaaagatgaagggtttctggatggagctcgtacttcaaggcttcatgtcgaaagaaaaatacttccgtctaagcagagaaaacgacttcagtgaaaatgagctagtctcattcatcgagagggagatttcggacaaccaacagtccggccgcatgatagcgtctgtgcttcaatactactttccagaatcaaaaatagtgttcgtgaaagaaaagctcatctccagcttcaagcgggacttccacctgatcagctcatacggccacaaccatctgcaagcggccaaggacgcatacataactatcgttgtaggtaatgtctaccacaccaaattcaccatggacccagccatatacttcaaaaaccacaaaagaaaagattacgacctaaatagactgttcctagaaaacatttcccgcgacggacaaatcgcctgggaatcgggaccgtatggaagcatccagacagtaagaaaggaatatgcacagaatcacatcgcggtgaccaaacgagtcgtcgaagtcaaaggagggctatttaaacaaatgccacttaagaagggccacggagaatacccgctaaaaacaaacgacccccgcttcgggaacatagcgcaatacggtggatacacgaacgtcaccggaagttatttcgtcctggtcgagtccatggaaaaaggtaagaaacgcatctccctcgagtacgtaccggtatatctgcacgaaagactggaggacgacccgggacacaaactactgaaagagtacctcgtcgaccaccgaaaactcaaccaccccaaaattctactcgccaaagtccgtaaaaatagcctcctaaagatagacgggttctactatagactcaacggcagatccggaaacgcactgatccttacaaacgcggtcgagctcatcatggacgactggcaaactaaaacagcaaacaagatatccggctacatgaaaagacgggctatcgacaagaaggcacgcgtctaccagaacgagttccacatccaagaactcgaacaactctacgacttctacctggacaaactagaaaacggagtctacaaaaatcgaaagaacaatcaggccgaactaatccacaacgagaaggagcaatttatggagctcaaaacagaggaccaatgtgtcctcctcaccgagatcaagaaactctttgtttgctcaccgatgcaagcagatttaactcttataggcggaagtaaacacaccggcatgatcgcaatgtctagtaacgtgaccaaagccgatttcagcataatcgccgaagaccccctcggcctccgaaacaaagtcatatactcacacatgggcgagaagtga

SEQ ID NO: 6403 - RNA, 3939 nt, synthetic construct
  misc_feature 1..3939: note = Cas9 variant
  source 1..3939: mol_type = other RNA
atgcaaaatggctttctcggcatcaccgtcagttcagagcaagtaggctgggcggtaaccaacccgaaatacgaactagagcgagcgagtcgcaaagatctatggggcgtcagactgtttgataaagcagaaacagcagaagaccgccgcatgttccgcactaaccggcgcctcaaccaacgaaagaaaaaccgaatccactacctccgagacatcttccacgaagaggtgaatcaaaaagaccccaacttcttccagcaactagacgaatcgaacttctgcgaagacgaccgcacggtagaatttaacttcgacacaaatctctacaaaaatcaattccccacagtctaccatctgcgaaaatacctcatggagaccaaagacaaaccagacatcaggctagtctaccttgctttctccaaattcatgaaaaaccgagggcacttcctatacaaaggaaacttaggcgaagttatggacttcgaaaacagtatgaaaggtttctgcgaaagtctcgagaaatttaacatagacttccccaccctaagcgacgaacaggtaaaggaggtcagggacatcctctgcgaccacaaaatcgcgaagacggtaaagaagaaaaatatcatcactataactaaagtcaaatccaaaaccgcaaaagcctggatagggctattctgtggatgcagcgtcccggtcaaagtcttgttccaagatatagacgaggaaatcgtcaccgaccccgagaaaatatcgttcgaagacgcttcatacgacgactacatcgcaaacatcgagaaaggcgtcggtatatactacgaggccatcgtaagcgccaagatgctattcgactggtccatccttaacgaaatcctgggagaccaccaactgctctccgacgcgatgatcgccgagtacaacaaacaccacgacgacctcaaacggcttcagaaaataatcaagggcaccggctcccgcgagctgtatcaagacatcttcatcaacgatgtcagcggtaactacgtctgctacgttgggcacgccaaaacaatgtctagcgcagaccaaaagcagttctacaccttcctaaagaaccgactcaaaaatgtaaacggcatctccagcgaggacgcagagtggatcgacacagagatcaaaaacggcaccttgctacccaaacaaaccaaaagagacaactccgttatccctcaccaactccaactacgagagttcgaactgatcctggacaacatgcaagaaatgtaccccttcctgaaggaaaaccgcgaaaaacttctcaaaatattcaacttcgtcatcccctactacgtgggcccactcaaaggcgtagtccgcaaaggcgaatcgacgaattggatggtccccaagaaggacggcgtaatccacccctggaatttcgatgaaatggtcgacaaggaagcctccgcagaatgcttcattagccgcatgacgggtaactgttcatacctattcaacgaaaaagttcttcctaaaaacagcctcctatacgagaccttcgaggtcctcaacgaattgaaccccctcaaaataaacggagaaagcatctccgtcgagctaaaacaacgcatatacgaacaactattcctcaccggaaagaaggtcacaaagaagtcactcacaaagtatttaatcaaaaatggatacgataaagatatcgaattatccgggattgacaacgagtttcactccaacctaaaatcccacatagacttcgaagactatgacaacctttctgatgaggaggtagaacaaataatccttcgaatcacagtctttgaagacaaacaactgctgaaagactaccttaatcgggagttcgtcaagctcagcgaagacgagagaaaacaaatctgcagcctatcatacaaggggtggggcaacctctcagaaatgctattaaacggtatcacagtaacagactcaaatggcgtcgaagtgtcggtgatggatatgttatggaacacgaacctaaacctaatgcaaatactgagcaagaaatacggctacaaagccgaaattgaacactacaacaaggagcacgagaaaaccatttacaacagggaagacctaatggactatctcaatatacccccggcacaacgccgcaaagtaaaccaacttatcaccatcgttaaatcactcaaaaagacatacggggtcccaaacaaaatcttcttcaaggtctcgcgcgaacaccaagacgatccaaagaggacaagctcccgcaaggaacagctcaaatacctctacaaatcactcaaaagcgaagatgaaaagcatctaatgaaggaattggacgaactgaacggccacgaactctccaacgacaaagtctacctctacttcctccaaaaaggaaggtgcatttactccggcaagaaactcaacctctcgcggttaaggaaaagcaactaccaaaacgacatcgactacatatatcccctatcggccgtcaacgaccgttctatgaacaacaaagtgctgacaggcatccaagagaatcgcgccgataaatacacatatttcccagtggacccggaaatccagaagaaaatgaaaggcttctggatggagctagtcctccaagggttcatgtcgaaagagaaatactttagactcagccgagaaaacgacttctcggagaacgagctagtgagcttcatcgaacgcgaaatcagcgacaatcagcagagcggccgcatgatcgctagcgtcctccaatattacttcccggaatccaaaatcgtattcgtcaaggaaaaactcatctcctcattcaagcgagacttccacctcatctccagctacggacacaaccacctccaagccgctaaggacgcctacataaccatagttgtaggaaatgtctaccatgcaaaattcaccatggaccccgcgatatactttaaaaaccataagcggaaagattacgatctgaaccgactctttctcgaaaacatctcccgcgatggacaaatagcttgggaatccggcccctacggctcaatacagacagtaagaaaagaatacgctcaaaaccacatcgccgtaaccaagagagtagtcgaagtcaagggcggattattcaaacaaatgccactcaaaaagggccatggcgaataccccctcaagacaaacgacccgcgcttcggaaacatcgcacaatacggagggtacaccaacgtaaccggttcctacttcgtcctagtcgaatcgatggaaaaagggaagaaaagaatttcgctagagtacgtaccagtctaccttcacgagaggctggaggacgacccaggacacaaactcctcaaagagtacctcgtggaccaccgcaaactcaatcaccccaaaatcctattagccaaagtccgtaaaaactccctcctcaaaatagacggcttctactaccgcctaaacggtcgctccggcaacgcactcatcctcacgaacgcagtcgagctcatcatggacgactggcagacgaaaacagccaacaaaatatccggatacatgaagcggcgggcgatcgataagaaagcacgcgtgtaccaaaacgagttccacatccaagaattggaacaactctatgacttctatctagacaaactagaaaacggcgtttacaaaaaccgtaaaaacaaccaagcggagctcatccacaatgaaaaagaacaatttatggagctcaaaaccgaagaccagtgtgtcctcctcaccgaaattaagaaattattcgtgtgctcccccatgcaagccgacctcaccctcatcgggggcagcaaacacacaggcatgatcgctatgagtagcaatgtaacaaaggccgacttcgccgtcatagccgaggaccccctcgggctccgaaacaaagttatctacagccacatgggcgaaaaatga

SEQ ID NO: 6404 - RNA, 3942 nt, synthetic construct
  misc_feature 1..3942: note = Cas9 variant
  source 1..3942: mol_type = other RNA
atgcactacctagacgagatattcgctccccacctacaagaagtcgacgagaacttcctccgccgcctcaagcaatccaacatccaccccgaagacccggcgaaaaaccaagccttcattggcaagctattattcccggatttactgaagaaaaacgagcgcggctatcccaccttaatcaaaatgagagacgaactcccagttgagcaaagggcacactacccggtcaccaacatttacaaactgcgcgaagccatgattaatgaagatagacaattcgatctacgggaagtctatctcgccgtacaccacatcatgaaataccgcggacacttcctcaacaatgcctcggtagacaagttcaaggtgggacgcatcgacttctataagagcttcaacgtactcaacgaagcctacgaagaactacagaacggagaaggatcattcaccatcgagccaagcaaagttgagaaaatagggcaactactcctggacaccaaaatgcgaaaactaaaccgacaaaaagctgtggccaagctgctggaagtcaaagtagcagacaaggaagagaccaagcggaacaaacagatcgcaacggcaatgtcaaaactcgttctcgggtacaaagcagactttgccacagtagcgatggcaaacggcaacgaatggaaaatagacctcagctcagaaacatctgaagacgaaatcgaaaaattccgcgaagaactatctgacgcacagaacgacatacttaccgaaatcaccagcctcttctcccaaatcatgctaaatgagatcgtccccaacggcatgagcatatctgagtcgatgatggatcgctactggactcacgaacgacaactcgcagaggtcaaagaatacctggcaacgcagcccgccagcgcccgaaaggagttcgaccaagtatacaacaaatacatagggcaagctcctaaagaacgcggattcgacctagaaaaaggccttaagaaaatcctcagtaaaaaggaaaactggaaggagattgacgaactcctcaaagccggggacttcctacccaaacagcgcacatccgcaaacggcgtaatcccacaccaaatgcatcaacaagaactggaccgaatcatagaaaaacaagcaaaatactacccctggctggcaacagagaatcccgcgacaggcgagcgggaccgtcatcaagcgaagtacgagctcgaccaactcgtctcattcagaatcccgtattacgtagggcccctagtcacaccggaagtacaaaaagctacatcgggagccaaatttgcgtgggccaaaagaaaagaagacggagagatcacaccgtggaacctctgggataaaatagacagagcggaatcagccgaagcattcatcaaaagaatgacagtcaaagatacctacctactgaacgaagacgtgctaccagcaaactcgctcctataccaaaaatacaatgtgcttaacgaactaaacaacgtcagagttaatgggcgacgcctcagcgtcgggattaaacaagacatatacacggaactattcaaaaagaagaaaaccgtcaaggtaagcgacgtcgcaagcctcgtcatggccaaaaccagaggggtcaacaaaccgtccgtcgaggggctgtcagaccccaagaaatttaactctaacctagccacctacttagacctcaaatcgatcgtcggagacaaagtggacgacaaccgctaccagacagacctagaaaatatcatagagtggcgcagcgtattcgaagatggcgagatcttcgctgacaaactaacagaggtagaatggctcacggaccaacaacgcagcgccctcgtcaaaaagcggtacaagggctggggccgactcagcaaaaagttactcaccggcatcgtcgacgaaaatgggcaacggataatcgatctaatgtggaacacagaccaaaacttcatgcaaatcgtaaaccaacccgttttcaaagagcagatcgaccaactgaaccaaaaggcaataaccaacgacggcatgacccttcgggaatgggtggaatcagtcttagacggagcatacacatcgcctcaaaacaagaaagcaatctggcaagtcgtccgagtcgttgaagacatagtaaaagccgtaggcaacgccccaaaaagcattagcatcgagttcgcaaggaacgaaggtaacaaaggagaaatcacccggagccgaagaacacaactccagaaactcttcgaagaccaagcccacgagctagtcaaggatacctccctcacggaagaactagaaaaagccccagacctatcagaccgctattacctctatttcacgcaaggcggcaaagacatgtacacaggggacccaatcaacttcgacgaaatctcgaccaaatacgacatcgaccacattctcccgcagtccttcgttaaggatgactcgctcgacaaccgggtactggtgtcgcgcgccgaaaacaataaaaagagcgacagggttccggccaagctctacgccgccaaaatgaaaccctactggaaccagctattaaaacaaggacttattacccaacgcaaatttgaaaatctaacaatggacgttgaccaaaacatcaagtaccgcagcctcggattcgtcaaacgccagctagtggaaacccgccaagtcatcaagctcaccgcgaatatattagggagcatgtaccaggaagctggcacagacataatcgaaacacgcgcaggcctcaccaagcagctaagagaggagttcgacctcccaaaagtacgggaagtcaacgactatcatcacgcagtcgacgcctacctcactaccttcgccggccaatacctaaaccgccgttatccaaaactcaggtccttcttcgtctacggcgaatacatgaaattcaaacatggctctgatctcaaactacgcaacttcaacttcttccatgaactcatggaaggagataaaagccaaggaaaagtcgtagaccaacagacgggcgaactaatcacgaccagagacgaagtagcaaaatcattcgaccgcctactcaacatgaaatatatgctcgtctctaaagaagtccatgacagatccgaccagctctacggcgccaccattgtcaccgcgaaagaaagcggcaaactaacttccccaatcgaaataaagaagaaaagaccagtagacctatacggcgcatacacaaacggcacttcagcgtttatgaccatcataaaatttaccggaaacaaaccaaaatacaaagtcatcggcgtaccaacaaccagcgccgtcgggctaaaaagagtaggtaagccgggaagcgaatcctacaaccaagaactccaccgcataattaagtccaacccaaaggttaagaaagacttcgagatcgtagtccctcacgtctcgtactcccaattaattgtagacgatgactgcaaatttacactcgcatccgacacgtaccaacaccccgcaactcaactcgttctctccaaagaatcgatggaaatcattgccgacgactttaaattcgtaaaagaaaacacagcgaccgccgatgagcaactcgtccgcgttttcgatgaaattgtcaaccagatgaaccactacttcaccatattcgaccaaagatccaatcgacaaaaagtcaccaaagccagggataaattcgtgtccctccccaccgaatccgaatacgaaggagccaaaaagacacaagtgggcaaaacagaggtcataacgaacctcctcatgggactccacgcaaacagcgcacaaggagacctaaaggtcctggggctatcaacgttcggattcttccagtccagcggcgggctgaacctcagcgaagacgcaatgatcgtataccaaagccccacaggactattcgagcgccgaatctgcctaaaggacatatga

SEQ ID NO: 6405 - RNA, 3942 nt, synthetic construct
  misc_feature 1..3942: note = Cas9 variant
  source 1..3942: mol_type = other RNA
atgagcttcaaagaaaactcgaaaatctactacggactcgacatcggcactgactcagtcggatggtcgaccactaacgaaaaatacgagctcctacgatacaaaaacaacctaatgtggggagtatccctcttcgaggccgcgagcttggcagaggaacgacgcggccaccggacccaacggcgccggtacgaccgccgccaacagagggtcgcactcctaggcgaactcttcgccaaagagatcctgaagacagaccctgacttcttccttcgactcaaagaatcgagcctctatccagaagaccgtaccagtaaaaacgtgaacacatacttcgacgacgcagacttcaaagactctgactacttcaaaatgtaccctacggtacaccacctcataaaagaactcagcgaatccaacaagccacacgacgttaggctcgtctacctagcctgtgcctttatcgtcgcacaccgaggccactttcttaacggcgcggatgaaaacaacgtccaggcagtcctagacttcgacagctcctattgcgagttcaccgactggttcaagtctaacgacatagaagacaaccccttctccgagtccgtcaaaaacgagttcagcgtgatccttagaaagaaaatcggcatcaccgcgaaagagcgcgaaattaaaaaccttctattcggaacaacaaaaactccggattgttacaaggacgaggaatacccaatagacatcgacgtgctgatcaaatttatatcaggtggcaagacaaacctcgcgaaactgttccgcaacccctcgtacgatgaactcgacatccaaaccgtcgaagtcggaaaagccgacttcgccgacacaatagacctgctagccagctccatggaggacaccgacgtccccctcctgagcgcggtcaaggcgatgtacgactggagcctgctcatcgacgtgctaaaaggacagaagaccatctccgacgctaaggtctgcgagtacgagcaacacaaatcagaccttaaggcgttaaaatacatcgtccgcaaatacctggatcgcgctcaatatgacgagatattccgcaccgccggggagaaaccgaactacgtatcatactcatacaatgtaaccgacgtaaagctcaaacagctgcccagcaactttaaaaagaaaaacagtgaagagttctgcaaatacattaaaagtaaactcgaaaagataaagcccgaatcagacgatgaagccgtatacaacgagctgatcgaaaaatgtaattcgaagaccctatgcccaaaacaggtaaccgacgaaaaccgcgtcataccttatcaactatactaccacgaactgtcaatgatcctcgacaaggcatccgcataccttgacttcctcaacaaaactgaagacgggatctcggtaaaacagaaaatactgacgctcatgaagttcagaatcccctacttcgtgggcccattagttaagcgcaacgaaaccgataacgtgtggatagtgcgcaaagccgagggccggatctacccatggaacttcgagaacatggtcgacttcgacaaatcggaagacggattcataagacggatgacctgcaaatgcacctacttggcgggcgaagacgtcctccccaagtactctctgctctactcaaaatacaccgtcctcaacgaaataaacaacatcaaagtcaacggcgagaaaatctccccggaactgaagcaagacatcttcaacgaactcttcatgaagacatccagggtaacagtcaagaaaatcacagaactactcaagaggaaaggagcgtttagcgaggaaaaaggggactcactcagcggagtagacataaacatcaagtcgagcctcaaaagttatctcgacttcagaagactgctggaaaacggaagtctaagcgaaaacgacgtagaacgcataatcgaacgcatcacagtgacaaccgacaagccaaggctcgtatcctggctcaaggccgagtacagcgacctacccgctgaggacatcagatacatatcacggctatcgtacaaagactacgggcgactgtcagccaaactgctaacgggatgctacgaactcgacacaaataccggcgagataggcggcagatccatcatagacttcatgtgggccgaaaatataaatctaatgcaaatcctgtccgactcatacggttacaagagcttcatagaggaagagaacaagaaatactacatgataaaccccaccggatcgatcgcgcaaacactcagagaaatgtacgtgtccccgagcgtaagccgagcgatcatccgaaccatggaaatcgtcaaagaacttagaaaaatcacgaagaaagacccagacaaaatcttcgtcgaaatggctcgcggaggcaaacccgaagaaaaaggaaaacggaccagcagccgccgggagcagatcgaaaaattgtacgactcagcgaaagccttcgtatcagacgaagacatatcgcatatgcgaagccaactaggctccctgagcgacgagcaactacgccgagaaaaatactacctctatttcatacagttcggcaaatgcatgtattcaggcgaagcgatcgacttctcccgtctaggcgacaaccactgctacgacattgaccacatcttcccacaatccaaaataaacgatgatagtctccataacaaggtcctcgtaaaatcgcagctaaacggagagaaatccgacgactatcccatcaaagccgagataaggaacaagatgcatcccctgtggaaaaacctcttctacagagaccccaaaaaccccgcagacaaggtcaagtacgagagattaacccgaagcaccccctttacggaagacgagctggccggctttatagaacgacagctagtagagacgcgccaatcgacaaaagccgtggcgaccctcctcaaggagatgttcccggactcaaaaatagtatacgtgaaagcaggtcaagtctccgagttccgacacgactttgacatgctcaaatgccgcgaaataaacgatcttcaccacgcgaaagacgcatatttaaacatagtgatcggcaacgtacacgacgtcaaattcacgagtaaccccatgaattttgtcaagaacgcggacaagcactataccatcaaggtaaaggaaaccctcaaacacaaagtgagccgcaacggtgaaacagcctggaacccagaaaccgacttcgacacggtaaagcgaatgatgagtaagaacagcgtgcgctacgtgcgatactgctacaaaaggaaaggcggattcttcaaccaaaacccagaccgcgcgggcaaccccgacctcgcgcgactcaaaaaggacctcgacccagtgaagtacggcggatacaacagcaagtcaatctcctgtttcagtttgattaaatgcaccggcgtcggagcagtaatcatcccagtcgaactcctttgcgagaaaagatacttctcagacgattcgtttgcctcggaatatgcatactctgtattgaaaaacgcgcttccagccaagaacatcgccaagatcagcatagacgacatcagcttccccctgaaaagacgcccaataaaaatcaacaccctattcgagttcgacggatacagggtcaacatacgcagtaaagactcctatcactacttcacgatttcaagtgccatggcagcaatatacagcaaagacaccagtgactacatcaaggcggtcagttcatacatagacaaaagcgacaagggcagcaaattcaagcccggagaagcattcgacgtgctttcgaacctaaaagtctacgacgaaatagccaagaaatgcatctccgaaccattttccaaaatttcaaaactagctgaggctggaaaacggtggaagaaagaagaaatcagcctacaaaactgcctactctga

SEQ ID NO: 6406 - RNA, 3945 nt, synthetic construct
  misc_feature 1..3945: note = Cas9 variant
  source 1..3945: mol_type = other RNA
atgctcaaaaaggattacagcatcggcctcgacatcggcacaaattctgtaggccatgcagtagtgacagacgactacaaagtcccgaccaagaaaatgaaagtcttcggcgatacgtccaagaaaaccataaagaaaaacatgctcggcgtcctactgtttaacgaaggccaaacagcagctgacacacgactaaaaaggggagcaaggcgcagatacacccgacggaaaaaccgactgagatacctccaggagatattcgccccagcactggcgaaagtagacccgaacttcttttaccgactcgaagagtcctcgctagtggctgaagacaagaaatacgacgtttaccccatcttcggtaaacgagaggaagaactactataccacgatacccacaaaacaatataccacctccgatcagagctcgcaaacaacgaccgaccagctgatctacgactcgtatacctagccctcgctcacatcatcaaataccgcggcaacttcctcctcgagggagaaatcgacctgcgcacaacagacataaacaaagtattcgcagagttcagcgagactctaaatgaaaactccgacgaaaacctaggaaaactggacgtcgccgatatcttcaaagacaacacattctcgaaaaccaagaaatcagaagaactgcttaaactttcgggggccaagaaaaaccagctggctcaccaactcttcaaaatgatggtaggaaatatgggcagcttcaagaaagtcctcggcaccgacgaggaacacaaactctccttcggaaaagacacctacgaagatgacctaaacgatctgcttgccgaagctggagatcaatacctagacatcttcgtcgctgctaagaaagtctacgacgccgccatacttgcctccatcctggacgtaaaagacacgcagaccaaaacagtctttagccaagccatgatagaacgctacgaggagcaccaaaaagacttgatagaactaaaacgcgtattcaaaaagtacctgcctgaaaaatgccatgacttcttcagcgaacccaaaatcagtggatatgcgggatacattgatggcaaagtgtcggaggaagacttttacaaatacaccaagaaaaccctcaagggaatcccggaaacagaagagatcctccagaaaatagacgcgaataactacctccggaaacaacgtaccttcgacaacggagcaatccctcaccaagtccatctgaaagaactcgtggcaatcgtcgagaaccaaggtaagtattacccctttctgcgagaaaacaaagacaagttcgagaaaatcctaaacttccgcattccctattacgtcggcccactagcaagaggaaattcaaagtttgcctggctcacccgggccggggaaggcaaaatcaccccctacaacttcgacgaaatgatcgacaaagaaacctccgcggaagacttcataaaacgaatgaccatcaacgacctatacctgcccacagagcccgtactgcccaaacactcgctcttgtacgagcggtataccatcttcaacgagctcgccggcgtccggtacgtcaccgagaacggagaggcaaaatacttcgacgcccagaccaaacgcagcatattcgaactgttcaaactagaccgaaaggtcagcgagaagatggtgattaagcacctcaaagtagtaatgcccgcgatcaggatccaggccttaaaaggcttggataacggcaaattcaacgcgagctacggcacctataaggacctggtggacatgggagtcgcccccgaactactaaacgacgaagtgaactcggagaagtgggaagatatcataaaaaccctcacgatcttcgaaggaagaaaacttatcaagagacggctcgagaactaccgagatttcctaggagaagacatcctacgcaagctatcgcgcaagaaatacacaggctgggggcgcctaagcgcaaaactgctggacggcatctacgacaagaaaacgcacaaaaccatactagactgcctcatgacggaagactactcccaaaacttcatgcaactgatcaatgacgacacatacagctttaaagagaccatcaaaaatgctcaggtcattgagaaggaagaaacgctagcaaaaactgtccaggaactgcccggcagccccgccatcaagaaaggcattctgcaatctctggagatagtggacgaaataatcaaagtcatgggctataaacccaaaagcatagtcgtagaaatggcacgggagacacagaaaacccacggtacacgaaaaagggaggaccgcgtccaacagatagtgaagaacctcaaagacgccaacgaactcccgaaaaagctgccctcaaacgcagaactctccgacgagcgcaaatacctctattgcctccaaaatggcagggacatgtacaccggcgcaccacttgactacgaccatctgcagttctatgatgtagaccacatcataccccagagtttcctcaaggacgacagcatcgaaaacaaggttcttacaatcaaaaaggaaaacgtaagaaaaaccaacggcctcccctcagaagcagtcatacaaaagatgggctccttctggaagaaactcctagacgccggcgccatgactaacaagaaatacgacaacctgcgacgcaacctgcatggcggcctaaacgaaaaactaaaagaacgcttcatagaaaggcagctagtcgagacccgccaaataaccaaatacgtagcacaactactggaccaaaggctgaattacgacggcaacggagtagaactagacgagaaaatcgccatagtaaccctgaaagcccaactagcatcgcagttccgaagcgagttcaaactgcgcaaagtacgcgcactaaataacttacaccatgcccacgacgcttacctgaacgcagtcgtggccaacctaataatggccaagtaccctgaactcgaacccgagttcgtctatggaaaataccgcaagaccaaattcaaaggactgggcaaagcaacagcaaagaacacactatatgccaacgtcctgtacttcctcaaagaaaacgaagtgtaccccttctgggacaaagctcgggatttaccaactataaagcgatacctctaccgcgctcaggtcaataaggtccgtaaggcagaacgacaaacgggaggcttctcggacgaaatgctagtccctaaatccgactccggcaagctcctaccacgtaaagaaggcctagacccagtaaaatacggcgggtacgcaaaagccgtcgaatcatacgccgtcctcatcacagccgacgaagtcaaaaaggggaaaactaagaaagtaaaaaccctggtcaacatccccatcattgacagcaagaaatacgaagccgacccaaccgcatacctagccagcaggggctacacaaacgttactaactccttcatccttccaaaatacagcctcctagaagatccggagggccgcagacggtacctagcctcattcaaagagttccagaaagctaacgaactgatcctcccccagcacctcgtagaactgctatactgggtaaacgcgaaagacggggaacaaaagctagaagaccacaaggccgagttcaaggaacttttcgacaagattatggagttcgccgacaaatacgtcgtcgcccccaagaacagtgagaaaatcagacgactatacgaagaaaaccaagacgcgacccccatggaattaggcaaaaacttcgtcgaactgctgcgttacaccgctgacggggctgcatccgacttcaaattcttcggcgaaaatatcccccgaaagaggtacaactcagcaggatcgctactaaacggaacactcatctaccagagtaaaaccgggctgtacgaaacaagaatagacctcgggaagctctga

SEQ ID NO: 6407 - RNA, 3948 nt, synthetic construct
  misc_feature 1..3948: note = Cas9 variant
  source 1..3948: mol_type = other RNA
atgggatattccgtcggactggacatcggtaccggttctgtcggctgggtcgtaacaaacgaagatggaaaattagccagagcaaaggggaaaaacttaataggagtccgcctgttcaagacggcggaacccgcagctgatcgccgtacaaacagaacgacaagacgacgcctgagccggagaaagtggcgtctccgcctgctcgacgaactattcgcaaacgagctaggtaagatagacagcaacttccttacccgcctcaaatactcctatgtacaccccaaagacgacgccaacagggcgaactattacggcggttacctctttccaacccaagaagagacaaagaaatttcacgccaagtatcccactatctaccacctccgtctggcattgatgacagagtcccggcagttcgacctccgagaaatatacctcgcaatgcaccagatcgtgaaataccgcggacacttcctgaactcccagtccaaaatgaccatcggaaacacgtataacccgcaagacctgcaaacggcaatggagaactacgccgaggcgaaaggactaagcatcgaactaaaacaacccgaagagatggtcgcaatcctcactggcgaagctggcttcggcctcagtaaaaaggcgaaggccgaaaaactcctcaacaacttcttcttcgacacgaaagaagaaaaagcaacggtacaagcgatcctcgccggcattgtcggcaacacaatcgacttcacaaaagtcttcaaccgccaactaacaggcgacaccctaaaagcatggaagctaaaattagacagcgaaaccttcgatgtagattccgaacccatcctgtcagacttagacgacgacgaaacggaactcttcttcgcaatacgccaggccttcgatgggttcacgctaatgaacctcctcggagaccaaacctcgatctccgccgccatggttgaacggtacacacaacaccacgacgaccttctcaccgtcaaacaagtcgcaaagaaacaaggactctctcacaaagagttctccaacatctactccgcgttcctcaaagacgacaccgacaagggaatgaagaaactcctagaagaatccaacctcagcaccgaagacgtcaacggaatacaactccggatggactcccacgattttctccctcagcaaagaacaaaagccaacagtgtcataccacaccaattgcacctagccgaactcgaggcaataatagaaaaccagggacaatactacccctttttgttagagacgttcgaaaaagaagggaccgctgccaacaaaattgctgaactactcaaattccgcataccgtactacgttggcccaatggtaaccaagaaagacgtagaaaacgcaggaggagatgccaccaatcactgggttacccggaacgagggctacgaaaagagcgccgtaacagcatggaacttcgaccaagtcttcaaccgcgaccaagcggcgcttgacttcatccaacgtcttaccggaacagacacctacctcataggcgagccaaccctcccacaaaactcgctcaagtaccaaatgttcacagtcctgaacgaactaaacaacgtaaaagtcaacggccgacgcatcgacaaccagaccaaacacgacctaatccaagacctattcaaatccaagaagactgtgtcactaaaagcgttccaggactactaccaatcccagggtaaaagcgacatccaagtagtagggctagccgacaagacgaagttcaacagcaacctgtccacatacattgacctatcgaaaacgttctccgccgaagaaatggagaacccccaaaaccaagacctcctcgaacaaatagttgaaatacagactgtattcgaagactccaaaatcgcggaaagggaactgtctaaactggaactgacaccagaacaagtaactaagctagcaaagacccactacacagggtggggaaatctcagcaacaaactcctaactacgccgatagtggatgtatcaggaaagaaagtctcaatactagatcaacttgccaaaacgtccaaaaacttcatgtcaataatatcaaacgaacaatacggagtccaggactggatcaaagagcaaaatacaacagagacgaccggcaccctggaagacaaactcgccgatctaacgacctcaccagccaacaaacgcggcataaaacaggctttcaatgtacttttcgacatccaaaaagccatgaaatccgaacccgaccgcgtctatctcgagttcgcacgtgaaacgcaaacttcagtacgcaccatgagccgctataattacctaaaaggactataccaaagcaaatccctcgacgcagaagctaaaaacctgaaaaaggaactagccgaaaccgaccaaaagaaatttgacaatgacagactatacctatacttccagcagcaaggcaaagacatgtacaccggacaacccataaatatcgacaaactctcaagcgactatgacatagaccacatcataccacaagcgttcaccaaagatgactccatagacaatcgcgtcctggtgagccgaccagaaaacgccagaaaaagtgacagcggaacttacacgactgaggttcaagccgccgcgagcggcctgtggaaaacactggtccagtccggattcatcagccgcaagaaatacgaccgattaacacatgctggagactactccgagggacagaaaaccggattcatagcacgacaactcgtggaaacacgccaaattatcaaaaacgtcgccgcactgatagagagcgagttcgaccaaacccaagccgtagccatacgagccgaaataacaggagacatgcgccgcctagtagcaataaagaaacatcgagaaataaacagtttccaccacgcctttgacgcccttctgatcaccgcagcgggccagtacatgcaaaaacgctaccccgaccgcgactccaacaacgtctacaacgagttcgaccgctacaccaacgactacctgaagaaactacgagaatcgtcatcaaaagacgaagtccgaaaactcaaacccttcggattcatagtaggcaccatggccaaaggcaacgaagactggacaacagaacaaacggagtaccttcgacacatcatgaacttcaaaaacatactcaccacttacaaaactggaccagaccgcggaccgctatcaaaagagacaatatacgcagtcgacccgaaggctaagctcatcggcacaaacaaacacaggcaggatgtctccctgtacggcggttacacatatccctactccgcctacatgacattagtccgcgccaatggcaaaaatcaactcgtaaaggtcagccgaagcgcagcaagcctaatgaagtccggacagctgaagttagaggactacgtacaacagcaacccgaggtgaagaagttcgagaaaatcctgctcgaacatctccccttgggacagctagtagacaacgacggaaaactcatgtacctaacctcctatgagttctaccacaacgccaaacaactatggttgagcacagaaaacgctgacctcatcagctctctctccatcgattcagatgaccagaagctcatcaaggcttttgatatattaacggccgactcagtaatcgaacgattccccttctacgaaatcgacctaaagaaactcatagaactacgagacaaattcgtactaatagacaacaagctcgacgtcctccgggtcgtactaaaggcacttcaactcgacagcgcccaacaaaaaccactaaagctcatcgacaaggcagcaaccgactggaaaaactaccgccaagccggagggataaaactatcagacaacgcagaaataatctaccaaagtacgaccggcatcttcgagaagcgaattaaaatcagtgacctgctctga

SEQ ID NO: 6408 - RNA, 3951 nt, synthetic construct
  misc_feature 1..3951: note = Cas9 variant
  source 1..3951: mol_type = other RNA
atgctacagaagaactacacaatcggccttgacataggcacaaactccgtcggctacgccgtaatcaacgacaactacaaggtccccgcaaagaagatgaaagtcctgggaaacacagataagaaaaccatcaagaaaaaccttatgggcgtattgctattcgatgcaggggaaacagcggccacaacgcgactcaaacggggcacccgacgccgatacacccggcgccgaaaccgcctacgatacctacaagagatattgggccccgaactagccaaagtagacgccaacttcctacaccgcctcgcggaatccagcctagtaaccgaggataaagagttcagcgcctaccccatatttggggatcgagaagaggaactactataccacaagacctacaaaaccatataccatctgcgctctgccctcgccaacaaagacgaaaaggcagaccttagattgatctacctagcactcgcccacataatcaagtaccgaggcaacttcctcatcgaaggtgagatagaactatcggataccgacatcgacaaagtttacgcagatttctgccgcagctttaacgaactcttcgatacagaagtgctacaagaaattgaagtcgaagccatatttaaagacaaaaccctaagcaaaaccaagaaagcagaggaactggttaaagtaagcggcgtgaagaaaaaccaagtggcgcaccaattccttaaaatgatggtaggcaacacagtcaactttaagaaagtcttcaacctcacagaagaccaaaaactcagcttcggcactgactcctacgaagacgagctcaacgacctactagcgaaatcagacgaccgatacctagacgtattcgttgcagccaagaaagtatacgacaccgccatcctggccaacatcctaaacaccaaaaactccgtcgcgaccaaaacaatcttcagtcaatcaatgatagagcgattcaaggaccaccagaaagacctcaaagaactgaaacaactcttcaaaacatacctaccagaaaaataccccgatttcttcggcaactcaaaggaggacggctacgcagggtacatcgaaggaaaaacgaacgaagaaaaattctatacacacacaaagaaaattctcaaaaatatacctcaggctgcatccgtactagcccagatagacgtgggaaactacctccgcaaacaacgcaccttcgacaacggtgtaataccacaccaaatccaactcaaagagctgcttgcaataatcgagaaccagggtaagtactacccattcctattagaaaacaaggagaaaatcgcgaaaatactcaccttcaggatcccgtactacgtcggacccctagcacggggaaactcccgattcgcatggctcaaacgagtaggaaaagagaaaatcaccccttttaacttcgaaaacgtagtagacctcgaaagctccgcagaacgcttcatcgaacggatgaccctcaacgacctgtacctcccggaagagaaagtgctacccaagcacagcatgctgtacgaaaagttctcgatcttcaatgaactggcgggcatccgctacatcacggacaacggagagatgaaattccttgacgcccaaacaaagcagtcaatattcgagttattcaaacaggagagaactgtgaaggaaaagaaagtactagaccttctcaaaaccctgatgccgtcagagagagtcgtggccataaaaggcatcgacaacggaaaattcaacgcctcattcgggacataccacgacctaagcaagatgggattcaagacggagaaaatcgcgtccgaaagcaaccaagctcggtgggaagaaatcattaagaccttaacaatctttgaggaccggaaactcataaaatcacgactacggaagtacgacgacttccttaatgaaaaggaaataggggcactatcaaaacgaaaatacacaggatgggggaggctttcagcgaaactcattgacggcatctacgacaagaaaacacaccaaaccatactcgacttcctcatgaacgaagactacaaccaaaacttcatgcagctcatcagcaacgacaactatagcttcaagaaaatcatcgaagactcccaggtgataaaagaggaaggctcgctaaccgaggtgatccaggagcttcccgggtcccccgccatcaagaaagggatactccagagcatcgaaatagtagatgagctggttaaagtaatgggcggcaaccccaagaaaatcgtcgtcgagatggcccgtgagacccagaaaacccacggcacgacaaggagggaagcccgaattaaggaaatcatcaagaacctcaataagctcaaactcaacgaattacctaaagatctcccatccaacgaagaactgtcagacgaaaaagtctacctatactgcctccaaaacgggcgggacatgtacacaggcgccccgctggatctcgacaacctcagccaatacgaggtagatcatataataccacaatcgttcctgaaagacgatagcatcgaaaacaaggttctcacggccaaaatcgaaaactcccggaagaccaacggactgccatcagtagaaatcgccaagaagatgggagccttctggcgatcgctgctaaaggtaggcgccattagcgaaaagaagtaccgcaacctccgccgctccctgcacggcggaatgacggagaaactcaaggaaacgttcgtgaaacgccaactcgtggagacccggcagattacaaaatacgtagcccaaatacttaactcgcgattcaacgaggagaaaaacgaggacaaagtcgccatcgtgaccttgaaagcccaactcacctcccagttccggaaagacttcgaactctacaaggtccgagaaatcaacaacttacaccacgcccacgacgcctacctcaacgctgtcctcgcaacactcttgatgaccagcttcccagaattggagccagagttcgtatacggcaaatacaggaaaaccaaattcaaaggccttggcaaagcgaccgctaaaaacaacctatacaccaacatcctccagcttctaaaagaagagtccgcacagtactgggacacaaaggaaagggacctagcaaccataaagaagaacgtctaccaggcacaggtaaacaaggtccgaaaggtcgagcgccagaccgggtccttctacgacgaaaccgtcgccaagaaatccgcatcccaaaaactcttcccgagaaagaacggactagaccctgtcaaatatggaggataccaacgagctaacgaaggctatagcttactcttccgcgcggacatgctcaacaaacgcggcaaaaccaagagcgtaaaaaccctagtaaaaatacccatcatcgaaagcgctcaatatttagcggacccgaccgagtacctggccaagcgtgggtactacaatgtcagcgagcattccctgctgctcccgaagttcagcttactggaaaacaacaacggcctacgccgctaccttgcaagcagcaatgagttccaaaaagcaaatgaacttatcctacccaaacacctggtccggctactatactggtctcaatcaaaacaacgcaaagaggaattaaacaaacacagagccgagttcgcagaactcttcacttacataatggacttcgcggacaaatacgtcgtggctccgaaaaacagcgaaaagatcaaaaacatatacgaaaacaacaaagactcttccgtcgaagtcctaggcaaaaacttcatagaacttctcaaatacacagctgatggtgcagccagcgacttcaccttctttgacacaaagataccgcgcaagcgttataattcggcgggcgacttactcgacggaaccctcatataccagtccaaaaccggcctctacgagacgagaatagaccttggtgcaatctga

SEQ ID NO: 6409 - RNA, 3957 nt, synthetic construct
  misc_feature 1..3957: note = Cas9 variant
  source 1..3957: mol_type = other RNA
atgatgataaaactaaataacatgaagaaaatactcggattagacctaggcaccaacagcatcggatgggccgtcgtagaaaccgaggacaacaagaaatttgaactcctcgacaaaggggtgagaatattccaggaaggcgtaaaaatcgaaaaaggcatcgaaagcagcaaagcggccgaacggaccgggtaccgctcggccaggaggataaaattccgaagacgacttcggaaaatcgaaaccctcaaagtactcatcgaaaacaacatgtgcccactgtcaatggacgaactaatcgtctggaaagagaacaaaaacaactaccccaaaaacaaaatattctacaactggctcaaaaccaaagatccaaaagaagggacgaacgggacctacatcaacccctactattttaggacggaagccattaagcggaagttagagaacaccaacgacgtcggccgcgccttataccacctggcccagcgcaggggcttcaaaagcaatcggctggaaagcaccgacgagaaaagcagaggcatcgtaaagaccgaaatcaacaagctaagcagcgaactaaacggacgatatcttggggaatacttctacgaactttacctaaaaggtgagaaaatccgcaaacgccatatcagccgcgaggaacactacctcaatgagttcaaaaagatttgcgaagttcaaaacttcaacaaagaactcgccgaaaaactcgaacgcgccatcttctaccagaggccactcaaaagccaaaaaggcctcgttggcaaatgcacgctacaaaacaataagcatcggtgcccgatcagccgccccgagttcgaagagttccgcatgtggcaattcatcaactcgattaaatacaaaaatagcgacggaaagttcgatttcctaaacaaggaacaacgagaaaacatcatacccgcgttcgtgagcaacaaaaacgcaactttcgagttctcaaagatagaaaagatcctaaacaagggcgtgcatatttaccagttcaattataaaagcaaccacaccataggctccaaccaaaccatgatcaactttatggacgtcttcgacatcgaccggaagctgacaaacgcctggctactctgcgtcaacaaaatttacgaactctataccgccaagaccaaaaaggatggcagcctgaagtcgaaaagcgaggtcataacagacgtgtggcacgtcctgttcacattcgacaacgaagagaacctgaaagagttcgctagaaacaaacttctcctagacgagagctctgcccaaaaattcagcaagatcaacctaaaacaggattactctcaactatcactgaaagcgatcaacaagatactcccctacctccaagaaggtctaatctactcctatgcggtcttcatcgcgaacattgaaaacgtgataggaaaatccatttggaatataaaggagaaccagcaaattatccgcacatccataaagaaaatcattgataaccacaaaacagagttagatataaacaccataaccaacagtctcatcaacgacttcaaagtcaattacaacaacgcgcacaaagaatacaaagtcgacgatatcgacctgaaaaacataagagagaaaataatcaaatattacggcaacaagacctggaactgcctacccgaagacgaaaaactatacgtcaaggaaaaagttgagaaactgtacgaaaaacaattgaaatctggaaaacgcggcatctttatcgagaagatccgcctcgacgaccggatagaaaacttcttgaaggacaatttcgactctagcgaactaaacctcaaaaagctgtaccatccgagcgacgtctccgtgtacaagtccgtcaagatcaccgatctcggactaagattactcggcagccccatgataccaagcatcaaaaatcccatggccatgcgcgccatgcaccaacttcggaaactaataaaccacctcataatcgagggcgtgatcgacgacagcacaataattaatgtagagatgagccgcgagctcaatgacgcaaacatgcggaaggccatcgaacgctaccaacgccagcgcgcaaccgaaaacgaagagttcaaaacaaagatcaaggaactctacaagaaagaatgcggaaccgacttcgagccgaacaatgacgacatcatgaaatacagactgtgggaagaacagaatcataaatgcctatacaccggcaaatcaataggcatctgtgacttcataggtagtaacccagcctttgaaatcgaacatacaataccccgatcactcagctacgacaactccctcgaaaacaaaaccctatgcgaaaaggaatttaaccaacaggtcaagaaaaaccgcatcccgttcgaactgagcaactacaaggaaataatcagccggataaacaactgggaaataaaggccgaagaactatttaagcaaatacaaaaagttaaaatacaaagccggatggccgcgacaaaagagatcaaagacaacgccatccaacggaagcacctccttcagatggagttcaactactggaacgggaaactgagccggttcacccgcgaggacgtcccagaagggttcaaaaactcgcagctcgtggacataggaataattaccaaatacgccagggcctacctgaagaccgtcttcaacaacgtaaacacggtaaaaggatcaaccgtcgccgaatttagaaacatctgggggctacaagagtacttcgaaaagaaagaccgctcgaaccacatccaccattgcatcgacgccataaccatcgcctgcctaaccaaagacaaatacgactttctggcccacttgtaccatctcgacgaacagaacaaccgggacgcagtccaccgcgccatgattaaatcgaaaccctgggagaacttcgtccaggacgttaaagagatagaaaaccagatcctcgtaagccactacacacccgacaacctccctaagcaatcgaagaagatacttcggaaacgtgggaaaatccagaaaaacgagaacggggacctcatttatgaaaaaggagacgcagtccgcggtagcctacacaaagagagcttctacggggccataaaacgagaaataatcaacaagaagggggagacggaagaaaaagtcctttatgtcaaacgcaaaccactcgagttcagcgacctgggattcaaaaccataagtgaactcgaaaacatcgtcgacgacgcggtgagggacaaagtcctaaacgcagtaaaggacaaaggcctgaagcaagcactgaacgagcccatctggatgaacgaagaaaaacaaatccctataaagaaagtacgctgctacaccccgtccgtcacaaaccccataaacctcaagaaacatagagataaatcaaagcacgaatacaagcaatcgtaccacgtgacaaacgacggcaactacctaatggtcatctacgaaggcaaagactcacaggaaaaggtcaaaagggactacgaaatcgtgtccaacctccaagccggagaatacttcaaacaatcagtccacggggtgctcaaagctcagggaataaacaacctggaaggcctgatcccaaaattcaaggagagtggtaagaacatcctcccactgaagtatatcctaaaaacgggaacgatggtcattttctgggagaattatcccgaagaaatatgggacatcgacaaaaaccaactatacaagagattattcaaagttacccaattcgagtcggacggccgcatacaagcacgcttccatcaaatcgcgaaacccgataacgagctgactaaggtctccgaactcgatttctcgaacatcgctgagaaaatccggctgagcaaaggcaatctcaacatgctggtcaacggctacgacttcaaaattaacgttctcggtcatatcgaaaaattatcctga

SEQ ID NO: 6410 - RNA, 3957 nt, synthetic construct
  misc_feature 1..3957: note = Cas9 variant
  source 1..3957: mol_type = other RNA
atgggctcaaacatgctaaagaaagactactccatcggacttgacataggaaccaacagcgtcggccacgccgtcgtaacagacgactacaaagtacccacgaagaagatgaaagtcttcggggacacgagcaaaaagaccatcaagaaaaacatgctaggagtactcctattcaacgaaggccaaacggctgcagacacccgcctaaaaaggggcacgcgccgacgatacacccgcaggaaaaacaggctgcgctacctccaagaaatattcgcccccgagctcgcgaaagtagacccgaacttcttatatcgcctcgaagaatcatcgctagtggccgaagacaagaaatacgacgtctaccccatcttcggcaaacgggaggaggagctcttataccacgacacttacaaaaccatctaccacctacgaagcgccctcgcgaacaacgatcaacccgccgacctccgcctcgtatacctagccctagcccatatcatcaaataccgtggcaacttcctactagagggagaaatcgacctccgaacgacagacatcaacaaagtcttcgccgagttcagcgaaaccctcaacgaaaacagtgatgaaaacctcggcaagctggacgtcgccgacatcttcaaaaacaatacctttagcaagacgaaaaagagcgaagaactcctgaaactaagcggcgccaagaaaaaccaattagcccatcaactgttcaaaatgatggtcggaaatatgggaagtttcaagaaagtcctagggacggacgaggaacacaaactttccttcgggaaagacacctacgaagacgacctcaacgaccttctcgccgaagcgggcgaccaatacctcgacatcttcgtcgcggcaaagaaagtgtacgacgcagcgattctcgcttcgatactcgatgtcaaagatacccaaacgaagacagtcttctctcaagcgatgatagagcgatatgaagaacaccagaaagatctgatcgagctcaaacgggtatttaagaaatacctcccagaaaaatgccatgactttttctcagagccaaaaatcagcggatacgcaggctacatcgatgggaaagtgagcgaagaagacttctacaaatacacaaagaaaaccctcaaaggcatcccagaaaccgaggaaatcctgcagaaaatcgacgccaacaactacctgagaaaacaaagaaccttcgacaatggggcaatcccacaccaagtccacctgaaagaacttgttgcaatcgtggagaaccaaggtaaatactacccatttctccgcgaaaacaaagacaaattcgagaaaatcctaaatttccgtataccctactacgtaggccccctagcccgcgggaactcaaaattcgcatggctaacacgggccggcgaaggaaagatcacaccatataacttcgacgaaatgatcgacaaggaaacctccgcagaagatttcataaaacacatgaccataaacgacttatacctcccaactgaacccgtactacccaagcacagcctactctatgagcggtacaccatctttaatgagctagcaggcgtgcgatacgttacagagaacggggaagccaaatatttcgatgcccagacaaaaagaagtatattcgaactgttcaaactcgatcggaaagtgtccgagaagatggttatcaagcatctaaaagtagtcatgcccgccatccgaatccaagcactaaagggactcgacaatggcaagttcaacgcctcctatggcacgtataaagacctcgtcgacatgggggtagcccccgaactcctgaacgacgaagtgaactccgagaaatgggaagacataataaagaccctaacgatcttcgagggacggaaactgatcaagcgcaggctcgaaaattatcgtgatttcctcggcgaggacattctccggaaactgagccgcaaaaagtatacaggctggggccgactgtcggcaaagctactcgacggcatatacgacaagaaaacccacaaaacaatactggactgccttatgacagaggactattcgcaaaacttcatgcagctgatcaacgatgacaactactcattcaaagaaactattaaaaacgcacaagtaatagagaaagaagaaacactggccaaaaccgttcaagaactacctggctcgccagcaataaagaaaggcatcctacagtccttagaaatagtggatgaaatcataaaggttatgggctacaaaccaaaaagtattgtcgtcgaaatggcccgagagacacaaaagacccacggtacacgcaagagagaagacagagtccaacagatagtcgagaatctaaaagacgccaacgagctgcccgaaaaactccccagtaacgcagaactgtccgacgagcgaaaatacctctactgcctgcaaaacggacgagacatgtataccggcgcgcccctcgattacgatcacctccaattttacgacgtcgaccacatcataccccagtcctttctaaaagacgactccatcgaaaacaaggtcctaaccatcaagaaagaaaacgtacgcaagacgaacggattaccctcggaagcagtaatacagaaaatgggcagcttttggaagaaactccttgacgctggcgcgatgactaacaagaaatatgacaacctccgccgaaacctgcacggcggcttaaacgagaaactgaaggaaagattcatagaaaggcaactggtggaaacacggcagataaccaaatacgtcgcacagctgctagaccaacgcctaaactatgacggaaacggcgtcgaacttgacgagaaaatagcgatcgtcacgctgaaagcacaattagcgagccagttccgctcagagttcaaactcaggaaagtgagggcacttaataacctacatcacgctcacgatgcctacctgaacgccatagtcgccaacctcataatggcaaaataccccgaactggaacccgagttcgtttacggtaaataccgcaaagcaaagttcaagggtctcggaaaagccactgccaaaaacaccctctacgctaacgtgctatacttcctcaaagaaaacgaagtatacccattctgggacaaagctcgcgacctcccaacaatcaagcgctacctctaccgagcacaagtgaacaaagtaaggaaagccgagcggcaaatcggaggcttcagcgacgaaatgctagtcccgaaaagcgattccggcaagctcctaccccgcaaagagggcctagacccggtaaaatatggcggctacgcaaaagccgtcgaatcttacgcagtcctcataaccgcagacgaggtcaagaaagggaaaaccaaaaaggtaaagaccctcgtgaacatacccatcatcgacagcaaaaagtacgaagctgaccccaccgcttacctcgcgtcacgcggttataccaatgtgaccaacagtttcatccttcccaagtattccttactggaagacccagaaggcagacgtaggtacctcgcatccttcaaagagttccagaaagcgaacgaactcatactcccccaacacctggtcgaactcctgtactgggtgaatgccaaagacggggaacaaaaactagaagaccataaggccgagttcaaagaactctttgacaaaatcatggaatttgctgacaaatacgtagtcgcaccgaaaaacagcgagaaaatcagacgcctgtacgaggaaaatcaagacgccacgccgatggagctcggcaaaaatttcgtagaactactacgttacactgccgacggagcggcaagcgatttcaagttcttcggcgagaacatcccacgcaaacgctacaactccgcgggctccctcctgaacgggacccttatataccaaagtaaaaccgggctctacgagacacgcatcgacctcggcaaactatga

SEQ ID NO: 6411 - RNA, 3960 nt, synthetic construct
  misc_feature 1..3960: note = Cas9 variant
  source 1..3960: mol_type = other RNA
atgttttcccaacgcaacaacccgtactgcgaactgctatttaaaattatagtaacaaacatcgaagagaaaaatctagaagtaattatggggattcgcaatagcgatatattctttatcagcaacttcatgtggtaccagaaacttatcatgatgattaaaaacatactgggcctcgacctagggacaaactcaatcggctgggccctcatcgaagtagacgaaaacaatatcccaatccgcatcatcgcaatggggagccgcataatccccctatcaaccagcgacaaagaggagttccaacgcgggctatcgatcaccaaaaaccaaaaccgtacagtatcgcgtacacagcgaaagggatacgaccgtaaacagctacgacgctcggatttaaagaagatcctcaaaaagtataacatattcccaagcgaagaactccttaagctgcccatgctggacctatggaagctcagatccgattcagccaaccccaacgaagacatatccgctgaacaactcggccgaatactgtacatgctcaaccaaaaacgaggatataagtccgcacgcagcgaggcaaactcggacaagaaagacacagattacgtacaagcagtcaagggacgatatgcacaactgaaagaccgccgccagaccatcgggcagtacttctacgaggaactgagcaccgcgtttagcgacaaaaacaaccagcaatacttccgagtgaaggaggaagtgtatccaagggaagcctatatcgaggaatttgacacaatcataaatgcgcagaaggacaaacacgggttcctcacagacaaggttatacatcagctcaggaacgagattatctacttccagagaaagctcaaatcccaaaaagggctagtgtcaatatgtgaactcgaaggattcgagaaaacagtttacgacaaagagaaaaacaaaaacaaagttgtgttcgtaggaccaaaggtagccccgaaaacctcaccactgtttcaactatgccgaatttgggaagtggtaaacaccatatccctcaagatcaaaaacccggaaggcagcaagtacaaatggggcgaaaaagtccccaacctcaagcaaaaagaaatcctcgcggattatctcttcaaaaacgaaaacctatcgttctcaacactactcgaaatcctcgagctaaagaaagaggacgtttacgtcaacaaacaaatccttaaagggattaaaggcaacgaggcttacgccgcactacataatgtactcggcgaccacgaactattgaacttcgacgtatcgatcatcacgagcgaccacaccgcaatcttagttgacaagaaaaccggggaaatactcgaagaacgagccggcctagagctagatgcgtcactagaaagagaacccttataccaattctggcacacgatatactcgctgaaagacctagacgaatgcaaaaacgccctcataaaacgcttcggactggacgaggacattgcagagaaattatcccacatcgacttcaacaaacaggccttcggcagcaaatccaacaaaagcatgcgcaaaatcctcccctttctgatggaaggctacaactactcagagagctgctcgctcgcaggctacaaccactccaacagcctaaccaaagacgaaagagagtcccaaatcacactcgagcgcttagaacttctccccaaaaacaacctacgccaacccatcgtggagaaaatcctcaaccagatgatcaacgtcgtgaatacaatcctggaaaaatacggaaaaccatccgaaatccgcgtcgagctcgccagggaattaaaacagtcaaaagacgagaggaacgacacagatctacaaaacagtcgaaataaaaagctaaatgaggagataggcaaacggctcgccgaactaggactgccagtcacgaaacgatatatccaaaagtacaagttcatcttcccgagcctgtcgaaaaacctgaaagacgcacacgtaaacaatcaatgcatctactgcggtgaaaccttcaacctcaccgaggcccttaacggagacgcctacgacgtggaccacatagtcccaaaagcgcttctcttcgacgacagccagaccaacaaggtcctagtacaccgcaagtgcaacagcaccaaaaccaaccagactgcctacgactacataacggctaagggcgaggaagaagtacgtatctactcagaacgagtcgacgactggttcaagaagggcataataagctactccaagatgcaacggctaaaagtctcccacaaagaatacctcgaaaggaagaaactcgggaaagaaaccgagacggacaagaaactctgggaaaatttcatagaccgccaactgagagacacacaatacataagccgcaagagcagagaaatactacaaaaagtatgcaacaacgtcacaaccaccgaaggcggagtaacagccaaactacggaacctttggggctgggacgacatcctaatgaacctacaaatgcccaagtacaaagagctaggccaaaccatcaccaaggaatggaccagcgaacatggaaagcgcaagcaccaaaaggaagaaatcgaaaactggactaagcgcgacgaccacagacaccatgccatcgacgccctcgtcgtcgcatgtacaaaacaaggcttcatccagcgcatcaacacccttaatagcagcgagacgaaggatctaatgatcaaggaagtggaagaggcgaaaatcgagttcaacgagaaaactacactactcgagaagtacctcaaaacccaaaaaccgttcacaacgagagaagtaatgaaggaagccgacaaaatcctcatctcctttaaggcagggaagaaagtggccacgatcaccaaatttaaagctacaggcaagaataaagaaaccggagttattgtgccgcggggcgctctacacgaacaatccgtatacggaaaaatcaaagtcatcgaaaaagacaaacccctaaaatacctattcgaaaatcccgataagatcgtaaactcaagaatccgagacctagtcgaaacccgcctaagcgaaaacgagaacaactcgaagaaagcactgtccaccgtaaagaaaaacccaatcttcttcaacgaagagaaaaacgagatcctcgaaaaagcctcatgctacaacgacgcaaccgtcctcaaatacaaattacaaaaccttaaagccaaccaggtagacgatatcgtcgacgagagagtaaaattcctggttaaagagagacttactcagttcggaagcaaagaaaaagaagccttcaaagacatcctgtggttcaaccaagaaaaacaaatcccgataataaccgtgcgcctttttgcgcgccccgacgcgaacaatctccagattatcaaaaaggacaaaaatggcaaggacatagggttcgtactcacgggcaacaatcaccacatcgccatctacgaggacaaagactccaaacttgtccaacacagctgcgcgttctggcatgccgtcgaacgcaagaagtataacatccctgccgtaataaagaacagcgccgacgtttggagcctactgctcgacaaagagctcccggtcctcttcctagacaagttacccgcagatgaactgaatctgaaattctccatgcaacaaaacgagatgttcatactcggcctttcccaggagggcttcgacgaagcgataaagaacaacgacaaatccctgttaagcaagcacctatacctcgtgtggagcatcagtaacaatgactactacttccgacaccacctagaaaccaaaaacaccgaactcaaaaatatacccactgccaaagactccaaaagatacttccgattcaaatcggtcggagccctagtcggcatcaaccccatcaaagttcgcctcaaccacctcggtgaaataaccaagatcggcgagtga

SEQ ID NO: 6412 - RNA, 3960 nt, synthetic construct
  misc_feature 1..3960: note = Cas9 variant
  source 1..3960: mol_type = other RNA
atgggctacaacattgggctagacatcggaaccggctcagtcggctgggcggccctcactgacgaaggcaaactggctagagctaaaggcaaaaacctaataggagtacgactcttcgactctgcgcagagcgcggcccagcgccgcagctaccgcacgacacgccgaagactatccaggagaaaatggcgccttcgcctactcgaaaacatcttctccgatgaaatgggaatgatcgacgaaaacttcttcgcacgactcaaatacagctacgtccaccccaaggacgaagtcaataacgcccactattacggcggatacttattccccacccaacaagagacccacgactttcacgagaaattccagacaatctatcacctcaggctcaaactaatgatcgaggactgcaaattcgacctccgcgagatatacctcgccatgcaccacatcgttaaatatcggggacacttcttaaacagtcaatccaaaatgacaatcggagacagctataacccacgagacttccaacaagcgatacagaactacgcagaagcaaagggactcatctggtcgctaaacgacgcacaagaaatgaccgacgtcctcgtcggccaagcgggcttcggtctttccaagaaagcaaaagccgaacggctgctatcagccttctccttcgacaccaaggaagacaagaaagcgatacaggccatattagccggtatcgtggggaacaccaccgacttcacgaaaatcttcaatcgggaaaggtccggagacgagctgaagaaatggaaattaaaactcgactcagaagccttcgacgaacagtcccaggcgatagtcgatgagctcgacgacgacgaaatggaactgttcaacgccatcagacaagccttcgacggatttacgctgatggaccttctcggcgatcaaacatccatatcagccgccatggtgaaaagatatcaacagcaccacgacgatttgaaaatggttaaagagatagccaagaaacaaggcctatcacaccaagacttctcgaaaatctacacggctttcctcaaagacgacaccgacaaaggcatgaaagcattactggacaaagcagacctagcagacgacgtcctcgtagaaatccagcagcgcatcgaatcgcacgacttcctccccaaacaacgaaccaaagccaactcagtcatcccgtatcaacttcacctcgctgagctcgagaaaatcatcgaaaaccagggaaagtactacccattcctcttagacacattcaccaacaaggctggcgaaacaataaacaaactcgtggaactcgtaaaattccgggttccctactacgtcggcccaatggtgaccgccgccgacgtagaaaaggccggcggagacgccacaaaccactgggtgaaacgcaacgaaggctacgagaagtctcccgtcacgccctggaatttcgaccaagtcttcaaccgggaccaagcagcgcaagacttcatcgacaggttgaccggaactgacacctaccttatcggagaacccaccctcctgaaaaactcgcttaagtatcagctattcacagtactcaacgaactaaacaacgtcaaaataaacggccacaagatcgacgagaaaacaaagcatgtcctaatccaggacctcttcaaatccaagaagacagtctcggaaaaagcaatcaaggactactatctctcccaaggaatgggagagatacaaatagtcggactagcggacaaaaccaaattcaacagcaacctgtcttcctacatcgacttgagcaagaccttcgacgctgaatttatggagaacccggcgaaccaagaactgctagaaaacataatccaaatccagacggtattcgaagacgttaaaatagccgagcgagagttacagaagctagctctccccgacgaacaagtgcaacagctagccaaaacacactacactggatgggggaatctctccgacaaactcctgagcacacccatcatacaagaaggcagccagaaagtatcaatcctcaacaagctgcagacaacatcgaaaaacttcatgagtataatcaccgacaacaagttcggagtccaacagtggatacaagaacaaaacaccgccgaaaccgccgacagcatccaagatcgcatcgacgagctgaccactgcccctgcaaacaagcgtggcataaaacaggccttcaacgtcctattcgacatacagaaagcgatgggtgaggagccgaacagggtctacctcgagttcgccaaagaaactcaaaacagtgtccgcacaaattcccgctacaaccggctaaaagacctatataaatccaagacactatccgatgacgtaaaagcgctcaaagaagaactcgaatcccagaaaagctccctgcaatccgagcgaataggcgatcggctttatctgtacttcctacaacaaggcaaagatatgtataccggacaacccatcaatatagacaagctgtccacagactacgacatcgaccatatcatcccccaggcgtacacgaaggacgacagcatcgacaatagagttctggtaagccgacccgagaacgccagaaaatcggactcggctacctacaccaccgaagtccagcaatctgccgggggactatggaaatccctcaagaatgcagggtttatatcccaaaagaaatacgaccggctgaccaagggcggcgactactccaaaggtcagaaaacagggttcatcgcccgccagctagtcgaaacgcgacaaataataaagaacgttgccagcctaatagagagcgagttctcccaaaccaaagccgtagccattcgctcagaaatcacagcggatatgcgccggttagtcgccattaagaagcaccgggaaatcaactcctttcaccatgcctttgacgccctcctcataactgccgctggccaatacatgcaagcgcgctaccccgacagggacggtgccaacgtctacaacgagttcgattactacactaacacgtacctcaaggaactgcgacaatcttcatcatcgagccaagtacgccgcctaaagccctttggcttcgtcgtcggaaccatggccaaaggaaacgaaaactggagcgaagacgacacccaatacctgcgacatgtcatgaactttaagaacatactgaccactcgcagaaatgacaaggacaacggagcgctcaacaaagaaacaatatacgctgtcgacccgaaagccaaactgatcggcactaacaagaaacgacaagatgtcagtctctacggcggatacatctacccctactcagcctacatgaccctagtccgtgcgaacggcaaaaacctactcgtaaaagtgacaatcagtgcagccgagaaaatcaaatccggacaaatagaactttccgaatacgtccaacagcgccccgaagtcaagaaattcgagaaaatactcataaacaaactcgccatcggccagctagtgaataacgacggcaacctgatttacctgacatcctatgagttctaccacaacgcaaaacaactgtggctacccaccgaagaagcagaccttatctcacaactgaacaaagacagctccgatgaagacctcataaagggcttcgacatcctgacgagcccagccatcctcaaacgcttcccgttttatgaacttgacctcaaaaagctagtcaacatacgagataaattcatagcagtcgaaaacaaattcgatatactaatggtaatactcaaagccctacaactggacgccgcacagcaaaagcccgtaaagatgatagacaagaaaagtgcagactggaaagactaccgccaacgaggcggcatcaaactctcggacacatccgaaataatctaccaaagcaccaccggtatattcgaaaagcgcgtcaaaatatcaaacctcttatga

SEQ ID NO: 6413 - RNA, 3963 nt, synthetic construct
  misc_feature 1..3963: note = Cas9 variant
  source 1..3963: mol_type = other RNA
atgacggagcagcagcgtccgtacaacatcggactcgacattgggacctcctcgattggatgggccgtcaccgaccagaacgataaactactacatatcagagggcataacggtataggggtccgcctcttcaaggaaggtgagtccgcggccgagcgaagaggcttccgcactacacgtcggcgcctctctcgcagacgttggcgcctacggttcctagatcgcatcttcgatgcggaactggccaaagttgacccaaacttcctggcgagactaaaacaaagtaacatttcacccctagacccaaacaaacagatgtttggcaacattctattcgacgacgcccaattcgacgaccaaaaatttcaccagcaataccccacgatctaccacctacgaagtgcgctcgcacagcccgacgccccacaagccgacgtccgactcatctacctagccttacaccatatgataaaattccgaggccatttcctaaatggcgccgcagtagaaaagtttcacggcgggcaactacatctagaagcagagttccaagaacttaatcaaatcttcagcaaccagcagcgcgatcacgttcagctgcaaacgtcgagcctcgacgaagttgccacaatcctcaaagacaatcagcgcactcccagcgaccgccaacgagaactctcagcccgactcttcgtccccgtcgacaaaacaatcgacaaagaaaacaagaaacttgccacagaattactcaaagccgtactcggcctaaaagccaaatttgacgtgatccttggagtagaagccaccgacccccaagcattcaaactacaatttagctccgatgacttcgacgacaaaatcgctgaactagcatccgaactcaccgatgaggctaacgaaatccttactgtcctccaacgcctctacttctcgctcaacctggcagacatcctcacaaaccgccagactaaacaagtagcggacagcatctccacggctatgattaacagatacgacgaccacaagcaccacttaaagatgcttaaagaacttgaaacccaggtcacccaagaacaaagagacggactcaagaaagcatacgacgaatacattgacggcgacaaacccaccatagacacattctacacaaatgtaaagaaaaacctagacgacagcgaactcgccaaccaaataaaatcgctcatagacctccaagcgttcatgcccaagcaacgctctaaagagaacggatccatcccccaccaactacaccaacgcgaactagaccaactaatcgaagttcaaggaaaatattacccctggctcctcgccgcgaaagacaagctcgacgccctcatcgcctttcgagtaccatactacgtcggccccatgatcgatcctaacgaatccgacgaccctcagaacacgaaattcgcctggatggtgagaaaggaagcaggcgaaatcaccccctggaactttgaagaaaaagtagacaaaaccgggtcggcgactaacttcataaaacgaatgaccaccacagacacctacttgctaggcgaaccggtactgcccaagaacagcctcctgtaccagcaattcacagtcctcaacgaactgaacaaactcaaagtagacggcaaagcactaaccgtcgatcagaagaaatacttgtatgaacacgtctgtaaaaagcagcgccgcgtcaccctcaaaaagctctctgattgtctgatggcacgaggcgacttccccatgggcgccatcttcacggggaccacagaccaaaagaatatgaacaacaccctcaaaacctatcaggacttccaagaaatcttcggcgacgaaatagacaaccccgaccgccaggtggacttcgagaaaatgatagaatggtcgaccatctttgaagacagagaaatattcaaactcaaactcgcggagctaaactggctcaccagcgaacaactcgaacgcgtctccaagaaaagataccaaggttggggccgactgagccaaaaactcttaacccacatcgtaaacgaaaacggagaacgtatcatagaccagctgtggaacaccaaccaaaacttcatggagatcatggggcaggatggcgtaaaacaggctatccaagaacataacggcgcaaacgtcgcacaaaccggcataaatgaaacaatcgacgaactctacacctcccctcaaaacaagaaagcgatccggcaaatcctcctcgtcgttgacgatatcaagaaggcggtagggtacgcgcccgcaaatatcatgatggaatttgctagggaagatcgggacgaccaccgcctcatcgcgtccagggcacgacagctcgagaaaacctaccaagagatcagcaagaactggttcgacaacgaaagcgtcacccaggaactcaaagaccaaatcaaaaacaaaaccaaattcaccgaccgcctatatctctactttatccaagggggaatcgacctgtataccggccaccccctaaatatagaccaactatcgagctacgacatagaccacatcctaccccagagcttcctcctagacaactcgctgaacaaccgagtcctgacctcccaaagcgagaaccgcgtgcataaagaagaccgactccccggcgaaaccgtagccaacaaaatgagaccaacctggaagatgatgagagaacaggggttgatgacacaaaggaagtacaacaaccttacactcaagccggaccaaatctccaaattcaataacagaggccagtttatcaatagacagctcgtagagactagacaagtcatcaaactagctgctgacatcatgaaccaaaaataccaggccgaccaaacaaaggtagtcaccgttaaagccaacctcacccatcacatgcgagaaaaattcaacttctataaatcccgcaacgtcaatgactaccaccacgccttcgacgcatacctgaccgtatttgtcgggaattggctactcaaagaatatccaaaactacaaccatacttcgtctacggagacttcgctaagacaggaacgaacaatcttaagagcttcaacttcctataccgctttgaacgcgaccataaacttaacgataaaggcgcaatagacaccgacaaagaccagcagttaggatacatgaaacgaatctaccgcttcaagaaaatgcttgtcacaaaacaactcgaaacaaacgaaggagcactctacaaacaaaccatatacaaagcaccggcaaatgaaaagaacaccaagaaaaatcggtcacttatcaacacaaagaaaaatcgccccagcgacatctacggaggctactcccaatccgtcacagcctacatgtccctagtgttcttcaaaaacaccttcaaactaataaaaatgccgctcgtcgcagcaaatgccatcaaaaactcactcagcagctaccacgacacgatcttaaaaatcctcgggtcgaacgagttcaaagtcctaatacccaaagttaagatgaaccaactgatcaaagaaggggacagtctctacactgtcgtcggcgtttacaagcacaacgcccagcaactaatcctctcagacaacagcatgggcatcataactaaacccataagagaaatatgcgactctgacttagacagtgtcttcaacgaattagtggataacatagataaatacctcaacctttacaaaattgaagacaaactcacaatcaaagaaaaattctacgcgctcaagaacaaagaaagcaaatttaaatgcatatcagacatactcgtgggcacgcactgcaatgctggccgctctaacctcaagataataggattatcatcttactggggtatgttctcaggaaacaacgacgggctaaaaatcaacgaaaactcacaactcatataccaatcccccacagggctattcgaacaccgtgtgaaagtgtcagacctatga

SEQ ID NO: 6414 - RNA, 3972 nt, synthetic construct
  misc_feature 1..3972: note = Cas9 variant
  source 1..3972: mol_type = other RNA
atgaaagacttctacatcggtcttgacatgggcaccgactccgtaggctgggccgtagccgacgaggactacaacctctgcaaatttaagggaaaggccatgtggggagtccgcctcttcgatgagtccgccaccgcggccgaacgcagaggcttccgcacagcccgacgacgggcccaacgaaagaggcaacgaatactatggcttcaaatgctattcaacgaagagatatccaagaaggacatcgccttcttccaacgactcaacgaatctaaactctatcttgaagacaaaagcactaacgtgccctacgcggtcttcgctgacgagagcttcaccgacgtcgactaccacaagctctacccaactatataccacctcaggaaagaacttgtacaatccgacgaacctcatgacgtacggctagtatacctggcattacaccacttaataaagaatcgtggccacttcctcttcgagaacgtggggtcagacttcgagaaagaatcgtccttcgaggtcctcttcaagaacttacaaaactacatactaggcgagtacgagcttgcgctggaatgcatttcaccgctacaaatcgcggacatactcaaagacaaaagcaagcgcaaaactacgaaaagctccgagatctgcaaactactaggaatctccaagaaagggcaaccccgcctgaacgcaatagtgctcctcatgtgcggacaatccgtgaaactcgccgacctatacggagacgaaaactacaacaaggaggagaagtcgagcatatcattcgagaaaggctacgaagacaacgaagaaacctaccgggaactccttctggagagattcgaactgatcgagaaaataaaggccctatatgactgggccatcctcgcggatatcctgaagggcgaaacctacatcagctttgccaaggtgaaaacgtacgatgaacaccgacacgacctccaacaactaaaagcctttgtaaaagaacgctgtagatcagactacaacgaaatcttccgcgaaacttcggacaagctcaacaactacaccgcgtactgcggtaagttcaaggaaaacggcaggaacggtgtaatactgcactcagccaaccaaacggatttctgcaagtatcttaagtcaaaatttgacaaactagacaagtccggatacgaggacatgttcgagaaaatagaaaacgggagcttcatgcccaaaatagtggtaaaggacaacggagtaatccccatgcaagtcaacgaatcagaggtcagagcaatacttaaaaacgcctccggatacttggatttccttaacaaccaggacaaagatggaatcacagtcgccgacaagatactccaaatcttcgagttccgaatcccgtactacgttggccctctcaacgtccactccgacaacagctggttagtccggaaggacggaaagatctacccatggaacttcaacaagatagtcgacgtggacaagtccgccgaggagttcatcaacaagctgactgccaagtgcacctacctacccgaccgagacgtcatccccaagaactcgatcctatacagcagatatatggtcctaaacgaactaaacaatctcaagctggacgggaagaaacccgacgtcagtttcaaacaagccgtcttcaacgacctattcatgcacagacgaaaagttacacaaaaagccctccgagaatacataaaagcccaaaccggcacagagccggaaataacgggtatcgacggcgacttcaaagctaatatgcggccagctatagagctagccggctacaacctatcagaacctgacaaagaagaaataataaaagccataaccatcttcggggacgacaaaaagctcctaaaacgacgaatcaaagacaagtactccgagatgctgagcgaagatgagatcaagaaaatctgcaaactaaaatacaaagactggggtcgcctatccagagagttcctaacagagatatttgacgtcgatacagcaactggcgaatgtaaagacaacataattaacaccctttggaacacaaatgacaatctcatggaactgctaggcgcaaaatacaacttcacccaaagcatagagcaagccataagcaagagcacccacaaggcttccatagagaaaatggtagaagacatgtacgtaagcccaaaggtgaaacggaccgtcttccagtccttaaagatcatgaaagaaatagttaagatcaagggccatgcgcccaaaaaggtgttcgtagaaatgacacgacacgatggaaccaagggagataatggacgaacgaagtcgcgcaagaaacagctagaagaactctacaagaaatgcaaagaagactccacagagctatgggacgaactggagaaaaccgacgacgatgagttcagacaagataagctgttcttatactacacccaaatgggaagatgcatgtatagcggagaacgcattgaactgcgtgacctgtttaacaaaaatctatacgacatcgaccacatatttcccaggtccaaggtgaaggacgatagcatagacaaccgagtcctcgtgaagaagcaaatcaattctcacaaagataacgactacccactggattccactgtacgggaaaagatgcgcggccactggcaatatcttctccgccacggcttcatctctaaaaagaaatacgaccgcctcacccgcgtcacgccactgaccgacgacgaactcgcagacttcatagcgcggcaacttgtagaaactagccaaagcaccaaggccgtagccaccctcctaaagacgctctacccaacaaccgaaatagtgtacgtcaaagccgaattagtttctcgctttcgaacagaatacaaattcataaaatgccgggaagtaaacgacctccaccatgctaaagacgcctacctcaacattgtagtaggcaatgtctacaatgtgcgatacacacactccaaggcaatcttcattaaaggcctgcagaccaagaagtactctctaaaccgcatgttcgcattcgatacccccggcgcatggaacattgaaaatgagaaatcacttagcatagtaaagaagacggtgatgaaaaacaatatactatacacgcgttacagctacatgaagaaaggcggcctatttaaaatccagccactcaagaaaggcaatgggcaggcacccctgaaaaaggacctcccactctcggacattggaaaatacggcgggtacgacaaaccaacggcgagctacttctcatacataaagtacgagggcaagaaagggaaagagtgccgtcaactcgtagccatagacaactacctcaagaaatactacgaagaaaaccccattgaatatctaactaaccggctaggcctcaaaaacccagcagtcctcatccccgtgatcaaatataacagctgcatagagatcgacggcttccgcatgaacatatcaagcaaatcaaacgagggcaaaaccatcgtatacaagcccgccgtccagctagtattgggcgcagaaaaagaagcctacgtcaaaaagatatcgaaagtcctcagcaaaccggaggaacagaaaatcacaagttacgatggggtatctgccgaagagaacatagagctattcgacgcattgaccgccaaaatgacgaacacaatattcaaaatcaagctagaagacatcggcaacaaaatcaagagcgggcgcgataaattcgtcaccctagacgtaaagaaacaatgttacgtcataaacgaaatactaaaaatcatgcactgcaatgtcgtcacgggagacctatccctgataggggcagcaaagaaagccggcatcgtatccacgaactcggccctcagcgaaataaagaaagtctcctcgatcatgcttataaaccaatcagtgaccggcctgttcgagactaaaatcgacctgctcaacatctga

SEQ ID NO: 6415 - RNA, 3975 nt, synthetic construct
  misc_feature 1..3975: note = Cas9 variant
  source 1..3975: mol_type = other RNA
atgcgcgcaaaaggcaaaaccctcataggcaccagcctatttcgcgagggtaacaccgcggcagaacggcgtggataccgcacaacgcaacgacgcctaaaacgccgcaagcgaagactcaagctactagaggctttcttcgacccctacatcttcgaagtagacgaaaacttcctcgcccgactccacgaagcagacatatccccaaaagacgaaaacaaacgattctggggctccctactatttcccaacgaaaaagacgccaatttttataggaagtacccaacaatctaccacctccggaaagcgctcatggaggaggacagaaaattcgacgtacgagcaatcttcctggcaatccatcacataatgaagtaccgaggcaacttcctgtcacccctgtccgttgactctttcaaacaggaaggcctggagctcaaagaacaactcgacagacaactaaagcgcgtggcagaactctacaatgaactcaacaccgatgtcaagatcaacgtttcagacgtagagaccatacaagacatcataatcgacaaaaacaagagtcgtcgagacaaagcgggggccctcaagaaactgcttgcagtgagtagcgacagaaaagaaataaacaagctgaacgcatcgttagcaaaagaacttagcaacgcgatactcggcatgaaagcccagtttgcgaacctcctgctagccgacgacttggaaatagacaagaacaagaaaaacttctccctgctggacacaaacgcggaagaaaacgtttctggcctactagagctagtgaacgagaagcaggccgagcttttcgacgccataaaaaccatccacgaccagattatcctcaacgaaatcgtaccggacggaaagagcatctcccaaagcatggtagacaaatatgaggcccaccgcgaacagctacaagtcctcaaggcactctacgaaaagatggacgccaaacaaatcaaggcaatcaagaaggcatactcactatatattgacggcaaagatcccaaagccaagaaagtagacaaacgtgcacatcaaaaccgcgccgacttctacaaagaagtcaagaaagtcctagtcgagctggacgactcccgcgctgaaaaactcctaggcctaatcgaaatgggccaattcctccccaaacaacgaacagcaatgaacggagtgatccccaatcaactccaccaggtagaactggacaaaatcatagaaatgcaaagcaagtactacccctggctagccgaaaagaaccccgtaaaatcgcaccaaaagagagctccttacaagctggatgaacttctcacgttccgggttccctactatgtaggcccaatggtcacatccaagaaacaacaacaaacttcaaactccaacttcgcatggatggtcaggaaacaagagggggagataacaccgtggaacttcgaagaaaaagtggacaccatagcatctgccaacgacttcatcaaacgcatgacagccaaagacacctacctcgtcggcgaagacgtcctgccagcgaactccctgctctaccagcgttataaagtcctcaacgagcttaacaatataaaagtgaacggccgccgtctaccagtcgaattaaagcgcgaagcatacgtagccctcttcgaaaacggagactcgaaaacggtctccgcgaagtgcttcaaaaactggctcaacgtcaagctcaagaaccttaactctctgaaattggagggattgtcaaccggaaccaaattcgacaacaacctctccacatatcacgacctcaagaaaattttcggaaaagccgtcgacgacgcaggtcggcagaaagacttcgagcaaatcatcgaatggctaacaattttcgaagacaagaagatcctaagaatcaagctcaaagagattgaatggctgacggaagaaaacataacccaactgacgcgcctcaactacaacgggtgggggcgcctgtcacgccggctactcaccggaatatgcgattcgaacggccaacggatcatggactggctatgggacaccaccaacaacttcatgcagatccaatctcaacctgacttccaaaaagcgatcgtagagtacaactctgacaaactcgaacaaggcgacatagaacagatactcggagaagcctatacgagtccccagaacaagaaagcaatccgcaaagtaatcaaagtggtccaggatgtcgaaaaagcgatgggcgctaagcccacgtccatcagcattgagtttacccgctccgacggacgcagcgagctgacaaactcacggatgacccaactgcagaaaacactcatgtccctcagcgaagaaatgaccgaccaagcgctcctagctgagttcaaagacttccaagccagcaagaagaaacttaccaacaaatactacctctactttacacaacttggccgagacatgtacaccggtgaacccttaaatatagaccaactgtccctctattccgacggagaccatatcctgccccgctccttcatcaaagacgacagccttgataaccgagtattaactaaaagagcggtgaacaacgaaaagagcgacacggtccccgtctgcgaatatggggcaaaaatgaaagacttctggaacgatttatacgacaacggcctaatctcaaaacaaaaactggcgaacctcctaactgacccggacgaaatcgggccatacaaggctaacgggttcatccgacgccaactggtagaaacctcccaagtaatcaaactcagcgccgaaatcctgcagacgctgtaccaagacacgaagataatcgaagtacggcaaaaatatacccatgagctccgcgaacacttcaacttcgtcaaaattcgccagcttaacgactaccaccacgccttcgacgcctacctgacagccttctccggtcgttacctgtaccaaaggtatcctaaactacgcgggtacttcgtctacggcgattacaacaagttcgacgcaaagaaagaccgcaactatctcaaatcgtacaattttctctacgacctagaagagggtaaaaccgaccagatagtcgataacgtagaacacaaggtattcatgaaccgacaagacgccataaaccaactaaagaaagcatacgaatacaaatacatgttagtcagccaagaaacatataccaatagcggggccatgtttaaggagaccatctaccccgtcaatccaaagcagaagttaattcaaaagaaaaacgacaaacccgtcgacatatacggcggatactccaacaactacgacgcctacctctccatcgtcaggcttgaagacaagaaaggcattaaatttcgggtcgtcggaatccccatgcgcaacaaagcggagctcgacaacctagccaaagaagaccataacggctacatgcaacgccttaacgaaatcgtggacgagcaaatcaactcaagtgggaaaaagaaaaccttcagaattatcctccccaaggtccactttaagcaattagtcgaagacgactccggtaaattcatgctcggatcagccgcatacccctacaacgcaaagcagctagtcctaagcgtaaagtccatagagagcctagcaaacaaggatgcctcagaccgcgagctcgtcgcagtttacgaggaaatcctaaacgtcgtcaacgacaaattcactctatacgacgcccgacaatttcgtaataaacttacaagcagcaaagacaaattcgttgaactaaacacagcggacaaagtaactgaactcctcgacatcctcgacggcctccacgccaaccccgttgttaagaaattaaaaattatcagcggaagtccattcgggttcttgcaacgcccatccggaatcgtactaaccgagaacgctaaactaatataccaatccccgacgggaatcttcgaacgagtcgtatacctgcgcgacctctga

SEQ ID NO: 6416 - RNA, 3984 nt, synthetic construct
  misc_feature 1..3984: note = Cas9 variant
  source 1..3984: mol_type = other RNA
atggaagggcaaatgaaaaacaacggaaacaatctgcagcaaggcaactactacctcggacttgatgtcggtacatccagcgttggatgggccgtcaccgataccgactacaacgtactgaaattccgcggcaagagcatgtggggggccaggttattcgacgaagcctccaccgccgaggaaagacgcactcaccgaggcaaccggcgccgtctcgcgcgccggaaatatagactcttactactcgagcaactctttgagaaagagatacgaaaaatagatgacaacttcttcgtacgcctgcacgagtctaacctgtgggccgacgacaaatctaagccctctaaattccttctatttaacgacacaaacttcaccgacaaagactacctaaagaagtacccgaccatctaccacctccgcagtgacctcatccacaactccacagaacacgacatccggctcgtattcctggctctccaccacctcataaaataccgcggacacttcatttacgacaacagcgccaacggcgacgtaaaaacccttgatgaggccgtcagcgacttcgaggagtacctcaacgaaaacgacatcgagttcaacatcgaaaacaaaaaggagttcatcaacgtgctgtccgacaaacacctaaccaagaaagaaaaaaagatcagtctcaaaaagctatacggcgacatcacggactccgagaatatcaacatcagcgtccttatagaaatgttgagcggctcctcaatatccttatcaaacctattcaaggatatagaattcgacggaaaacaaaacctaagtctagacagcgatatcgaagaaaccctcaacgacgtcgtcgatatccttggcgacaacatagacctgctgatacacgcaaaagaagtatacgatatcgccgtgctcacctcaagcttggggaaacacaagtatctctgcgacgcgaaggtagagctgttcgaaaaaaacaaaaaagacctcatgatcctaaaaaaatacatcaaaaagaaccaccccgaagactataagaaaatattctcctcccccacagaaaaaaagaattacgccgcatacagccaaaccaactcaaaaaatgtctgcagccaggaagaattttgcctcttcatcaagccatatatccgcgacatggtcaaatccgagaatgaggacgaagtccgcatagccaaagaggtcgaggataagtccttcctaactaaactaaaaggcaccaacaactccgtcgttccctaccaaatccacgagcgcgagctgaaccaaatactcaaaaacatagtagcgtacctacccttcatgaacgacgagcaagaagacatatcagtcgtagacaaaataaaactcatcttcaaatttaaaatcccctactacgttggccccctcaacacaaaatccacccgctcctgggtctaccgcagcgacgaaaaaatttacccctggaacttcagcaacgtgattgatctcgacaagaccgcgcacgaattcatgaaccgcctgatcggccgctgcacctacacaaatgaccccgtcctccctatggactcccttctctactccaaatacaatgtcctcaacgaaatcaaccctataaaggtaaacggcaaagccatccccgtcgaggtcaaacaggcgatctacaccgacctattcgaaaactccaaaaagaaagtgacccgcaaatccatctacatatacctgctgaaaaacggttatatagaaaaggaggacatcgtgtcaggaattgacatagaaattaaaagcaaactaaagtcccaccacgactttacgcaaatagttcaagaaaacaaatgcacaccggaagagatcgaacgcattataaagggcatcctagtatactccgatgacaaatcaatgctgcgccgttggctcaagaataacatcaaaggactatcggagaacgacgtcaaatacctagccaagcttaactataaggaatggggccgtctctctaaaaccctccttaccgacatctacaccatcaatcccgaagacggagaagcctgctcaatcctagacataatgtggaacaccaatgcaaccctaatggaaatactgtcgaacgaaaagtaccaattcaaacagaacatagagaactataaagccgaaaactacgacgagaaacagaacctacacgaagaactagacgatatgtacatcagcccagccgcccgccgctcgatctggcaagccctaaggatagtagatgagatcgtcgatataaaaaagtcagcacccaaaaaaatattcattgagatggcaagagaaaaaaaaagcgccatgaaaaaaaaacgcacggagagtcggaaggacaccctccttgagctgtacaagtcatgcaaaagccaggcggacggcttctacgacgaagaactcttcgaaaaactctcgaacgagtcaaactccagactgcgccgcgatcaactctacctctactacacccagatggggcgtagcatgtacacgggaaaacgtatcgacttcgataagctcatcaacgataaaaatacgtacgacatcgaccacatctatccccgttcgaaaatcaaagacgactccatcaccaatcgagttctagtggaaaaagacatcaatggcgaaaagacagacatctaccccatctctgaggacattcggcagaagatgcaaccgttctggaaaatcctaaaagaaaaaggattaataaatgaggagaaatacaaaagactcacacgcaactacgagttaacagatgaggagctctcttccttcgtggcccgacaattggtggagacccaacaaagcacaaaagcactcgcaactctactcaaaaaagaatacccctctgcgaaaatcgtatactccaaggccggcaacgtgagcgaattcagaaaccgaaaggataaagaactcccaaagttccgcgaaatcaacgacctacaccacgcaaaagacgcctatctcaacatcgtagtcgggaacgtatacgacacaaagttcaccgaaaaatttttcaacaacatacgcaatgagaactactcgctgaaacgcgtcttcgacttctccgtcccgggcgcctgggacgccaaaggctcaactttcaacacaattaagaagtacatggccaaaaacaaccccatcattgccttcgcaccatacgaggtaaaaggggaactattcgaccagcaaatagtaccaaaagggaagggccagttccccatcaaacaaggaaaggacatcgaaaaatacggcggctacaacaaactatccagcgctttcctcttcgccgttgaatacaaaggcaaaaaggcgcgcgaaagaagcctcgaaaccgtctacataaaggacgtagaactttacctgcaagacccgataaaatactgcgaaagcgttctcggactaaaggaaccccagatcataaaaccgaagatcctcatggggtcactcttcagcatcaataacaaaaaattggtcgtaacgggacgctccggaaaacaatacgtgtgccaccacatatatcagctctccatcaacgacgaagatagccagtacctgaagaatatcgctaaatatcttcaagaggaacccgatggaaacattgagaggcagaacatcctcaatataacaagcgtcaacaatatcaaattattcgacgtactatgcacaaaattcaatagcaacacatacgaaatcattctcaacagccttaaaaacgacgtaaacgagggccgcgaaaagttctccgaactagacatactagaacagtgcaacatactcctgcagttactcaaagcattcaaatgtaatcgggaaagcagcaacctcgagaagctaaacaataagaaacaagccggtgtgatagtcattccccatctgttcaccaaatgctcggtatttaaggtcatccaccaatcaatcacggggctattcgaaaaagagatggacctactcaaatga

SEQ ID NO: 6417 - RNA, 3984 nt, synthetic construct
  misc_feature 1..3984: note = Cas9 variant
  source 1..3984: mol_type = other RNA
atgaagaattactcgattgggctggacatcggcaccggctccgtcgggtgggtctgcatcgacgaaaactaccaaatcctccgctataacaatcgagcagccttcggcgtgcacgagttcgaaaccgcacacgtcgccgaggaacgccgtatcaagcgtggagcccgccgccgctacaaccgccgaaagaaacgaatccaactccttcaatctctgttcgtcccacacatgcaacaaaaagccttcttcgcccctacaataacagaacactactggaaaaacgataaccaattcgaaaaccggaccctcagcgaagtcttaatgtccctcggcatgaacccgaacacataccccaccatcttccatctgcgccacgaactcatcgaatcaagcgtcaaaaaggatgcccgtctaatctacctagccctccacaacctagtaaagttccgaggacacttcctccaggagggatcaacatggaacgccaacatgtccgacgccaacctatccgaacaattcgaacaactactccacatatacaccgaaatggaggaactcccccaagtctcccttacggcccaacaaagcaccgacgtcgaacacatccttcttaacaatcacatcagcaaagctgaacgagccagacaacttacagcattattcgaacgcacctacgaacccttcttcaagctaatcgtaggactcgatatagcggcggcccagctgttcaagcaatccgagcaacaactcctctacaaggagagcaaaacaaaagtcaacctcactgcggagacactgcccgaagtactccaaacaatgcttgagccggaagtcgccttcatcgaagccgtacaacccttctatcaacaaacagtgctctttgatctcctgaaaggccaaagctacgtcgcagccgcaaaggtcgaggcattcaaccagtatgaacgcgacctcgccctactgaagtcagtaattaatgaagtcggctccgaaaaacaataccgggcattcttcattacttccaagcagaagaaacgacaattcgaacaaaaaccaaacatggagctcctatgtcacctagaccgcttcaatcgcgagaagaaatatgaggaaacattctataaagaagtgagcaaactcctcactgcccttatcaaggaagcgaccggcgaggtcaaggagcacatagaacagattatacaggccatggagagtcagagcttcctcgtcaaacagaaaggcatccaaaacgcaagcataccctaccaaaactccctctacgaagctgaaatgattcttcggaaccagcaagcctactacccctggatcaccgacgagttcatcgaaaaagtcaaacagctcatcgccttccgaatcccctactacattggacccctggtccaaggcgacgaacaaccatttggctggctgcaacgacaagcggacggaaacatcacaccttggaatttcgatgaaaaagtaaacaaggccgcaagcgcagaatctttcataacgagaatgaccaaaaactgcacataccttaaggaagaaaaggtactgccaaaacaatccctcatgtacgaaaaattcacgctcctaaacgaactgaactcggtacagatccgctcatccctcgaacaaccgcataaaaagcaccggctatgcgaagacatgaaacagtggatcatagagcacgtgttcaaaaagacaaaaaccgtcacccacaaaaccctcatccaggcactaaagaaaagcccatacaaagacgagctctatgacgaatcaacgggcaactggaaagacgtctacggcacccagaaagaagacagattcgctagcagcctctcgacctacatttccctcaaagaaatagtcggggacatagtcgacaacgcattcatggaagaaatcatctactggctgaccgtgttcaccgaccgcgacatcatcaccctcaaaatgaacgataaatacccgttcataaccgaacaacagatccagcgacttctcagtctaaacataagcggctggggccaactgtcacaaagactcctgcaatccataccagtggacgacatgaaccgcagtgtcatcgaatacatggaaaagcacgccgtcaacttcatggagctcctaagcccccgccagtcagacctagcctataaaatcgagcaagtgaacaagcaacacagcaagaagatccacaagatcagatacgaggacatcgaacaactcaccggatcgcccgccctcaagagaggaatctggcgttcagtaaagatcatcgaggaactcactgccatattcggagaacccaaaaatattatgatagaagtggcgcgggaagaccaagcgtcgcaccggacaaagagccgaaaggaacaatgggaatcgatcggaaaatcactagcaaaggaagagaaagaactaaaagcattcttcaaagaaatggcccaatacccaaaacagcagttcgacaggactcggttctggctatacgtcacccaacagggaaagtgcctgtacacaggaaaaacactacgcctcgaggacctatcgtcctacgagatcgaccacatcctccccaggaatttcgtaaaggacgatagcatcgacaacctcgccctcgtttatcctatggcaaatcaggagaagaacaaagcgggcaacaacaagatgccacttgagataatcgacgccaagcaacaacccgcaatgatggcacactggaagcggctcaaccaactcaagctcatctcagactcgaaactgcacaagttgatgaaacctagcttcaacgacgttgataaagagaacttcattgcccgccagctggtagaaacccggcagatcatcaaacacgtccgagatctgttacaagaacgcttcgagcacacagacatacacgttgtcaaagccaagatggtaagccaattccgaaaattctcgcggatccccaagatacgagactacaataataaacaccatgcaatggacgcactattcacaaccgttcttatccaattcatactccaaaagtacggcaagaacttcctccaatttgacctccaacacaaagacatctccaaaaagtggtccaagatagcccaatccaccaaacacttcttccttttccaacagttcgccgagcaacagataaaatccccagtaacgaaagaacttgtgagtggggttcaatacttcgagcacatcttctatgaacaaagttggcaaacaactaagatgacccaaacaatcgacagtaatttctacaaagaaactatattcagcccaaaattaaagacagcaaaatacacctcagcaaaagcggaaaagttcgtccatgacgcaatcgtcaaatatgccgtctgcgggatccaatacacgagcctcaagaaaaacaaagaacagcaccacgtactcctcaccgacataaacgtcatcgaacactaccaactaaaagaagcaagcctcaacgaactcgccctccacctagccaagcgagagagcaaagacgacgtcatcgacgcccaaatgctagtggtcatacccaaatacaagaaaattatgctcaatgggtccccatactactgcatttccagcgacgagcggcacatagcaacacaattcgtcttacgcaaagacctactcgaagccgtgctccacgtaaacgacgagacttcagtagacgagctacgaacactgttcagatcgatcgtcgaggaaatgatgactcaatacaaagtatacaacaaagacacaatccgcaacaagatagacgcgttcatcgagaccgagctcatcgacgtcgaaacattccaagtcgggttcacagagataaagaaaatggtcgctgcaaacgcgcagagatcggataaattcggaggccgactacgccaagttatgaaagtggaggacatctacatcattgatgaatccataaccggactacggtaccgaaaaccccgcaaacttgtcaaatga

SEQ ID NO: 6418 - RNA, 3984 nt, synthetic construct
  misc_feature 1..3984: note = Cas9 variant
  source 1..3984: mol_type = other RNA
atgaagaaaaactacacgatcggcctggatatcggaaccgccagcgtaggctgggctgtcctaaccgaagactatgagctaataaaacgaaaaatgaaaataagcggcaacacccaaaagaaagcagttaagaaaaacttctggggagtccgactcttcgaacagggcgaaacggccgaaggccgccgactaaaacgaacaacgaggcggcgcatagcgcgacgcaggcagcgaatacaatatcttcgaaccatcttcgacgaaggcatgaatcaagtcgacgcaaacttcttcgcgagactcgacgagagcttcagcatcatcgacgagaaagagaacgagaggcaccccatcttcgggaacgtggccgaggaagctgcctaccacgaacaattccccaccatataccatctgcgtgagcacctagccaactccagcgaacaggccgacctacgactcgtctacctcgcactcgcccacatcatcaagttccgcggacacttccttatagaaggcgagctcaacaccgaaaacagctcagtaagcggaacgttcgaacaattcataaaagtctacaacgaaacctttaacgtagaaaaggccctagacctcaccgtagacctcgacggcatcgcggagcaaaagatcagcagaatgaagcgtgcagagctaatcctcagcctatttccagaagaaaaatctacgggtgacttcgcccaattcatcaagatgatagtaggcaaccaaggaaatgtgaaaaagacattctcactaaatgaggatgccaaaattcaatttagcaaagaagagtacgaagaaaacctcgagaccctactagcggaaatcggagaagatttccgctcagtcttcgacgcagcgaaaagcgtctacgacgcgataagcctggcaaacatactgaaggtaaccgacgccaccacacgggcgaaactatcatccagcatggtagtcagattcactgaccacaaagaggacctaaagacactaaaacgcttcgtccgggagaacttacctgacgagtacgacgacttatttaaaaacaagaaggtcgcgggttacgccggctacatcgacggcaacgaaacacaagaagcgttctacaaatacctaaagaaaaccttggccaaagccaccggggcagaaggcttcctagccaaaatggaacaggaggacttcctgcgcaaacaacgcaccttcgacaacggggtcataccctaccagctccaccttgaggaactgaaagcgatcatcaagaaccaaaagagctactactccttcctagatgaggagaaaataagtcaactgatgacgttccgcataccctactacgtaggaccgctcgccaaagaaaaaggccaattcgcctggcttacaagaaaggaaatgggcaaaataacgccgtggaatctcaacgaaaaagtagacatagagaaaagcgccaccgacttcgtggaaagaatgaccaacaatgacagctacctgccaatggaaaaggtactacccaaacacagtctcctatacgaaacctttacagtatacaacgagctcacgaaggtgagatacatagacgacaacggcagagcacaaaatttttcgagcaaggagaagagacagattatcaacgaattgttcaaacagcaaagaaaagtaaagaaagaaatgctggaagcattcctcaaaaatgaatacggaatcgagaatccaaaagtagaaggaatcgaaaaatccttcaatgcctgcctgggtacataccacgacctgattaaacttggtatacgtcccgagctgtttgaacaacccgaacatgagcagcagttcgagcaaatcgtcaaaatcctgacagtgttcgaagaccgaaagatgaggcgaaagcagttggaaaaattctccaacatcctaaccgaagaagaacaaaaacaactagaaagaaagcactacaaaggctgggggcgcctgagcgcgaagttgatccacggcattgtcgaccagaaaacacagaaaaccatactcgactaccttatcgacgacgacgatctccccaaaaaccgtaacagaaacttcatgcaactaatcaacgacgagaacctatccttcaaagaagaaatcgagaaaatcgcattcgacaacgacaaatcgaccgaagaaatcgtacaagagctcgccggatccccagccatcaaaaagggcatactgcaaagcctgaaaatcgtcgaagaaatcatagacatcatgggagaactacccacaaatatagtggtagagatggcccgagaaaaccaaacgacagcccagggcaaccgcgcatcgaaagcccgaatgaaatacctcgaggaatccatcaaaaagctcggctcatcgatacttgaagacgaaccaatcagcaaagacgcgaacctgctacgcaacgacagactattcctgtactatctacagaacggaagagacatgtataccggcaatgagctcgacatcaacaacctctcgtcatatgacatcgaccacatcgtcccccagagcttcgtcaaggacgactccatcgacaaccgggtgcttacaacaagctcgatgaacagaggaaagagcaacacagtgcccgctgaatcggtcgtgaagaaaatgcgccccacctgggagcgtctactagccagcggactgatcagcaaaaagaaattctcatacctcacaaaggccacaaacggcggcttgacggaggaagacaaagcccatttcatacaaaggcaattagtagaaacccgacaaataacgaaaaacgtggcccaaatcctccaccaaaagtacaacaacgagcaactaagcgaaaaaccggtacgcgtcataacccttaagagcgcactcgcaagccaattccgaaaagacttctccctctacaaaataagagaactaaacgactaccatcacgcgcaggacgcctacctcaacggcgtcatagcccaagcattgctgaaggtctacccaaaactagagcccgagttcgtctacggtgaataccaaaaggtgtccatccgcgcgctcaacaaagccactgccaagaaggagttctactcgaacataatgaacttctttacgagcgacgaaatggttgcgaacgaagaaaccggggaagtcctgtggaacagacaacgcgatatcaaaacaataaagaaagtcatgaactaccaccaaatgaacatcgtcaagaaagtagagatacaaacgggcgcatttacgaaagaatcgatcctcccgaaagggcccagcaaaaagctaatagcacgcaaaaacaactgggcgccggtaaactacgggggcgtggactcgccgaccgtcgcgtactccgtcataattacccacgagaagggcaaagccgcaaaagtagtacagcaactcgtaggaattaagatcttagaaagacaggctttcgagcaggacgaggtagcgttccttgaggaaaaaggatttatccacccgaaagtacaactaaagctacccaaatacagcctctaccagttcgccgatggcaggagaaggctattagccagcgcagaggaatcccaaaagggcaatcaaatggtactgcctgtacatctcatagaacttctctaccacgccaagcacgtatccgatagcagtggcaaatcccttgaatacctgaacgaacaccgacacgagttcgccgagctcctggaagcaatacttcagttcacggaacagtacattgacgccgggaagaatcagaagaaagtccgcgacctatacgagaaaaaccaggacgccgacatgcgggaacttgcgagcagtttcatccaactcctccagctcaataaacaaggcgccccagccgacttcaaattcttcggagagacgatcccgcgacgacgctacaaaaacaccgcagaaatcgtcgacgcaaccttcatcaaccagagcatcacaggactctacgaaacacagaagcgcctcgtgtga

SEQ ID NO: 6419 - RNA, 3984 nt, synthetic construct
  misc_feature 1..3984: note = Cas9 variant
  source 1..3984: mol_type = other RNA
atgacagaacaacaacagccatacaacatcggcctcgacataggcacatcgtccataggctgggccgtaacggaccaaaacgacaaactactgcacatccgaggccataacggcatcggtgtgcgactcttcaaagaaggagagtccgcagccgaacggcgcgggttccgaaccacgcgccgtagactaagccgccgccgctggcgactccgtttcctagaccgcatcttcgacgcggaactcgcaaaagtggatccaaacttccttgcccgcctgaagcaatccaatatcagtcctctcgacccaaacaaacagatgtttgggaacatcctcttcgatgacccccaattcgacgaccagaaattccaccagcaataccctaccatctaccacctccgaagcgccctcgcacagccagacgcaccccaggcagacgtaaggctcatctacctggcgctccaccacatgatcaagtttcgcggacatttcttaaacggcgccgccgtcgaaaaattccacggcggccaactacacctagagagcgagttccaagagcttaaccaaatctttagcaaccaacaacgagaccacgtgcaactccaaacctctagccttgacgaagtcgccaccatcctcaaagacaaccaacggacccccagtgacagacaacgcgaactatcagcgcgactgtttgtccccgtagacaaaacgattgacaaggaaaacaagaaacttgccaccgaactgctcaaagcggtcctcggcctaaaagcgaaattcgacgtaatccttggtgtcgaagcaaccgacccccaagcattcaaactacaattttccagcgacgatttcgacgacaaaatagcagagctcgccagcgaactgacagacgaggctaacgagatcctcaccgtcctccaacgactatacttctcgctaaacctcgcagacatccttaccaacaggcaaacaaaacaagtcgctgattcgatctcgaccgccatgatcaaccgctacgacgaccacaagcaccacctcaaaatgcttaaggagctcgaagcacaagttacccaggaacaacgcgacggcttaaagaaagcctataacgaatacatcgacggagacaaacctacgattgacacattctacacaaacgtgaagaaaaatctggacgattcggaacttgctaaccaaataaaaagtcttatagacctacaagcattcatgccgaaacagcgaagcaaagaaaacggcagcatcccccaccaactccaccaacgagaactcgatcaacttatcgaagtccagggcaaatactacccctggctccttgccgccaaagacaagctcgatgccctgatcgctttcagggtcccatactacgtaggacccatgatcgatccgaaccaaagcgacgacccccaaaacaccaaatttgcctggatggtaaggaaggaagcaggagaaataaccccctggaacttcgaagagaaagtcgacaaaacctcaagcgcaacaaacttcataaaacgcatgacaacgacagacacatacctcctaggtgagcctgtccttcccaaaaactctcttctttaccagcaattcaccgtccttaacgaactgaacaaattaaaagtcaacggcaaagcactcacagtagaccagaagaaatacctctacgatcacgtctgcaagaaacaacgacgcgtcaccctcaagaaactttccgactgtctcgtggcgaggggcgactttccaatgggggcgatattcacagggacgacagaccagaaaaacatgaacaatacactaaaaacgtaccaagacttccaggagatcttcggcgacgagatagacaacccagaccgacaggtggacttcgaaaagatgatcgagtggtccacgatattcgaagaccgagaaatcttcaaactcaagctagccgagctcaattggctcacgagcgagcaactcgagcgcgtgagtaagaaacgataccaaggatggggacgtctaagccaaaaactcttgacccatatcgtaaacgagaacggcgaaagaatcatagatcaactgtggaacacgaaccaaaacttcatggagattatgggacaagacagcgttaaacaagcaatccaagaacacaatggcgccaacgtagcccaaacaggcatcaacgagacaatcgacgaactatacaccagcccgcagaataagaaagccattcgccagatacttctcgtagttgacgatataaagaaagccgtgggctacgcacccgccaacataatgatggagttcgcccgagaagaccgagacgatcaccgcctcatcgcctcccgagcacggcagctggagaaaacctaccaagaaatttccaaaaattggttcgacaacgaatccgtaacccaagaactcaaagaccagattaaaaacaaaaccaaattcactgatcgactctacctctacttcatacaaggaggcatcgacctctacacaggccaccccctgaacatagaccagctgagctcctacgacatcgaccacatactcccgcaatccttcctcttagacaactcgctaaacaatcgagtactgaccagccaagcggagaatcgcgtccacaaagaagaccggctccccggcgaaaccgtcgcaaacaaaatgcggcccacctggaaaatgatgagagaacaaggtctcatgacacagcgtaaatacaacaacctcacactaaaacccgaccagatctcaaagtttaacaatagaggccaattcataaaccgccaacttgtagaaacccgacaagtcatcaagctcgccgcagacataatgtcccagaaataccaagccgatcaaacgaaagtcgtcacagtaaaagccaacctcacccaccacatgcgcgagaagttcaatttctataaatcacggaacgtcaatgactatcaccacgcgttcgacgcctacctaaccctcttcgtcggaaactggctcctcaaggaataccctaaactccaaccctacttcgtatatggtgacttcgcgaagacgggtaccaacaaccttaagtccttcaacttcctataccgattcgagcgcgatcacaaacttaacgacaagggcgccatcgataccgacaaagaccaacaactaggctacatgaaacgcatctatcgcttcaagaaaatgctcgttaccaaacaactagaaaccaacgaaggagctctgtacggacaaactctatacccagcacccaagaatgacaagaaaacccggaacctgatcaacagtaagaaaaaccgacccagcgacatctacggcggctacagcaacgaaaacggcagcttccttacgctcgtcaaactgaagaaaggctccaaatacgactaccgactggtcgccgtgccagtatcaaaaataagcgaaattaaagagagtgaactcgccaccatcgaaaaagccatagcgccccaattcctgaaaagctcaggcaaataccgcgacttccaagtcgtactctcaaaaatacttataaaccaaaaggtcatcgacgatggcatgatattcactataggtagcaaatcgtacaaacacaatgccaaacaagtcgtgttgtcggacaactcaatacagatagtctcgaccctatcccgaataagcgacaaggaaaaactgattactgtgttcgacgaaatcgtagacatcacctccaaatacctcccatggtacaaagtcaacgatgtcgagaaaacaaaaatgctattcagacaaatgcaagacatagacgagatgaagaaaataatcgacaactcgctcatcggcctacactgtaacgcctccatcacagacttagggaaagtcggccttagcaaatactggggccggttcgtcctgaccgccgggatttccctcacagtcgatgcccaactcatataccaaagccccacaggccttttcgaacaccgcgtgaaagtgtcggacctctga

SEQ ID NO: 6420 - RNA, 3990 nt, synthetic construct
  misc_feature 1..3990: note = Cas9 variant
  source 1..3990: mol_type = other RNA
atgaacaagcagccgtacaacatcggactggacatcggcaccagcagcgtcggctggtccgccaccgaattggacaaccggctcctacacataaaaggccacaacggcatcggagtgcgactcttcaaagaaggagaatcagccgctgaccggagaggcttccgcactacgcgcagacgcctcgcaaggcgcaaatggcggctccgtctattgaacgaaatcttcgccacagaaatagcaaaagtcgatccctctttctttgcgagactcaaacaatccaacgtttcccccaaagatcccaacaaaacaatgtttgggaacatcttgttcgacgacgaaaacctggacgaccagaaattccaccatgactacaagacgatctaccacctacgccaagcaatcatcaatcaccccgaacagaaattcgacatccggctcatttacctagccatgcatcatatcatcaaataccgcggccacttcctgaaccaggcaaacgtccaggactttaaaggaggcaaaatagacctcgaaaaatcattcaaagctctcaacgacatattcgagaaccaaggacgtgacctccgcctggtcacagacgaagccaaccagtatgtgaaggttctatccgacaacgccaagacccgctctgaccgcaagaaagaactttctaagttactatacgtacccatcgacaaagataccgacaaaaactcgaaaaaggtcacgggtgagatccttaaagcaatactcggcaataaagcgaaattcgatgttatctttggcatcgaggtcgaaaaccccaaggaatgggtcctaaccttcaacagcgacgatttcgacgacaagatagaaggactctcatcacaaatgaccgacgaggactccgagatcctgctaattcttaaggagctatacttcgccctcaacttatccgacatcctcaacaactccgtcacggacaaaaacgccaagacgctatccgaagccatgatcaacagatacgacgaccacaagaaccagctagcaatgctaaagaaagtaatagactcatcagacaaaaagcacgcaaaagaactaaaggaggcatactccgcctatatagacggcgagaacaataagaagatatcctttgaggacctcaagaaacggattcaaaagaacctggtcgactccgagctgtcccagaaaataaatgacctcctagatcatgactacttcctaccaaaacaacgctcaaaagagaacggcgcaataccccaccaactacaacaacaagagcttgatcagataatagaaagccagaagcagtactaccctttccttgccgaactgaatcctaatgaaaaacgcagccgccaggccaaatataagctcgacgagctcgtcgcgttccgcgtatcctactacgtaggccccatggtagaggtcaccgattcaaaccaagagaacaatggcaaattcgcctggatgattcgaaaggaacaaggggaaatcaccccctggaacttcgatgaaaaggtcgaccggaccgagacggcaacgaaattcatcacacgaatgacgactaccgacacatacctaatcggagaacccgtcctacccaaaaactcacttctctaccagaagttcgtagtgctgaacgaactcaacaacctcaaaatcaaccaagaaaccataaccccaggccaaaagcaatacttatatgaacacgtaatgaagaagaacaaacgcgttacattaaagaaaatagccgacgcccttgtcatcaaaggagattatccgtacgccccagaggtaaaaggcaccaccgaccagaagaacctcaacaacggcctaactacatacatagacctcgccaaaatcttcggcaacgaactcgacgacgtggacagagaggccgacttcgagaaaatcattgaatggtcaactatcttcgaagatcagcacatcttcgtcttaaaactccaggaattgaagtggctcacagagaaacaacgcaaccaagtagtcaagctccgctaccaaggttggggaaaactcagcaaagaactactcgcaggcctagtggacgataacggccagcggatcatagacttactctggtccgataaccaaaacttcatgcaaatcgtcaaccagaagtccttcaaagaatccatcgcggaccacaacggcgcccacctcgaagagaaaaacttaaaagacgtaatcaacgatctttataccagcccccagaacaaaaaggccatccgccaagtaattctagtagtcgacgacataataaacgcagtgggctacgaacctgcgaacatcatgatggagttcgcccgagaagattccaacgaccaccgactcacaaactcgcggagccgacaactcgaaaacgtctacaaagacattacgaatagctggttcgacaacgactcagtaaaagacgaactcgaagacaagatcaaaaataaagacaagtttactgatagactgtacctttacttcacccaaggcggcaaagacctctacacgggggagccactcaatatcgatgacctaagcagctacgacatcgatcatatactcccccaatccttcatcctagacaattccctcgacaaccgagtcttgaccagccagcgcaataaccgagtgtctaaagaagaccaactgcccggcgaactattcggaaccaaaatgcatgccttctggaaacgcctgaaagccgcccacctcatatccaacaagaagtattacaacctaacactaacccccaactccatctctaaattcaataaccaaggaaggttcatcaaccggcagctcgtagaaacacgacaagtaatcaagctagcggcggagattctccataaccggtacagtgaagaaaaagggaccaacatcgtcactataaaagccaatctcacccaccacatgcgcgaaaaattcaacttctacaagaatcgaaacgtaaatgattaccaccacgcattcgacgcctacctcacggcgttcgtgggtaactggttactccaacaataccccaagctaaaaccctacttcgtctatggagacttcgccaagaccgaaataaacaaccttaaatcattcaacatgctatacaaattcgaacaagctcaccaactgaacgaaaaggatggaaagatagccaaggacacagacgccctcctcggctacatgaaaaacgtataccacttcaagaaaatgctggtaacaaaagaactagaaacaaaccatggagccctcttcaaccaaaccctatatccatcaccagcccacgatatcaagaaacgccagctcataaaaccgaaagacaaccgccccacagacatctacggcggatacacccacgaggaacggaaatacatgtcccttgtaaaggtaatcggaaagaaagacaacgaataccggatggcaaacgtgccccttctaaaaatcaacaaaaacaacgacataaaagagatactcaaatcacagttttctaacaagaaattcgaaatagtactccccaaagtgctcaaaaaccaactcttctccgaaaacggagctcttttcgtgatagggtccaaaggctacaagtacaatgccaaccagctagtgctatccgacctggacatgaagctactaaacgacttgtcaaacaacaagtccatcgacgaagtgaccataaatcaactattcaagaatatcgtcgacagcacaaacaagtatatgcctctctacgaaatcaaaaatctcaacgaggtggtagagaagttcaacaacctcgagttcaacgacaagaagaaaacaataacagacttcctccttgcaacacacgccaaccccacaatgagcaacctcaaaaacataggactgccatactttggccgcttcatacgcaacacaggcatcaaactctcggaaaacgccaacgtaatctaccaatcccctacgggccttttctcccggaaaatcaaaatatcggacttctga

SEQ ID NO: 6421 - RNA, 3993 nt, synthetic construct
  misc_feature 1..3993: note = Cas9 variant
  source 1..3993: mol_type = other RNA
atgaaaaacgactacactataggcctcgacataggaaccaattcggtcggctattctgtcgttaccgacgactacaaagtaatctctaagaaaatgaacgtcttcggaaacactgagaagaaatccatcaagaaaaacttctggggagttcgactatttgaatcagggcaaacagcccaagaagcacgcatgaaaagaacaagccgccgtcggatcgcacgcagaaagaataggatatgctatctacaagaaatcttccaaccagaaatgaaccacctggacaacaacttcttctaccgcctcaacgagtcgttcctcgtcgcggacgacgcgaagtacgacaaacaccctatattcggcaccctagacgaggaaatacacttccacgaacagttcccaaccatctaccacttgcgcaagtacctcgccgatggcgacgagaaagccgacctacgtctagtatacctagccatagcccacatcataaaattccgaggcaacttcctgatcgagggcgagctgaacaccgagaataactctgtcatagaactaagcaaagtattcgtccagctatacaaccaaaccctatccgaactcgagggcttccagttcattgacgaaagtatagacttctcagaagtcttgacccagcaactctccaaaagcgaacgcgcagataacgttctaaaactcttcccagacgagaaaggtacaggcatcttcgcccaattcattaagctcatcgtcggcaatcagggcaacttcaaaaaggtcttccagcttgaagaggaccaaaaactccagcttagcaccgacgactacgaggaaaacattgaaaacctactagccatcatcggagatgaatacggcgacatcttcgtcgccgcacaaaatctataccaggcaatactcctggccggaatactgaccagcacagagaaaacccgcgctaaactcagtgccagcatgatccagcgctacgaggaacacgccaaggacctaaaactactcaaacgcttcgtgaaggaacacatcccagataaatacgccgaaatcttcaatgacgccacaaagaacgggtacgcaggatatatcgacgggaagacaaaagaggaggagttctacaaatacctcaaaaccaccctagtccaaaaatctggttaccaatacttcatcgagaaaatcgaacaggaaaacttcctccgcaagcaacgtatatacgacaatggcgtcatcccccatcaagtacacgcagaggaactccgagccatacttcgtaaacaggagaaatactactcattcctcaaagagaaccatgagaaaatagaacaaatctttaaggtgcgtataccctattacgtggggccgctcgccaaacacaacgaacagtccagattcgcctggaacatccgaaaaagcgacgaacctatccgcccgtggaatatgaatgacgtcgtcgatgaaaacgcctcagccgtagcctttatagaacgaatgacaattaaagacatatacctaaacgaaaacgtgctgccgcgccactcactcatctacgaaaaattcacggtcttcaacgaactaacgaaggtactatacgcggacgaccgaggcgtgttccagcgattctcagccgaggaaaaagaagacatcttcgaaaaactattcaaatccgaacgcaaagtcaccaagaagaaactagagaactacctccgaatcgaactatcgatatcgagtccctcggtcaaagggatagaggagcagttcaatgccaacttcggcacatacctggatctgaagaaattcgacgagctccacccctaccttgacgacgagaaataccaggacaccctcgaagaagtgataaaggtactcaccgtctttgaggaccgatccatgatccaaaaccagctcgaacaactccccctcaatctgagcaccaaaaccattaaagccctcagccggaggaagtacaccggatggggccgcctttcagcccgcctaatcgacggcatacacgacaagaacagcggcaaaacaatcctggactacctcatcgaggacgaaagcgactcctacatcgtcaacagaaatttcatgcaactcattaatgacgaccaccttagctttaagaagataatagaagactcccagccctacaaagagcagcaatccgcggaagaaatagtctcagaactcagtggatccccggccatcaagaaaggcatcctgcagtccctaaaaatcgtcgacgagctcgtagccatcatggggtataaaccaaagaacatagtcgtcgaaatggcccgggaaaaccaaacaaccggtcgaggcaaacaaaacagcaaaccccgccttaaaggaatcgaaaacggcctaaaagagttctccgactcagtactcaagggcagcagcatcgacaacaaacaacttcaaaacgatcgactctacctttactatctccaaaatggaaaagacatgtacaccggccacgaactcgacatcgaccacctcagcacctacgacatagaccacatcatcccacaatccttcctcaccgacaactcaatcgacaaccgggtgctgacaacttcgaaatctaacagaggaaagtcagataacgtcccatcggaggaagtagtgcgaaaaatggatcgtttctggcggaaactcctcaacgctaaactaatctccgaaagaaagtacacaaatctcacaaagaaagaactcacggagtcggacaaagcgggtttcctaaaacgtcaattagtagagacacgacaaatcaccaaacatgtggccaccatacttgactcaaagttcaacgaagacagtaacaaccgtgacgtacaaatcatcaccctcaagagcgccctcgtaagtgagttccgcaaaaccttcaacctgtacaaggtccgggaaatcaacgacctacaccacgcccacgacgcgtacctcaatgcggtagtagcactaagcctcctacgcgtctatccgcaactaaagccagagttcgtgtacggcgaatacggaaagaactcaatccacgaccaaaacaaagcaaccatcaagaagcaattctactcaaacatcacccgctactttgcgtcaaaagattacataattaacgatgacggcgaaatcctatggaacaaacaagaaacaatagcccaagttatcaagaccctaggcatgcaccaagttaacgtagtcaaaaaggtagaaatccaaaaagggggatttagcaaggaatccatccaacccaaaggagaaagccaaaaactgattcgtcggaaacaacaatggaacacaaagaaatacgggggatttgactcacccgtcgttgcctacgccatcctcctcagcttcgacaagggcaagagaaaggcgcgcagcttcaaaatcgtcggcataacaatacaggaccgcgagagctttgaaggtaacccgatcctatacctaagcaagaaagactaccataacccgaaagtagaagcaatcctccccaaatactccttgttcgaatttgaaaacggtcgccgcagaatggttgccagcgcaagcgagacacaaaagggaaaccaactaatcatacccggacacctcatggaacttctataccacagcaagaaaatcatcaacgggaaaaactcagactcagtctcctatatacaaaataataaggaaaagttccgtgagatattcgagtatatcgtggatttcagcagtaaatacatcagcgcagacgcgaacctaaacaaaatcgagaaaatcttcgaaaacaacttccacaaagcaagtgagcaggaaatagccaaatccttcataaatctcctcaccttcaccgcgatgggcgcccccgccgacttcgagttcttcggagagaaaatcccacggaaaaggtacgtgagcatctcggaaataatcgacgctgtctttatacaccaatccatcacaggcctctacgaaacgcgcgtcagactcaccgaagtatga

SEQ ID NO: 6422 - RNA, 3993 nt, synthetic construct
  misc_feature 1..3993: note = Cas9 variant
  source 1..3993: mol_type = other RNA
atggaaaaagagtacacgataggactcgacatcgggactaactcggtcggctgggccgtactaaccgacgactatcgcctcgtcgcccgtaaaatgtctatacagggcgatagcaatcggaaaaagataaaaaaaaacttttggggggcccgactctttgaagagggcaaaacagcccaattccgaaggatcaagcgaacaaaccgccgtcggatcgcaagacgacgtcagcgagtcctagccctgcaagacatattcgccgaagaaatccacaaaaaagaccctaacttcttcgctcgactcgaagaaggcgaccgagtggaggccgacaaacgtttcgctaaatttcccgtgttcgccacactcagcgaggaaaaaaactaccaccgccagtaccccacaatctatcacttacgccacgacctagcgaattcaaaagaacaagccgacataagactcgtatatctcgccattgcacattgcctcaaatatcgaggccacttcctcttcgaaggcgaactcgacacggaaaacaccagcgtcaccgagaactaccaacaattcctgcaagcataccaacagttcttcccagagccaataggagacctagatgacgcagtaccaatcctcacagaaaggctatccaaagcgaaacgcgtagaaaaggtcctcgcttattacccgtcagaaaaatcgaccgggaatttcgcacagttccttaaactcatggtcggcaaccaggcgaacttcaaaaagacgttcgacttggaggaagaaatgaaactgaatttcaccagagactgctacgaggaagacctcaacgaactcctcgaaaagacaagcgacgattatgccgagctatttctcaaagccaaaggcgtctacgacgcgatcctcctctcccagatactgagcaagtccgacgacgaaaccaaagctaaactaagtgctaacatgaaactacgtttcgaggagcaccaacgcgacctcaaacaactcaaagaactggtacgcagggacctaccgaaaaaatacgacgacttcttcaaaaatcgatcgaaaaacggctatgccggctacgtaaaaggcaaagccacacaggaagacttctacaaattccttcgcaccgaacttgctggccttgaagagtcacagagcataatggagaagatcgacctggagatatatttgctcaaacaacgcaccttcgccaacggagtcataccccatcagatccatctagtcgaaatgagagaaataatggaccgccaaaaacgattctacccattcctcaaaggcgcacaggggaagatagaaaagcttctcacgttccgcatcccttattacgtgggcccactcgcccaagagggacagtcccccttcgcctggataaaacgaaagtcgccctcacaaatcaccccgtggaatttcgccgaggtcgtcgacaaggaaaactcagccatcgaattcatagaacgaatgaccaaccaggatacctacctgcccaaggaaaaagtactccctaagcaaagcctaatctaccagcgctttatgatcttcaacgaactcactaaagtatcgtatacagacgagcgcggcaaatcccactacttttcaagcgaacagaagagaaagatatttaacgaactcttcaaacagcaccctcgcgtaaccgagaaacaactccgcaaattcctagagctgaacgaacaaatcgactctaccgaaatcaagggcatagaaacaagcttcaacgcatcatactccacataccatgaccttctcaagctatctgatcaaatggatacgctactagacgaccccgacatgaccacgatgttcgaagaaataatcaaaatcctcacaatctttgaagaccgagaaatgatacgcgaacaactcaagccctacgaaaccgtacttggcctaccggccataaaaaagcttgcaaagaagcactacacaggatggggacgcctcagcgaaaagatgattcaagggatgcgcgaaaagcagagcaggaaaacgatcctagactacctcattgatgacgacgactttccctgtaaccgcaaccgcaacttcatgcagctgataaacgacgaccacctcagtttcaaagaaaccatcgccaacgaactcatcatgtccgactccaacgtcctacttgaccaagtcaaggccattccaggctcgccagcagtaaaaaaaggcatctggcaatccatcaagattgtggaagaaatcataggtataataggcaaagcaccaaagaacatcgtcatagaaatggcccgagagaaccagcgcacgagccggagccgaccacgacttaaggccctagaagaggccttaaaaaatatagattccccccttctcaaagactacccgaccgacaatcaggctctacagaaagaccgactctacctctactacctacagaacggcaaagacatgtacacaggtgaaccactcgaaatccaccgtctctcggaatacgacatcgaccacatcatcccccgaagcttcatcgtcgataactcactcgacaacaaagtcctcgtaagttcgaaggtcaacaggggaaagctcgacaacgcgcccgaccccctcgtcgtcaaacgaatgcgatcccactgggaaaaactacatcaagcaaaactcatatccgacaagaagctggcaaacctcactaaacagaacctcaccgaggccgacaaagcccggttcatccagcgccaacttgtcgaaactcgacaaattacaaaacacgtcgccaatcttctacaccaacacttcaacctgcctgaagaagtctcggccaccgaaaagacatcaataataaccctcaagagcacgctaacctcccaattccgacaaatgtttgacatttataaggtacgagaaatcaaccatcaccaccacgcgcacgacgcttacctcaacggcgtcgtagctatgaccctactaaaaaagtaccccaaactggcacccgaatttgtatacggatcgtatataaagggggacatcaaccagataaacaaagccacagccaagaaggaattctattccaatatcatgaaatttttcgagtccgaagagatcatctgcgacgaacaaggcgaagtcatctggaacaaaaagcgcgacctgtcgacaataaaaaagaccatcggcgcacatcaggtaaacatcgtcaaaaaagtcgaaaaacaaaagggaggcttctacaaagaaaccatcaactccaaagccaaccccgaaaaacttatcccaaggaaagcttccctcgacccccttaagtacggaggttacgggagcccccttgtcgcatacacggtaatatttatattcgagaaaggaaagcagaaaaaagtcacaaagggcatcgaagggatcacggtcatggaacaactccgtttcgagcaggacccccgcgagtttctaaagaccaaaggctacgaaggcgtcaaacaatggctcatactcccaaagtacatactcttcgaagcccagggcggataccgacggatgatagcctcccaccaggaaacacaaaaggccaactcgctcatcttacccgagaacctggttaccctactctaccatgccagacactacgatgagatcaatcataaagtctcattcgactacgttaacgcgcacaaggaaggattcaacgacatatttgacttcatatccgactttggagtccggtacatccttgcgccccaacacctggaaaaaatcaaggtcgcgtacgaaaaaaacaaagaggtcgacctcaaagaaatgattgacgcgatactgagcctcttgaagttcacgttattcggagcctccgtcgagtttaagttcttcgacataaagatcctcaaacggtacaaatccctcacggacatctgggaggccacaataatctaccagtcagtaaccggcctgtacgagcgacgagtagaggtgaggaaactatgggacggcgagcgcctgtga

SEQ ID NO: 6423 - RNA, 3996 nt, synthetic construct
  misc_feature 1..3996: note = Cas9 variant
  source 1..3996: mol_type = other RNA
atgaacaagcaaccatacaacatcgggcttgacatcggcacctcctccgtaggttggtccgcaaccgaactcgacaaccgcttactccacatcaaggggcacaacggaataggcgtacgtcttttcaaagaaggagaaagcgccgcagacaggaggggcttccggacaacaagacgccgcctcgcccgacgaaaatggaggcttaggctactcaacgagatattcgcaacagaaatagccaaagttgacccatcctttttcgcccgcctcaaacagtcaaatgtgtcccccaaggaccccaacaagacaatgttcgaaaacatcctcttcgacgacgagaacctcgacgaccaaaaattccatcacgactacaaaaccatatatcaccttagacaagcaataataaaccaccccgagcaaaaattcgacatacggctgatctatctagccatgcaccacattatcaaataccggggccacttccttaaccaagccaacgtacaggactttaagggcgggaagatcgacctggaaaaatccttcaaagctctaaacgacatatttgaaaaccaaggcagggacctgcgcctagtcacagacaaagcaaaccagtacgtcaaagtactatccgacaacgccaagacccgatccgaccgtaaaaaggagctctcaaagctcctatatgtccccatcgacaaagacaccgacaaaaactccaaaaaggtcaccggggaaatcctcaaggccatccttggcaacaaagcaaaattcgacgtgatcttcggaatcgaagtcgagaatccgaaagaatgggtgctaacctttaactccgacgacttcgacgacaaaatagaaggccttagctcacagatgaccgacgaagactcggagatcctgcttatactgaaggaactctattttgcacttaacctcagcgatatcctcaacaactcagtaaccgataagaacgccaagaccctatccgaagcaatgatcaatcgatacgacgaccacaaaaaccagctcgctatgctaaagaaggtcatcgactcgtccgacaaaaagcacgccaaggagctcaaggaggcatactcagcctacatcgatggcgaaaataacaagaaaatctccttcgaagacttaaagaaacgaatccagaaaaacctagtcgatagcgagctctcccagaaaatcaacgacctcctcgaccacgactacttccttccgaagcaacgctcaaaagaaaatggcgccatcccccaccaactacaacaacaagaactagaccaaattatagagagtcaaaaacaatactacccattcctggccgagctcaacccaaatgaaaaacgcagcaggcaagcaaaatacaaactagacgagctagtagcctttcgcgtaccatactacgtcggcccaatggtcgaagtaaccgactcaaaccaagaaaacaacggtaagtttgcatggatgattcgcaaagaacaaggcgagatcacgccctggaactttgacgaaaaagtcgaccgaaccgaaacagccaccaaatttatcacgcgcatgactaccaccgacacgtacctaataggggaaccggtcctacccaaaaactccctcctctaccagaagttcgtagtactaaacgaactcaacaatctaaaaattaaccaggagataataaccccaggccagaaacagtacctctacgaacacgtcatgaagaaaaataaacgcgtaacccttaagaaaatagcagacgcactggtaatcaaaggggactacccctacgcgcccgaagtcaaagggaccaccgaccagaaaaacctgaacaacggactcaccacgtacatcgacctcgccaaaattttcggcaacgaattagatgatgtagacagggaagctgacttcgagaagatcatagaatggtccaccatattcgaagaccaacatatattcgcccttaaactgcaagagctcaaatggctcaccgaaaaacaaaggaaccaggtcgtaaaactaaggtaccagggttgggggaagttatccaaagaactcctcgccggcctggtcgacgacaacggacagcgaatcatcgacctcctctggagcgacaaccaaaacttcatgcaaatcgtcaaccaaaagagcttcaaagagtccatcgccgatcacaacggggcgcacttggaagaaaagaacctcaaagacgtcatcaatgatctatacacctcaccccagaacaagaaagcgatacgccaggtgatcctcgtcgtagacgacatcatcaacgcagtcggctacgaaccggccaacataatgatggagttcgcacgggaggactcgaatgaccatcgcctgactaactcccgctcccgccagctcgagaacgtctacaaagacatcacgaactcatggttcgacaacgacagcgtgaaagacgagctggaagacaaaatcaaaaacaaagacaaatttaccgaccgcctttacctttacttcacccaaggagggaaagacctctacacaggggaacccctaaacattgacgatctcagctcctacgacattgaccacatcctacctcagtcattcattcttgataacagcctcgacaaccgagtgttaacatcccaacgcaacaaccgcgtttctaaagaagaccaactaccgggggaactcttcggcaccaagatgcacgccttctggaaacgtcttaaagccgcccacctaatctcaaacaagaaatactacaacctaacccttacccccaactccatttccaaattcaacaaccaaggcaggttcatcaaccgacaactcgtggagacacggcaagttataaaactggcagcagaaatactacacaaccgctactctgaggagaaaggtacaaacatagtgactataaaggcaaacctaacccaccacatgagagagaagttcaacttttacaagaatagaaacgtcaacgactaccaccacgcatttgatgcctaccttacagcattcgtgggcaactggctattacaacaataccccaaactcaaaccttacttcgtctacggcgacttcgccaaaaccgaaataaacaatctaaagtccttcaatatgctctacaagttcgaacaagcacaccaactaaatgaaaaagacggcaaaatcgcgaaggacgcagacgctttactaggctacatgaagaacgtctatcacttcaaaaagatgcttgtcactaagaaactcgaaacaaaccacggcgctcttttcaaacaaaccctctatccctccccagcgcacgacatcaagaaaagacaacttattaagcccaaggacaaccggccaactgacatatacggcggctacacccacgaagaacgcaaatatatgtcgctggtgaaagtcatcggcaagaaagacaatgagtaccgcatggccaatgtccccctgctaaaaatcaacaaaaacaacgacatcaaagagatactcaaatcccagttctcaaataagaagttcgaaatcgttctgcccaaagtactcaagaaccaactcttttccgaaaacggagccctgttcgtcatagggtctaaaggctacaaatacaacgccaatcaactcgtgttgtcagacctcgacatgaaactcctcaacgacctctctaataacaaatccatcgacgaagtaacgataaaccaactattcaaaaacatagttgactccaccaacaagtacatgccactgtacgagataaagaacctcaacgaggtggtcgagaagttcaacaacctcgaatttaacgacaaaaagaaaaccatcacggacttcctacttgcaacccacgccaacccaaccatgtccaaccttaagaacatcgggctaccctcatactttggccgcttcacctccggaaatgctggcattaaattaagcgaaaacgccaacgtaatctaccagagccccaccggcttgttttcacgcaaagtcaagataagcgacttctga

SEQ ID NO: 6424 - RNA, 3999 nt, synthetic construct
  misc_feature 1..3999: note = Cas9 variant
  source 1..3999: mol_type = other RNA
atgaaaaatcgcgagaacatcaaatactatatcggcgtcgacatcggcaccaacagcgtcggttgggcagtaatcgacgagaacggcaacctcctcaagaagggaaagcaccacttatggggaagtcgactattcgatcaggcccagaccgcacaaaaccgccgtaactaccgttcttcccgccgccgatacaacaaacggcggcaacgcattgggttactgcgcctgattatgagcgacatggtgctcgaggtcgacccctcgttcttcataagactcgagaaaaccacatttctagacaaggaagacaagaaggcaatactcaaagacaactacaaaatgaactacaacctattctgcgatgaggactacaacgacaaaaagtacttcaaggactatccaacaatttaccacctccgtaaaaagctatgtgaaagcgacgagaaagccgacccgcgactaatatacttagccctccaccacattgtcaaataccgtgggaacttcctctacgaaggacaggagctgcacctcgaaccgtcaaacaaagaagaagacctaaaaatacttttcgacatcctgggaaagaataacgataccgtctacgacattagcgaagaacaaatccaattcatactgaaaaccgtggtggagaatatctcaaagactgcaaaggtggatgaatgcatgagccaactgaaactgaactcggaggacaagaaaatagtaaaagaatttatgcgaggtctagtcggcaacaaattcaacgtatcgaaactgtacatgcacgaggacttgcagttcgacgacgaggacctgaaattacagttctccgacaaaagctacgaagagaaaatcaccgaatacgaaaacgtgctcgaagagaaaatggaatttatagacctcatgcagaggttctactcctggatagaactgtccaagatcgtcgggagcgactcacagcacgcgagcatctcaggcgccatggtgaacatctacgaatcccaccgggaagacctccgtaccctaaaggaagtgatgttgaagatcgggaagaaagagtacgacgagatgttcaaacccaccagcaagaacgtcgtaaattactacaattacgtgaatccggtcgcctgtagcggtgacaaaacagacgggttctacaaatacgttaaaaaggcaatcgaaaagagcgacgactcccgaaaggacgaaatactacagaaaatagccaacgagacatacatgctaaagcaaactagcaaaaacaacgcgtatatcccctaccaaatgcaaaaagatgaactgatcaaaattctggaccatcaggaaaaatactatcccgtactcaaagaaaaccgagacaaaataatttccatattagagttccgcatcccatactactacggcccactcgacggcaacaaacaattcggctggctgatcaagaagaaaggaaaagaaaacgaaagaatactaccatggaaccaccaagagattgtcgacgtacaagagaccgccgcccaattcatcaagaaactcacgaactactgcacctatctcccgatagaaaaagtcatgccacagaaatccctcacgtgcagtatgtacgaagttctctcagaagtaaacaaaatcaggatagacggaaagctgctgcccatcgacaccaagaaccgactaatagaggacctatttttcaaaagaaagaccgtaaaagaaaaagacctcatcaactggctcaagcaaaaccagctgacggtaggcgagataaccgggtatcagaaagagaaggctttctctagctccctagcgccgtggatagactttaaagaaatatttgacgaaatcaacgactccaactacgacctcatcgaaaagatcatagaggatatgactatattcaacgagggatcaatactcaaagagagacttaagaaagcctacaacctagaccagaacaaagtcaagaaaataatgaaactaaaatactccggatggtcacgcctctcgaaaaagctaataaacggaatccgcgcagacaacaagtttggctcctccgtctccatcctggacgtcatgaaggaatcgcacatggctctaatggagatcatcaacgaccaagacctcggattcaaacagatcattgaaaaagagaacttcaaaaacgaaaccggatcgtttgagtacgaagacatcgagaacctagccggctcccccgcccttaagcggggaatatggcagacactgcaagtcatagaagagatcaaaaactacatgggccacgaacccaaaaatatatacatagagttcgcccgagaggaacaagaaaaagtaagaacaaccacacgggtaaagaaactcaaatccatatacaacgacatcaaaaaccagctagacgtccacggcaaagaggtctacagtaacctcaacaaacaagatgagaaatcatcaatagagaaacgcctctatctgtattatacccaactaggtaaatgcatgtactcaggcgaaagcctggacattgacaaactatccaattacgaaatcgaccacatcttccctcgaacactcacatcagacgactcgctcgacaacctagtcctggtcaaaaagaaagagaaccagcgcaaactagacgacctcgtgctgccactcgaaatacggaacaaaatggaggtcttctggaagaaactgtacgacaacggactcatcacgcaaaccaaatactaccggctaatgcgcgacgagttccgccgcgaccaaatcgacaaattcataaaccgccagctagtggagaccagacaaataatcaaacacgtcgcgaacatcatcgagaatcactacgaagatacaaaagtcttcactgtgcgagcaaacctatcgcacgagttccgagaaaaatacggcatctacaaaaaccggaatgttaacgacttccatcacgcccacgatgcctatatcgcatgcataatcggccggtacatacaaatcaggttccccggcctcgaggccaagtacgtatatgggcaatacatgcaaaatgtgaagaaaacgaaaaataacatagacaaggaaaaccacggcttcatcatcaatagtatgaagtatgaatgcatcgacgaagacacaggagaggtcatatggaaccccgaaagaatacttgactatatcaaatgcttcaactacagagacgtttatattaccaagaaactcgacaccaacaaccgagaacttttcaacgtcaccatcctcccaaacgacaaaaactccgagaagggtaaaacgaaagcaacaatacccgtcaacaagctacgatctaacgtaagaaagtacggcggcttctccgggctacaatccgatattgtggccatcgagggcaagaaaggcaagaaaatcgaccgccgtctaatcaacctgcccatacttcttcgctacgtgtcgattgaagaccaatgtaaatacatcatggagaacaacaaatactccgacgtaaaaataattaaaaagataaagaagaaccaactaatagaaatcgatggaatatgctactacctaaaaagcgcagacgaactagacaccgcataccagttaatcctcagtagagacgacaacgaaatgatctacaggattgaccgagcgatacagaacaacgacttttcatacttcgacaacaagaaagagaacatagacgagctgtaccggctgatttgccataaaatgatagagaactacccgaaatacaaaaagaaagtatacgagttcataaaagaaagggaagaggagtttttcgaactggacaactcccaaaagtgcatagtcatcttcgaaatgatacgcgtaatgaagcgtggcgagcaatacataaacatcccgttcgagccgtacaacctaaagaacgaccgtaagggacgactaaactgccaaagtatcctcttagacaacacatacttctacgacgtctccataacaggaatatactcgaagaagtacaaattatga

SEQ ID NO: 6425 - RNA, 3999 nt, synthetic construct
  misc_feature 1..3999: note = Cas9 variant
  source 1..3999: mol_type = other RNA
atgcagaaaaactacaccataggactcgacatagggaccaattcggtggggtgggcagtaatgaaagacgactacaccctcatcaggaaaagaatgaaggtactcggcaacacggacatcaagaagataaagaaaaacttttggggcgtaagactctttgacgagggcgagaccgcgaaagaaacccgcctaaaacgcggcaccaggagacgataccagcgccgacgaaaccgactcatatacctccaagacatattccagcaacccatgctcgccatcgacgagaactttttccaccgactggacgactcatttttcgtacccgacgacaaatcgtacgacaggcaccccatattcggatccctagaagaagaggtagcgtaccacaacacttacccaaccatataccacctacgcaagcacctcgctgacaaccccgaaaaagctgacctccggcttgtctataccgctctggcacacatcgtaaaatacagaggccacttcctaatagaaggcgaactcaacacggagaacacgagcatctcggagacatttgaacaattcctggacacttactccgacattttcaaagaacaactggtaggcgacatttcaaaagtagaagagatcctgtcctccaagcaatccaggtcccgcaaacacgaacaaatcatggcactattcccaaacgaaaacaagctaggcaacttcggaagattcatgatgcttatcgtgggcaacaccagcaacttcaagcccgtcttcgatctggatgacgagtacaaacttaagctcagcgacgaaacctacgaggaagacctagataccctactgggaatgaccgatgatgtcttcctagacgtcttcatggccgcaaagaacgtttatgacgccgtagagatgagcgccatcatctccaccgacaccggcaactcaaaggccgtcctctcgaaccagatgataaacttttacgacgaacacaaagtagacctagcgcagcttaagcaattcttcaaaacgcacctacccgacaagtactatgaatgcttttcagacccctccaagaacggatacgccggttatatcgacggaaaaacaaaccaagaagacttttacaagtacatagaaaaagtcatgaagaccatcaagagcgataagaaggattacttcctggataaaatcgatcgcgaagtctttctccggaagcaacgaagtttctacaacagcgtcataccccaccaaatccatctgcaagaaatgcaggcaatactcgaccggcaatcccaatactaccctttcctcgcggaaaaccgagacaaaatcgaatctctagtaaccttccgaataccgtactacgtagggcctctaacagtaagcgaccaaagcgagttcgcatggatggaacgtcaaagcgacgaaccgatacgtccctggaacttcgatgaaatcgtcaacaaagaacggtcggccgaaaagtttatcgaaaggatgaccaacatggacacctacttactcgaagaaaaagtcctgcccaagcgaagcctcctatatcagacatttgaggtgtacaacgagctcaccaaagtaagatacacaaacgagcaaggcaaaacggaaaaattaaaccgccaacaaaaagccgaaataatcgaaacactattcaagcaaaagaatcgggtacgcgagaaagacatcgccaactacctggaacaatacggatacgtcgacggtacggacatcaaaggcgtagaagacaaatttaacgcatcactcagcacgtacaacgacctagcaaagatcgacggtgcaaaggcttacctcgatgatcctgagtacgctgatgtctgggaagatatcatcaaaatcctaaccatcttcgaggacaaagcaatgcgaaagaaacaactacagacttactccgacaccctgtcaccagagatcctcaaaaagctagaacggaagcactacacaggctggggaagattctccaagaagctcataaacggtctgcgagacgagggctcaaacaaaacgatcctcgactacttaaaatccgatgaggggtcatccggcccaacaaaccggaacttcatgcaacttattagggacaacaccctcagcttcaagaagaaaatcgaagacgctcagaccatcgaagacaccacccacatctacgacaccgtcgcggagctaccaggaagcccggccatcaagaaaggtatccgccaggctcttaaaattgtcgaagagatcatcgacatcataggatacgagcccgagaatatagtggtggaaatggctagggaatcccaaacaacgaagaaaggcaaagacctatcaaaagaacgtctcgaaaaactcacggaggccatcaaagagttcgacggcccaagcgacgtcaaagtgaaagacctgaaaaacgagaacctaaggaatgaccggctatacctatactacctacaaaatggaagagacatgtacacaaacgagcccctagacataaataacctgagcaaatacgacatcgaccacataataccacagagcttcaccacagataacagcatagacaacaaagtcctcgtctcacgcaccaaaaaccaaggtaacaaaagcgacgacgtccccagcatcaacattgtccacaaaatgaaaccattctggagacagcttcacaaagccggcttaattagtgaccggaaattcaagaacctcacaaaggcggaacacgggggcctgaccgaagcagacagggcacacttcctgaacagacaactcgtagagacccggcaaatcaccaaacacgtcgcgaacctgctcgacagtcaatacaacaccgcagaagaacaacgcataaatatagtcctcctaaaatcatccatgaccagccgtttcagaaaagagttcaagctatacaaagtacgcgaaataaacgactaccatcacggccacgacgcctacctgaacgcagtcgtagcaacaacaattatgaaagtctacccgaaccttaaaccccaattcgtatacgggcagtacaaaaagacaagcatgttcaaggaggaaaaagccaccgctcgaaagcatttttactctaacatcaccaagttcttcaagaaagaaaaagtcgtaaacgaggaaacaggagaaatcctctgggataccgaaaggcacctctccaccattaaacgggtactatcctggaaacagatgaatatcgtaaagaaagtcgaaaaacaaaaaggccaactctggaaggaaaccatctacccgaagggggactcttcgaaactcatcccggtcaaagaagggatggacccccaaaaatacgggggactgagccaagtaagcgaagccttcgcggtcgttataacccacgaaaaaggaaagaagaaacaactcaaatccgacctcatctcgatcccaattgtcgatcaaaaagcctatgaacagcatcccacagcgtacctcgaagaagcagggtacaacaatccaacagtcctccatgagctgttcaagtaccaactattcgaactcgaggacggctcccgacgaatgatagcatccgctaaagagttccaaaaaggcaaccaaatggtcctacccctggaacttgtggagctactataccatgcgaaccgatacgataaagtgaaattcccggactcaatagagtacgtacacgacaacctagcgaagttcgacgacctgctcgaatacgtcatagacttctcaaacaagtacataaacgccgacaagaacgtccaaaagatccaaaagatatacaaagaacacggcacagaagacgtcgagttaacagtcgagagcttcgtcaatctaatgacattcacggcgatgggcgcccccgctaccttcaaattctacggcgaaagcataacccgctcgcgatacacgagcataaccgaatttcgaggatccacactcatcttccaatccatcacgggcctatacgaaaccaggtataaactggaagacaactga

SEQ ID NO: 6426 - RNA, 3999 nt, synthetic construct
  misc_feature 1..3999: note = Cas9 variant
  source 1..3999: mol_type = other RNA
atgatgaaggaatacagcattggccttgacatcggatcaagtagcgtagggttcgtcgcggtagacgatcaataccgggtggtacgagccaaaggcaaaaacgtgatcggcacgcgacttttcgacgagggaaaaaccgcagccgatcgccgcggccttcgcaccacacgccgacgcctctcacgcaggaaatggcgcctccggctgctacgaggcatctttgaaccccacataaacgaaatcgacgagagcttcttcatgaggttaaaagaatcaaatatctcccccaaagacagcaacaaacacttccctggagacatactgttcaacgaccgctccgacagagagttctatgaaaattacccaacaatataccacttgcgtcaagccctcaaaaccgaaaagcgccaattcgatattcgcgaaatatacctcgccatgcaccacatcgttaagtatcgaggacacttccttgaaggagggaccgtaacagattttgaagtcggagaacttgacttggcaggtaaatttagccggctcaacgaactattcgaatccataaacctagaagtccctttcgttctcagactggacaacctcgaagatgttaaggccgtcctaatcgacagccaacgctcggcacaggaccggcaacggaccctgacaccggacatatatgtacccagcacagacaagataacagagaaaagattcaagggaatcgcgaccgaactactaaaagccattgttgggaacaaagccaaatttgacgtcctcgccggactggaactagacaaagaggaagcgaaactctgggcactcaccttcgactccgagacatttgacgaagacatagaacaactggagggcgacatgacggaagcaacacaagatctaatcgaaattctgaaatccttacgcagcctgataagactggcggtgaacatgccggagggcgtgagcctgtccgaaatgatgatacaacgatacgaggaccacgccgaccacctcaaactgctccgcgacatcatccacaacacggacgcagaaaaagccgcaggcctccaagccgcatacgatggatacatagacggagtaaaggggaagaaaacacctgttgatgacttctacaaagcgattaagaaaaacctagacgactccgaagccgcccatcaaatcctagcgctcatagacaaaaacgagttcatgccaaaacaacggtcaaaatcgaacggctggattccgcaccaaatccagcaaaaggaactcgaccgcataatcgaaaaccaaaagcagtactacccgtggctcgcggatgtcaacccaaacgaatcgaggcgcaaagtagccccgtacaaaatcgacgaactggtcacgttcagagtaccctactacgtagggccccttgtaacgtccgaggaacagaaaaagtatggaagcaaattcgcgtggatggtaagaaaggaagagaaaggcgagatcaccccatggaacttcgaccaaaaagtcgaccgcgccgccagcgccacggagttcatcaaccgaatgaccacgatggacacctatcttctcaacgaagacgtcctccccgcccactcactgatataccagaaatatgaagtattgaacgagctcaataaagtcaagataaacggcgatgccataacgccagaactaaaacagaaaatataccacgacctcttcgaaaagcaaacgaccgtctccatcaaaaacctacaaacctacctcgtctcagagtccgaggcatcagaagtcccggaaataaaagggcttgctgacgaaaagaaattcctaagcggactgaccacataccacgacctgatgaaaatattcgaccgaaacgtcgttaacgaccccgagagagccgaagacttcgagaaaataatacggtggtcgaccgtattcgaagacaagcacatttacagagagaagctcgactccctcagctggctcacaacagaccaaaaagaccgcctagccgtaaaacgctaccgcggctgggggcgactcagcgaaaaactgctcatagggctacgcgacgaaggacacagaagcataatggactacctatgggaaaccacgtcgaatttcatgcaaatacaagcccagaacgacttcagcgagaaaatagcagcagaaaataaagagttcctcgacaacacccaaagcgtgcagggaattatcaacgaactatacacgtcaccgcaaaacaaaaaggcgatacggcaaacactgctagtggtggaagacatcaagaaagcattccacggcgaagcaccaaagaggatctttgtcgagttcgcgcgcgaaaatgagagtactccacagagatcaatacaacgccaacgacaggtcgagaacgcatacgagaaagtcacccaaaacctactggtggacgataaaatccgcgcggagctcaaggactcgatcaacgaaaaacgcttattccacgaccgactgttcctctacttcatgcagggaggcatagacatgtactccggtaagaaaatcaatatagacaacctcagcgcatacgacatagaccatatactcccccagtccttcaccgtcgacaactccctagacaaccgagtcctcacaaaccagaaagacaaccgagagaaaggaaactcgctaccctccgagctctaccggggatcaatgaaagaaacttgggaaatgatgcgaaatcaaggcctcctatccaaaggcaaattccaccggctcatgatgacaccaaactccatgacagcatacgaccaacaagggttcattaacaggcagctagttgagaccaggcaagtaatcaaactcgccgtcgaaatactcgcttcagagttcgaccaagcagacgaaaaagtcgaaatcgtcagcgtcaaagcaggcctcacacaccaaatgcgccaagacttctcgctaatcaaaaatcgcgatgtaaacgactaccaccacgcattcgacgcgtacctaacagcgttcgtcggaacctatctattaaagaggtacccaaagctacgcccatatttcgtatacggcgagttcaagaaattcagccaaaaacaagcgaacctcacaaacttcaacttcttgtgggccctcaaacacaaggaccaagtcgccgtcgaagacacaggagagaaaatatggaacaaaccacaagacctcgcgtacataaggcatctcttcgccttcaagaaaatcctcatctcccgcgaagtaagcgaacgccacggagccttgttcgaccaaacactatacaaagcgtccgacgacaaagctagtggacaaggctccaaaaagctaatacccgcaaaggacaacagacccacagaactatacggaggctactccggccaaacaagcgccttcatggccattgtaaaagtcacaaaaggtaagaaaacgaaatacctcgtagtcggtgtacctacagccgccatatcacaactacaaggcatggacgtcaaaagtagccaatacacggagaaaatatacaacatcctatctccaaaactgctcagcaagaacgacgacttcgaagtaatcgtaccgaaggttcgataccgtcaactaatcctagacaacaaccagctattcacactaggttcagacacctacaaatacaacgcccgacaactcgttctaagcaatgaagtcttagcagtaatcaatcgcgacaagtccttcatagacaaaaagctaagcgaagaagctgaaaaccaggccctcaacgacgccttcgacgaaatagtagtcgccatggacaaacacttcgatttatacgacaaaaacggattcagagaaaaggtaaaagccggcaagcagcgcttcgaagaattacccgtttctctattttccgaagacaaagaaaacgaaggtataaccaaaagaaccgtcctcaaacgcattctacaaggccttcacgcaaacgcaacaaccagtgaccttaaggtcctcgacggcaaattctacaattga

SEQ ID NO: 6427 - RNA, 4002 nt, synthetic construct
  misc_feature 1..4002: note = Cas9 variant
  source 1..4002: mol_type = other RNA
atgaaaaactacactattggcctggatatcggggtcgcaagtgtaggctgggtttgcatcgatgagaattacaagatacttaactacaacaataggcacgccttcggcgtccacgagttcgagtccgcagagtcagcagccggacggcgtctcaagcgcggcatgcgccggcggtacaacagacgaaagaaacgcctccaacttctacagagcctcttcgactcctacatcacggactcagggttcttcagcaaaaccgacagccaacatttctggaaaaacaacaatgagttcgagaatcgctccctaaccgaagtactgtcctcccttcgaataagctcccgcaaataccctacaatataccatctccgctccgacctgatcgagagcaacaaaaagatggacttacggctcgtatacctcgccctacacaacctggtaaaataccggggacacttccttcaagaggggaactggagtgaagccgcctccgccgagggaatggacgatcagctgctcgagctagtcaccagatacgcagaactagaaaacttgtcgcccctcgacctatccgaatcgcaatggaaagccgccgaaacgctgctactcaaccgaaacctaacgaagacagaccaaagcaaagaactgacagcaatgtttgggaaagaatacgaaccattttgcaaactggttgcgggcctgggcgtctcactacaccagctttttccatcctcagaacaagcccttgcatacaaagaaaccaagaccaaagtacaactctcgaacgaaaacgtcgaagaagtgatggagctactactcgaagaggagagcgccttgctcgaggcagtgcagccattctaccaacaagtcgtactctacgaactactaaagggcgagacgtatgtagctaaagccaaagtctcagcattcaaacagtaccaaaaagacatggcgtcactaaagaacctcctagacaaaacattcggagagaaagtatatagaagctacttcatctccgataagaacagccaacgcgaataccagaaaagtcacaaagtggaagtcctatgcaagctcgaccaattcaacaaagaagccaagttcgccgaaaccttctacaaagacctcaagaaattgctggaggataagtcgaagacaagcatcggcaccacagaaaaagacgagatgctgagaatcatcaaagccatagacagcaaccaattcctccaaaaacaaaaaggtatacaaaacgccgcaatcccgcaccaaaactcgctatatgaggccgagaaaatactacgcaaccaacaggctcattaccccttcatcaccaccgaatggatcgaaaaagtaaaacagatcctcgccttccgcatcccgtactacatcggccctctcgtcaaagacaccacacagtccccgttctcatgggtcgaacgcaaaggggacgcgcccatcaccccttggaacttcgacgaacaaatcgacaaggccgcctccgcagaagcgttcatttcaagaatgcgcaaaacttgcacctacctgaaaggtcaggaggtattacctaaatcatccctgacttacgaacgctttgaagtgctaaacgagcttaatgggatacaactacgaaccaccggggcagaatcagacttccgacaccgactcagctacgaaatgaaatgctggataatagacaacgtcttcaagcaatacaagacagtatcaacgaagcggctcctgcaagagttaaagaaaagcccctacgcagacgaactctacgacgaacacaccggcgagatcaaagaggtgtttggcacccaaaaagaaaacgcattcgccacatccctctcagggtacatcagcatgaagtcaatactaggggcagtcgtcgacgacaatccggccatgaccgaggaactaatctactggatcgctgtcttcgaggacagggaaatcctacacctcaagatccaggaaaagtaccctagcatcaccgacgtccaacgacaaaaattagcccttgtcaaactcccgggctggggacgattctcacggctcctcatagacggactcccactcgacgagcaggggcaatcagtgctcgaccacatggaacaatacagttccgtcttcatggaggtactgaaaaacaagggcttcggcctggaaaagaaaatccagaaaatgaaccagcatcaggtcgacggaaccaagaaaatacgatacgaggacatagaagaactggccggaagccccgcactgaaaagaggtatatggcgcagcgtaaaaatcgtcgaggaactcgtcagcatattcggagagccagcaaatatagtactcgaagttgcccgagaggatggagagaagaaacgaacaaaatcccgaaaagaccaatgggaggaactaacaaaaacgacactcaaaaacgacccagacctcaaatcattcataggagaaatcaaaagccaaggcgaccagcgcttcaatgaacagcgcttctggctctatgttacacaacaaggcaaatgtctatacaccggcaaggcgctcgacatccaaaacctcagcatgtacgaagtggatcacatcctcccacaaaacttcgtaaaagacgacagtctcgacaatctcgccctcgtaatgcccgaggcgaaccaacgcaagaatcaagtaggccaaaacaaaatgcccctcgagatcatcgaagccaaccagcaatacgcgatgcgcacactctgggagaggctacacgagttaaagctgatttcgagtggcaagctagggcgcctcaagaaaccgtccttcgacgaagtggacaaagacaaattcatagcacggcaactcgtcgaaactcgtcagataataaagcacgtaagagacctccttgacgagaggtttagcaaatcggacatccacctggtaaaagctgggatcgtgagcaaattccgccgcttcagcgaaataccaaaaataagagattataataataaacaccacgcaatggacgctctgttcgccgcagcactcatccaatcaattctaggaaaatacggcaagaacttcctcgccttcgacctttccaagaaagacaggcaaaagcagtggcgtagcgtgaagggcagcaacaaagagttcttcctgttcaaaaacttcgggaacctacgcctacagtcacccgtcacgggtgaggaggtgagcggcgtagagtacatgaagcacgtctacttcgaactgccatggcagacgacaaaaatgacacaaaccggagatggcatgttttacaaagaatcaatattctccccaaaagtaaagcaagcaaagtatgtcagtcccaaaacggagaaattcgtacacgacgaagtcaaaaaccattccatctgcctagtagaatttaccttcatgaagaaggaaaaagaagtccaagagaccaaattcattgacctgaaagtgatcgagcaccatcagttcctaaaggagccagaaagtcaactggccaagttcctagcagaaaaagaaacaaacagtccaataatccacgcgcgaataatacgcactatcccaaaataccagaaaatctggatagaacacttcccctactacttcatctcaacaagagaattgcacaacgcacgccaattcgaaatttcctacgaactcatggaaaaggtaaagcaactgtcagaacgaagtagcgtcgaggagcttaagatcgtattcggcctcctcatcgaccaaatgaacgacaactatccaatttacaccaagtcttcaatccaagaccgagtccagaaattcgtcgatactcagctatacgatttcaagtccttcgagataggatttgaagaattaaagaaggcagtcgcggcaaacgcccagagatcagacacattcgggtcgagaataagcaagaaacctaaaccggaagaagtagcaataggatacgaaagcataacaggcctaaagtaccgaaaaccacgaagtgtagtaggcaccaaacgctga

SEQ ID NO: 6428 - RNA, 4002 nt, synthetic construct
  misc_feature 1..4002: note = Cas9 variant
  source 1..4002: mol_type = other RNA
atgtcacagaacatcgtcgattactgcataggactcgacctaggcacgggctcagttggatgggcggtcgtagacatgaaccaccgcctcatgaaaaggaacggaaaacacctctggggctcacgactcttttccaacgctgagaccgccgccaaccgccgggcctccagatccattcgccgacggtataacaaacgacgagagagaatccgactactcagagccattctccaagatatggttctcgaaaacgatccgaccttcttcataagactcgaacatacgagcttcctagatgaagaagacaaggccaactacctaggagccgactacaaagacaactacaacctatttatagacgaggacttcaacgactacacctactaccacaaataccccactatctatcacctgagaaaggcgttatgcgagtctaccgaaaaagccgatccacgtctgatctacctagcgctacaccacatcgtcaaataccggggcaacttcctctacgaaggtcaaaaattcaacatggacgcgtcgaatatcgaagatcgcctaagcgatgtattcacacaatttgcggacttcaacaatataccctacgaggacgacgaaaagaaaaacctcgagattctcgaaatactcaagaaacctctctcgaagaaggcaaaggtagatgaggtgatggccctcattgctccggaaaaagattttaaaagcgcctacaaggagctcgtcaccgggatagccggcaacaaaatgaacgtgaccaaaatgatcctatgcgaacccataaaacaaggagactccgagatcaaactcaaattctctgacagtaactacgacgaccagttttctgaagtggaaaacgacctaggcgagtacgttgagttcatcgactcgctccataacatctattcctgggtggagctccagaccataatgggcgccacgcacacgtacaacgccagcatatcagaagcaatggtcagtcggtacaacaagcaccacgaagacctacagttgcttaaaaagtgcatcaaggataatgtgcccaaaaagtattttgacatgttccggaacgacagcgaaaagctgaaaggatactataactacatcaaccacccgagcaaagcccccgtcgacgagttctacaaatacgtgaagaaatgcatcgaaaaagtggacacacccgaagcaaaacaaatcctccacgacatagaactcgaaaacttcctcctcaagcaaaactctcgaaccaacggaagcgtcccctaccaaatgcaactcgacgagatgatcaaaataatagacaaccaagccaagtactacccagtgctaaaggaaaaacgcgaacaactcctatcgatcctaacatttaagataccctactacttcggccccctaaacgaaaccagcgaacacgcatggataaaaaggttagagggcaaggagaaccaacgtatcctcccctggaactatcaagacatagtagacgtcgacgcgacggcggagggcttcataaaacgcatgcggtcttactgcacctacttcccggatgaggaagttctcccaaagaactcgttaatcgtatccaaatacgaggtctacaacgaactaaacaaaattcgggtcgatgacaaactcttggaagtcgacatcaaaaacgacatatacaacgaactcttcatgaataacaaaacggtaaccgaaaagaaactgaaaaactggctagtcaacaaccagtgttgcaacaaaaacgcggagataaaaggcttccaaaaagagaaccaattcagcacttcgcttaccccgtggatagacttcaccaacatcttcggcgagatcaatcaatccaacttcgatctcatagaggacataatctacgacctcacagtgttcgaggacaagaaaatcatgaaaagacgcctcaaaaagaaatacgcactacccgacgacaaaatcaaacaaatcctcaaactgaaatacaaagattggtcgaggctttcaaagaaacttctcgacggcatcgtggctgacaataagttcgggtcgtctgtcaccgtcctcgacgtcttagaaatgtcacgactcaacctaatggaaataatcaacgacagagacctgggatacgcacaaatgattgaggcagcagcctcatgcccagaggatggaaaattcacctacaaagaggtgcagcgcctggcgggctcaccagctctgaagcgggggatatggcaaagccttcaaatagtggaagagatcacaaaggtgatgaaatgccgccccaagtacatctacatagagttcgaaaggtccgaggaaaccaaagagcgaaccgaatccaaaataaagaaactcgagaacgtctacaaagacctcgatgaacaaacaaaagtcgagtacaaaacagtactagaagaacttaaaggattcgacaacacaaagaaaatctcctcggactccctatttctctatttcacacaactcggcaaatgtatgtacagcggcaagaaactcgacatcgacagcctagacaaataccaaatagaccacatagtcccccaatcgctagtaaaagatgacagcttcgacaaccgcgtcctagtagtaccaagcgaaaatcagcgcaaactcgacgacctcgtagtgcccagcgacatccgggtcaaaatgaactcattctggaagctcctgttcgaccacgagctcatttcacccaagaaattctactccctcatcaaaaccgaatatacggaacgagatgaggaacgcttcatcaaccgccagcttgtagaaacacgtcaaatcaccaaaaacgtcacccaaatcatagaggaccactacagtaccacaaaagtagccgcaatacgagcaaacctaagccacgagttccgggtgaaaaaccacatctacaaaaacagagacatcaacgactaccatcacgcacatgacgcatacattgtagccctaatcggcggattcatgagagaccggtacccgaacatgcacgattccaaagcggtgtacagcgaatatatgaaaatgttccgcaaaaacaaaaacgacaaaaagcgatggaaggacggattcgtaatcaacagcatgaactacccctacgaagtcgacggcgaactaatatggaacccggacatcatcaacgaaatacgcaaatgcttctactacaaagattgctactgcaccaccaaactcgatcaaaagtccggacagatgttcaacctcacagtcctcccgaacgacgcccattcgcccaaagggacgaccgaagctgtcatccccgttaacaaaaacagaaaagacgtaaacaaatacggcggattctccggattacagtacgtaatcgtagccatagaaggaaagaagaaacgggggaagaaaacaaaacttgtcaagaaaatatccggcgtaccactacacctaaaagccgcctctctcgacgagaaaatcaaatatatcgaagaaaaagaaaacctcacagacgttaaaatcatcaaagacagtataccagtcaaccagatgatcgagatggacggcggcgaatacctactcacaagccccatcgagttcgtaaacggccggcagctagtcctcaacgaaaaacaatgcgctctaatcgccgacatctacaacgccatctacaaacaggactgcgataatctagacgacgtcctcatgattcaactctacatagaactcatcaacaaaatgaaagcgctatacccagcataccaatccatcgcggaaaaattcgagtccatgaccgaggactacgtggccgtgagtaaggaagaaaaagcggacatcatcaagcaaatgcttataatcatgcacaggggcccccggaacgggaagatccagtacgccgacttcaacgtgggcgaccgcatcgggcgcaaaaacaaaatgtcgctcgacctggagcgcgtaaccttcgtcagccaatcgcccaccggcatatacacgaagaaatacaaactctga

SEQ ID NO: 6429 - RNA, 4002 nt, synthetic construct
  misc_feature 1..4002: note = Cas9 variant
  source 1..4002: mol_type = other RNA
atgggaaaagagtattatctcggcctcgacatcgggactgacagcgtcggctgggcagtctgcgatacgaactacaaaatccccaaattcaaaggcaacgccatgtggggcatccggctattcgagaaatcaaactcggctgaagaaaggcgcggcttccgcagcagcaggcgacgaacgcagcgaaagagggaacgcctcaaactactcgaaatgctgttcgacgaggagatttcaaaaatagaccctgccttcttcataaagctccgcgagagcaacttatatctcgaagacaagagcacaaaaatcccctactgtgtgttttccgacgaaaactacacagacaaagacttccacagagattaccctacaatctaccatctccgcaatgaactaataaagtcaaacaagccacacgacgtccgtctggtgtacctagcgctacaccacataatcaaaaatcgaggacatttcctatttgactactcatacaaaaacgacaaaagcggcgacttcatgccaatctacaatgacctcaaaaactacttttacgacaattacgaaatcgagctagactgcagtgacgtcgacgagttcgcaaacacgctaaaagacaaatccaagggcaaaacaaagaagaacgccgaaatcgcagaactcttcggcgtctcgaagaagtacgataaggtcctctacagcgcactctcgttgctttcaggaagcagcgtcaaactcttcgacatattcgacgacgaagcattaaaggatgtagagaaaaagagcgtcagcttctcatcagggttcgacgacaacgccaacgacttccaatcctatctcggagaacgcttcgaactcttagaaaagctaaaggcggtgtatgactgggcggtgctcgcagatatcttggacggcaaagagtacatcagcgaagccaaagtcgcaatctacgagaagcacaaacgagacctgaagaccctaaagaagtacatcaagatctatatgcccgaaaagaaggcagagatattcaacatctcgtccaaggacaacaattacgtagcctactccaagcacatcaagacctcgaacggcaccggcgtactcataagcacatgcacccaggaggagttctgcgcgtacctgaagaaaaccctaggcatttgtaaagatgcttcctacgaagaaatgtttaaagaaatagagaactccacgttcatgcccaaacaagtaaccaaggacaacggagtggtcccgatgcaagtaaacgagaaagaactcgtcgccatactagacaacgccaaagaatacctacccttcctgctcaacaaggacaatgacggcaagaccgtgtacgacaagataaaggctctttttgaataccgaatcccgtactacatagggccccttaacacccacagcaccaaatcatggctcgtacgtagcaacgagaaaatttacccctggaatatagaagacgtagtagacttcgacaagtctgccgaaaagtttattgaaaaccttacctccaaatgcacatacctcccccagtacgacgtaataccaaaacactcactcctttacaacaaattctgcgtgctcaacgaactcaacaacttgaagatagacggcgagaaaatcagcgtccaactcaaacaagacatatacaacgacctcttcaagaaatactataaagttaccaacaagaaactctgcgactatctcaaatcgcgcaacatagcgtttgacgaaattagcggaatcgataacgatttcaaaagttcccttaaatcctacaaagacctagtagcgtacaacctaacagacgagcagaaagaagagatagtaaaagcaatcaccatcttcggcgacgacaagaaactgctcaagaaacgcttgaaaaacgagttcggcggatgcctctcggatgatgaaataaagaaaatctgcaaactgaaatatactgggtggtccaagctctctcgtgaatttttaacggacgttaccgctgtctacaaagaaaccggcgaactcatcaacataatctgcgccctctgggaaacgaactacaacctcaccagcctcctctacagtgacgagttctgctgcgacgataaggaaaataaaacattcaacgacaaaatcaacgaactcaactccttcggcaacgacaaaaccctaaatcagatagttgaagaactctacgtatccccactcgtcaaaagaccaatataccagtccctacttatcaccaaagaacttgaaaagataatgaaatgtccacccaagaaaatcttcgtcgaagtagcgcggggagccgaagagaagaaacgtacagtcagccggaggaacaaactccttgatctctacaaaagctgcaagaacgactaccccctcctattcgacgagctacagaacaataccacggacgacgagctaaaatcagacaaactctacctgtacttcacccaattcggcaaatgcatgtataccggcgaaaacatcgagcttggcgacctcttcaacaagaacttgtacgacatcgaccacatctacccccagtcgaaaataaaagatgactccctagacaatcgagtcctcgtgaaaaagaccacaaacgcgaaaaaggacaacgaatacccactatcgtcccagattcgggagaaaatgacaccccactggaaagcactgttagacaaaggcctaataaacaaaaagaaatacgaacgcctagtccgaaattaccccctctcagacgaagaactgtcacagttcatctcacgacaactggtcgagacacgccaatcgacaaaagccgtggcaaacatactcgaacaactctacccacgacccgacacggagatagtatacgtcaaagcagcactagcaagcgagttccgccaccaatatgacatgctaaaatgccgcgaagtcaacgacctacaccacgcaaaagacgcctacctgaatatagtggtcggcaacgcatacaacggcaaattcacccacaacaaggccaacttcatcaaaggactacagaacaacgacaaagcctacacggtcaagctagattccatgctgaagcacaacatagatggcgcttggatcgccgacaacaacgagtcactcaacatagtaaaatccaccatgaacaagaacaacatccgctacactcgatacgctttcgagaaaaagggaggactattcaaggtcaccatcctcaagaaaggaaacggccaggcatccatcaagaaaaatgacaaacgcaatagcatagaaaaatacggcgggtacaaccaagtctcatccacgtatttcagctgcgtcgaacatggcaaagacaataatagaatgatctccatgttcagcgtcaacctatatgacaaaaacaagtacgaagaaaaccccattgcatacctcatcgaaaattacggtttaatcaacccaatcatcaaagtgaaaaaggtaaagatccagtcgtgcattagcttcgataacatgctttgtcacctgggcggaaaggacagcggcggctcacagatatcctaccgaccgggagtacagctagtgctcggatacgataatgaacgatacatccgcaacgtgattcgctgcgccgggggcgacctccacctacaaacatctaagaacgaaaaagacatagtaaccgcggaaaagaacatcgaactattcaaccttctcatcgagaagatgaaaaacaatatttacggagtgctctactcaaatctgggcgacaagctatactgcagtaaggaaaagttcgagaaattggacatagtagaacaatgcaacgtaatcaaaaacgtactcaccatactcaagaacaacgcgtcgaaaggggacctgaagtccatcggcataaaagcaaacggagccatacggctcaacaacaacatatcagaaatcaagaaggtcaaaagtatcaaactaataaatcaatcggttaccggcctattcgagcaagagatcgagctattaaatctctga

SEQ ID NO: 6430 - RNA, 4002 nt, synthetic construct
  misc_feature 1..4002: note = Cas9 variant
  source 1..4002: mol_type = other RNA
atgagtcaaaacatagtagactactgcattgggctagacctcgggacaggaagcgtcggctgggcggtggtagacatgaaccaccgtctaatgaagagaaacgggaagcacctatggggcagtcgcctcttctccaatgccgaaacagcagcaacccggcgctccagcagaagcattcggcggcggtacaacaaaagacgcgaaagaatacgcctcctacgggccatcctacaagatatggtcctagagaaagaccccacgttcttcattagactcgaacatactagcttcctagacgaggaagacaaagccaagtacctcggtaccgactataaagacaactacaacctcttcatagacgaggacttcaatgactacacctactaccataagtacccaaccatataccaccttcgaaaagccctttgtgagagcacggagaaggccgacccccgcctaatttacttggccctccaccacatcgtgaaataccggggcaacttcctctacgaaggacaaaagttcaacatggacgcatccaacatagaagacaagctatccgacgtattcacgcagttcgcagacttcaacaacatcccttatgaagacgacgaaaagaaaaacctcgaaattctcgagattctcaagaaacccctatcgaagaaagcaaaagtggacgaagttatggcactaatcagccccgagaaagagttcaagtctgcatacaaggagcttgtaacagggatagcgggaaataaaatgaacgttacgaaaatgatcctctgcgagagcattaaacaaggggactcagagatcaaactcaagttcagcgactcgaactacgacgaccaattcagcgaagtagagaacgacctgggcgaatacgtggaatttatagactccctacacaacatatacagctgggtcgaactccagaccataatgggagccacacacacagacaacgcgtcaatcagcgaggccatggtcagccgatacaacaaacaccacgaagacctacaactactaaagaaatgcatcaaggataacgtacccaagaaatacttcgacatgttccgaaacgacagcgaaaaagtcaaaggatactacaattacatcaaccgacccaacaaagccccagtggacgagttctacaaattcgtcaagaaatgtatcgaaaaagtagacacccccgaagcgaagcaaatactacacgacatcgagctcgagaacttcctactcaaacaaaactcacgcacaaacgggtccgtcccctaccagatgcaactcgacgaaatgattaagataatagacaaccaggctaagtattacccagtcctaaaagaaaagcgggaacagctactcagcatcctcacattcaggatcccctactactttggccctctaaatgagacatcagagcacgcatggataaagagactagaaggcaaggaaaaccagcgcatcctcccatggaactaccaagacaccgtcgatgtagatgcaacggccgaaggcttcataaaacgaatgcgaagctactgtacctacttccccgatgaagaagtactacccaaaaactcactaatcgtaagcaaatacgaggtctacaacgaactaaacaagatcagagtagacgacaagctactcgaagtcgacgtaaagaacgatatctacaacgaactcttcatgaaaaacaagacggtcacagaaaagaaactcaaaaattggctggttaacaatcagtgctgtaggaaagacgccgaaataaaaggcttccaaaaggaaaaccaattcagcacctcgctaacaccatggatcgacttcaccaacatcttcggcaaaattgaccaatccaatttcgatctcatcgagaaaatcatatacgacttaacggtcttcgaagacaagaaaatcatgaaacgcaggctcaaaaagaaatacgcgctgccagacgacaaaatcaaacaaatcctcaagctcaagtacaaggattggagccgcctttccaagaaactcctagacggcatcgtggccgacaaccgcttcggttcctccgtcaccgtcctggacgtcctagaaatgagtcgactcaacctaatggaaataatcaatgacaaagaactaggctatgcgcagatgatcgaagaagcctcttcatgtccaaaagatggcaaattcacatatgaagaggtcgccaaactagcgggcagccccgcgctgaaacgagggatatggcaatccctacagatagtcgaggagatcacaaaagtgatgaaatgccggccgaaatacatatatatcgagttcgaacgctcagaagaagcaaaagaacgcaccgaatcaaaaatcaagaaactcgaaaacgtatacaaagacctagacgagcagacgaagaaagagtacaaatccgttcttgaagaactgaaaggcttcgacaacacaaagaaaatcagcagcgactccctatttctgtacttcacccagttagggaaatgtatgtactccggcaaaaagctcgacatagactccctggacaagtaccaaatagatcacattgtgccccagtcactcgtaaaagacgacagcttcgacaaccgcgtccttgtcctaccctccgaaaaccaacgaaagctcgatgacctcgtcgtcccctttgacatacgggataagatgtaccggttctggaagctcctgttcgatcacgagttaatctccccgaaaaagttctactcattgatcaaaaccgaatacacagaaagggacgaggagagatttataaaccgccagctggtagaaacgcgccaaataaccaagaacgtaacccagataatagaagaccactactcaaccacaaaagtcgcggctatccgagctaacctcagccacgagttccgcgttaaaaaccatatctataagaaccgcgacatcaacgactaccaccacgcccacgacgcatacatagtagcgctcatcggaggattcatgcgcgaccgctacccaaacatgcacgactccaaagccgtctactcagaatacatgaagatgttcagaaagaataaaaacgaccagaagaagtggaaagacggcttcgtaatcaactcgatgaactacccgtatgaagtagacggcaagctcatctggaaccccgacctaattaacgagataaagaaatgcttctactacaaagattgctactgcaccacaaaactagaccaaaaatcgggccagatgttcaacctaacagtactacccaacgacgcacatagcgccaagggaacaacagaagctgtcatccccgtcaacaagaaccgaaaggacgtcaacaaatacggcggattcagcggcctccagtacgtcatagccgctatcgaaggcaccaagaagaaaggaaagaaactggtcaaagtgcgaaaactatcgggaatcccactctaccttaaacaagcagatataaaagagcaaatagaatacgtagagaaggaggaaaaactctcggacgtaaaaataatcaaaaataatatcccactaaaccagctcatcgaaatcgacggcaggcaatacctcctgacaagcccaacagagtgcgtcaacgcaatgcagctagtactgaacgaagaacaatgcaagctcatcgcagacatatacaacgcaatctacaaacaggacttcgacggtctcgacaacatgctaatgatccagctttacctacaactgatagacaagctaaaaacactttacccgatctacatgggcatagtagaaaaattcgaaaaactcacggaagacttcgtctcaatctcaaaagaggagaaagctaacgtaatcaaacaaatgctgatcatcatgcacaagggaccacaaaatggcaacataatatacgacgacttcaacgtaggaaagagaatcggcagacttaacgggcgcaccttctacctcgacaacatcgagttcatctcgcagtcgcccacgggcatatacacaaagaaatacaaactctga

SEQ ID NO: 6431 - RNA, 4002 nt, synthetic construct
  misc_feature 1..4002: note = Cas9 variant
  source 1..4002: mol_type = other RNA
atgtacacctactacttcaaagaatcggaaatggtctacgacgtcggactcgacataggtacggggtccgtggggtgggtcgcccttgatgaaaacgggaaactagcccgagcaaaaggcaaaaatctagtgggtgtgcgattattcgacactgctcaaaccgccgctgaccgccgagggttccgcaccacacggaggcgcctaagccgtcgaaagtggcggctcaggcttctcgacgaactattctcggccgagataaacgaaatagatagctccttcttccaacgactgaaatacagctacgtacacccaaaggatgaagaaaacaaagcccactactacggcggctacctattccccaccgaagaggaaacgaaaaagttccaccggagctacccgacaatctatcatctgcgacaagaactaatggcccaacctaacaaaagattcgacatacgagagatatacctagcgatccatcaccttgtaaaataccgtggccactttctctccagccaggagaaaatcaccattggaagcacgtacaaccccgaggacctcgctaacgcaatcgaagtatacgcagacgaaaaaggcctgagctgggaactgaacaacccagaacaactgaccgagatcattagcggagaagcaggatacggcctaaacaaatcaatgaaagccgacgaggcactcaaactcttcgaatttgataataatcaggacaaagtcgccatcaaaaccctactggccggcctgaccggaaaccaaatcgacttcgccaaactgttcggaaaagatatctccgacaaagacgaagccaaactctggaaattaaaactcgacgacgaagcgcttgaagagaaaagccagacgatcctatcacagctgacagacgaagaaatcgaactattccacgcggtcgtccaagcctacgacggcttcgtcctaatcggcctcctcaacggcgcagacagcgtcagcgcggccatggtccaactatacgaccaacaccgggaagaccgcaagctgctaaagagcctcgcgcaaaaagccggcctcaaacacaaacgtttctcggaaatatacgaacaactagcactcgcaactgacgaagccaccatcaaaaacggaataagcactgcccgcgaactcgtcgaagaaagcaacctcagcaaggaagtaaaagaagatactctacgccgccttgacgagaatgagttccttcccaagcaacgaaccaaagcaaactcggtaatcccacaccaactgcatctagccgaactccagaaaatcctccaaaaccaaggacaatactacccgttcctccttgacacattcgaaaaggaggacggccaagacaacaagatcgaggaactcctccgattccgcatcccatactacgtaggcccactcgtgaccaaaaaggacgtagagcacgcgggaggcgatgcagacaaccactgggttgaacgcaacgaaggcttcgagaaatcaagagttacgccatggaacttcgataaagtgttcaaccgcgacaaggccgctagagacttcatagagagactaacgggcaacgatacctacctcataggagagaaaacgctcccgcagaacagcctccgctaccaactgttcaccgtactaaacgaactcaacaacgtccgcgtcaatggcaaaaagttcgactccaaaaccaaggcggacctcataaacgacctatttaaagcccgcaaaacagtaagcctcagcgccttgaaagactacctaaaagcgcaaggaaaaggcgacgtcacaataacagggctagccgacgaatccaaattcaacagttcactgtcctcctacaacgatcttaagaaaacctttgacgcagaatacctcgagaatgaagataaccaagaaaccctcgaaaagatcatcgagatccaaaccgtattcgaggactccaaaatcgcgtcccgggaactatccaaacttccactagacgacgaccaggtcaagaaactcagccagacacactacaccggctggggccgactaagcgaaaaactcctcgacagcaaaattatagacgaacggggtcaaaaagtctccattctggacaaactcaaaagcaccagccaaaacttcatgagcatcatcaacaacgacaagtatggagtgcaagcgtggatcacggaacagaacacaggctcgtcaaaattaaccttcgacgaaaaagtcaacgagctaacgacttccccagcaaacaaaagaggcataaaacagtcattcgccgtactgaacgatatcaagaaagcaatgaaagaagaaccccgccgcgtctacctagaatttgcgcgcgaagaccaaacatccgtccgctccgtcccccgatacaaccaactgaaagagaagtaccagagcaaatccctttccgaagaagcgaaagtgctcaaaaagacactagacgggaacaagaacaaaatgtcggacgaccgctacttcctatacttccaacaacaggggaaagacatgtacaccggccgccccatcaacttcgaacggctaagccaagattacgacatcgatcacatcatcccgcaagcattcactaaggacgacagcctagacaaccgcgtgcttgtctcgagacccgagaacgcccgcaaaagcgacagcttcgcgtacactgacgaagtacaaaaacaagatggatcgctctggacatcattactcaagagcgggttcataaacaggaagaaatacgaacgactcaccaaagcaggaaaatacctagacggccaaaagaccggtttcatcgccagacagttagtcgagacgcgccaaataatcaagaacgtcgcttctctcattgagggagagtacgaaaactccaaagcagtagcaattagatcggagattaccgcagacatgaggctcctggtcgggataaagaaacatcgcgaaatcaactccttccaccatgccttcgacgctttgttgataaccgcagcggggcagtacatgcaaaaccgttaccccgatcgagactcaacaaacgtatacaatgagttcgaccggtacaccaacgactaccttaaaaatctccgacaactatcgtcacgcgacgaagtgagaagactgaaatctttcgggttcgtagtaggtaccatgcgaaaaggcaatgaagattggtccgaagaaaataccagttatttgaggaaagtgatgatgttcaagaacatcctaacgacaaagaaaacagaaaaagaccgcgggcccctcaacaaagaaaccatcttcagcccaaagtcaggcaagaaactgatccccctcaattctaaacgctccgacaccgcactctacggtgggtacagcaatgtctacagcgcctacatgacgctcgtacgtgccaacgggaaaaacctcctcatcaaaataccaatcagcatcgccaaccaaatcgaagtgggcaacctaaaaatcaatgactatatagtaaacaacccggcgatcaagaaattcgagaaaatactcataagcaaactccccctgggccaactcgtcaacgaagatgggaatctcatttacctggcctcgaacgaataccggcacaacgccaaacagctatggctctctaccacagacgcagacaaaatagcgagcatcagcgaaaacagctcggacgaagaattgcttgaagcgtacgatatcctcaccagtgagaacgtcaaaaatcgcttccccttcttcaagaaggacatagacaaactgtcacaagtcagagacgagttcctggactccgataagaggatagccgtaattcaaacaatccttcgcggcctgcaaatagacgccgcctaccaagcccccgtcaaaatcatcagcaagaaagtatccgactggcacaaactccagcaaagcggtgggataaagctgagcgataactcagaaatgatctatcaaagcgcgaccggaatcttcgagacccgagtcaagatatcagacctcctgtga

SEQ ID NO: 6432 - RNA, 4005 nt, synthetic construct
  misc_feature 1..4005: note = Cas9 variant
  source 1..4005: mol_type = other RNA
atgaaaaacccatatacaatagggctagacatcggcacgaactccgtcggctgggcagtcctcacaaaccaatacgacttagtaaaacgcaagatgaaagtagcgggcaactccgacaaaaagcaaatcaaaaagaacttctggggcgtgcgcctcttcgacgacgggcagacggcagtagaccgtcgtatgaaccgcactgccaggagacgaatagaacgacgccggaaccgcatatcctacctgcaggagatattcgcagtcgaaatggcgaacatcgacgccaactttttctgtcgactaaacgacagcttctacgtggacagtgaaaaacgaaacagccgtcatccattcttcgcgaccatcgaagaggaagtagcgtaccacaaaaactaccgcacgatctaccaccttagggaagaactcgtcaactcctccgaaaaggcagacctcagactcgtttacttggcgctagcacacatcataaaataccgagggaactttttgatcgagggagccctcgacacgaaaaatacatctgtagatggcgtctatgaacagttcatacagacctacaaccaagtgttcatgagcaatatagaagaagggacactggccaaagtagaagaaaatatcgaggtcgccaacattctagcaggcaaattcacacgcagagagaaattcgagcgaatacttcagctctacccgggtgaaaaatccacgggcatgttcgctcaattcatctccttaatcgtaggatcaaaaggtaacttccaaaaagtgttcgacctcatagaaaagaccgacatagagtgcgccaaagactcatacgaagaggaccttgaggcattactagcaataatcggggacgagtacgcggaactattcgttgccgcgaaaaacacctacaacgcggtcgtactaagtagtatcataacggtgaccgccacagaaacaaatgcaaagctatcagccagtatgatcgaacgcttcgacgcacatgagaaagacctaggcgagcttaaagcgttcataaaattgcatctgcccaaacaataccaggaaatcttcaacaacgccgccatcgacggttacgccgggtacatagacggaaaaacaaagcaggttgacttttacaagtacctcaagacaatcctagaaaacatagaaggcgccgattactttatagcaaagatagaagaggaaaacttcttgcgaaagcaacggacattcgacaacggggctatcccccatcaactccaccttgaggaactggaagctattatacaccagcaggcgaagtactacccattcctccgcgaggactacgaaaagattaagagcctcgtcacatttcggataccatacttcgtcgggcccctcgccaaaggccaatccgagttcgcttggctcactagaaaagctgacggcgaaattcggccgtggaacatagaagaaaaggtcgatttcggcaagtccgctgtcgactttatcgagaaaatgacgaataaggacacttacctccccaaagaaaacgtgcttcccaaacactccctgtgctaccaaaaatatatggtatataacgaactcacgaaggtacgctacatcgacgaccaaggcaagaccaactacttcagcggacaagaaaagcaacagatattcaacgacctcttcaagcagaaacgaaaagtcaagaagaaagacctggaactattcttacgtaatataaaccatatcgaatctcccacgatcgagggcctggaagacagctttaacgccagttacgccacctaccacgacctactcaaagtaggcatgaaacaggaaatactcgacaaccctctaaacaccgaaatgcttgaggacatcgttaaaatcctcacggtcttcgaggacaaacccatgattaaggaacagctccaacaattttcagacgtcctagacgggggcgtgcttaagaaactagaaagacgccactatactggctggggacggttgagcgccaaactactcgtcggcatacgggaaaaacaatcgcaccttaccattctcgactaccttatgaacgacgatggcctaaaccgtaacctcatgcaactaatcaacgattccaacctatccttcaaatccataatagaaaaagaacaagtcagcacgacggacaaagacctccaatccatcgtcgcggacctagccggcagcccagccatcaagaaagggatactacagtccctcaaaatcgtcgacgagctagtaagtatcatgggctacccaccgcaaactatagtagtcgaaatggctcgggaaaaccaaaccaccggtaaaggcaaaaacaactcgaaaccccgatacaaatccttggaaaaagctatcaaagagttcggcagcaaaatccttaaggaacaccccacagacaaccaagaactcaaaaataaccggctatacctttactacctccaaaacggcaaggacatgtacacaggacaagaactggatatccacaatctctccaactatgacatagaccacatagtaccccaatcattcataacggacaacagcatagataacctcgtcctaacatccagcgcgggaaaccgtgaaaaagggggcgacgtacctccccttgagatcgtacgcaaaagaaaagtcttctgggaaaaactataccaaggcaacctaatgagcaaacgcaaatttgactacctaacaaaagcagaacgaggcgggctcacggacgccgacaaagcgcgcttcatacatcgccagctcgtagaaacgcgacagatcacgaaaaacgtcgcaaacatactccaccaacgattcaacaacgagactgacaaccacgggaacaccatggaacaagtcagaatcgtcacactgaagtccgcacttgtgtcccaattccgtaaacaattccagctctataaagttagggaagtaaacgattaccaccacgcccacgacgcgtatctgaatggagtagtcgcaaacacgttactgaaagtctacccgcagctcgaacccgagttcgtctacggcgaataccaccaattcgactggttcaaggctaacaaagccaccgccaaaaagcaattttatactaacataatgctattcttcggccagaaggaacgcattatcgatgaaaacggcgaaatactctgggacaaaaagtacctcgaaacaatcaagaaagtcctcgattatcgtcaaatgaatatcgtaaagaaaacagaaatccaaaaaggcgagttctccaaagcaaccattaaacccaagggcaactcaagcaaactcataccgcgaaaagaaaactgggaccctatgaaatacggcgggctggactccccaaacatggcatacgcagtaatcatagaacatgcaaaagggaaaaagaaacttatcttcgaaaagaaaataatccgcatcaccataatggaacgaaaaatgttcgaaaaggatgaggaggcctttctcgaggaaaagggctatcgtcaccctaaggtcctaacaaaactcccaaaatacaccctgtatgaatgtgagaaaggacgccgccgaatgctcgccagtgccaacgaagcccaaaagggaaaccagctagtgctctccaaccaccttgtatcactgctttaccacgccaaaaactgcgaagccagcgacgggaaaagcctaaaatacatagaagcccaccgagaaacattctcagaacttctcgcccaagtatcagagttcgcaacacgctacacgctcgctgacgcaaacctgagcaagatcaacaacctgtttgagcaaaacaaagagggcgacatccaagcaatagcgcagagcttcgtagatctcatggccttcaacgccatgggcgcccccgcctccttcaagttcttcgaagctactatcgaccggaaacgatacactaacctaaaagaactcctctcaagcaccataatataccaatccatcaccggcctatacgaatcacgtaaaaggctcgacgactga

SEQ ID NO: 6433 - RNA, 4005 nt, synthetic construct
  misc_feature 1..4005: note = Cas9 variant
  source 1..4005: mol_type = other RNA
atgaaaaagccatacaccattggactcgacattggcaccaactcggtgggctgggcagcccttacggaccagtacgacctcgtcaagcgtaaaatgaaggtggctggcaacagcgagaaaaagcaaatcaagaaaaacctctggggagtccggctcgtcgacgaaggcaaaaccgctgctcaccgtagagtaaaccgcaccacccgcaggcgtatcgaaaggcgcagaaaccgaataagttacctccaagaaatattcacggcagaaatgtttgaagtcgacgccaacttcttttatcgcctagaagattccttttacatagagtccgaaaagcgccaatcgcgccatcccttcttcgctacgatcgaagaggaagtcgcgtaccacgaaaactacaggaccatctaccacttgcgcgagaagctagtcaactcgtcggataaagccgacttacgactggtctacctcgccctcgcacatatcataaagtaccgaggcaacttcttaatcgaaggcaagctcgacaccaaaaacacatcggtagacgaagttttcaaacaattcatcaagacatataaccaagtcttcgcctccgacatagaggagggcagcctcacgcgcattgaagaaaacaatgaagtagccaagatcttctccgaaaaactaacgaaaagagaaaaactggacaagatcttaaacctctacccaaacgaaaagagcacagacctattcgcgcagttcatctcactcatcatcggctcaaaaggcaacttcaagaaattcttcaacttgacagagaaaaccgacatcgaatgcgcgaaagactcctacgaggaagacctagaggtcctactggccagagtcggggacgagtacgccgaaatattcgtagcggccaaaaacgcctacaatgcggtcgtcctctcaagcatcattaccgtcagcaacacggaaaccaaggccaagctatccgcctcaatgatcgagcggtttgacaaacacgacaaagacctcaaacgaatgaaggcattcttcaaggtccgtttgccagaaaacttcaacgaggtattcaatgacgtagagaaagacggctacgctggctacatagaaggcaaaaccaagcaggaagcgttctacaaatacatgaaaaagatgctcgaacacgtcgagggcgcagactacttcatcaaccaaatagaagaagaaaacttcctccgtaaacagcgcacctttgataacggcgccatcccacaccagctccacctggaggaactagaggcaatcctccaccaacaagccaaatactacccattcctcaaagtagactacgaaaagataaaatcccttgtaacgttccgaatcccgtacttcgtcggacccctggctaacgggcaaagcgagttctcctggctcacgcgaaaagcagacggagaaataagaccctggaatatagaagaaaaggttgacttcggaaagagcgccatcgacttcatcgagaaaatgaccaacaaagatacctatctcccaaaagagaacgtcctgcccaaacacagtatgtgctaccaaaaatacatggtatacaacgaactcaccaaaatacgctataccgacgaccagggcaaaacacactacttctcgggacaagagaaacaacaaatctttaacgacctctttaaacaaaagcggaaagtcaaaaagaaagacctagagctattcctatacaacatgaatcacgtagagtcacctacggtcgagggagtcgaggacgccttcaattcttcctttaccacctaccacgacctccaaaaagtaggcgtgccacaggagatcctcgacgacccgctcaacactgaaatgctggaagagataataaaaatcctaacggtcttcgaagacaaacgcatgattaatgagagactgcaagagttcagcaacgtcctggacgaagcagttctgaaaaagctggaaaggcgacattacacggggtggggccgactcagcgccaaactgctgataggcatccgcgacaaagaaagccacctgacgatcctcgactacctgatgaacgacgacaaacacaaccgcaacctgatgcaactcatcaacgactcgaacctcagcttcaagagcatcatcgaaaaggaacaagtcagtacggccgacaaggacatccagagcatcgtcgccgacctcgccggaagccctgccataaagaaaggcatactccagtccctaaaaatagtcgacgaactcgtcggcataatgggttacccaccccaaaccatagtggtcgaaatggcccgcgagaaccaaacaacgggaaaagggaaaaacaacagtaagccccgcttcaccagccttgagaaggcgatcaaagagctaggctcccaaatcctaaaagaacacccaaccgacaaccaaggactcaaaaatgacagactctacctctactatctacaaaatggcaaggacatgtacacgggacaagaactcgacattcacaacctaagcaactacgacatcgaccatgtagtaccgcagagcttcatcaccgacaactcaatcgacaaccgcgttctagcctcctcggcggccaaccgcgagaaaggagacaacgtcccctcgctcgaggtcgtacgcaaacgaaaagtctactgggaaaaactataccaggccaaactcatgtctaaaaggaaattcgattacttaacgaaagcggaaaggggagggttaacagaagccgataaagccagattcatacaccgtcagctcgtcgagacccgccagataaccaaaaacgtagcaaacatactacaccagcgattcaactgcaaaaaggatgaaagcgggaacgtcatcgaacaggtccgaatagtaacactcaaagccgccctagtatcccaattccgcaagcaattccaactctacaaagtcagagaagtaaacgactaccatcacgcccacgacgcatacttaaactgcgtcgtagccaacacactgctcaaagtttacccgcaactcgaacctgagtttgtctacggggactaccatcaattcgactggttcaaagcaaacaaagccactgccaagaaacaattctacacgaacatcatgctattcttcgcaaagaaagaccgcatcatagacgagaacggagagatactctgggacaagaaatacctcgacacaataaagaaagtgctgaactatagacaaatgaacatcgtaaagaaaacagagatacaaaaaggagagttctccaacgccaccgccaacccaaaaggcaattccagtaaactgatcccccgcaaagccgactgggaccccatcaaatacggcggctttgacggctcaaacatggcatacgcgatcgtaattgaacacgaaaaacgaaagaagaaaaccgtgatcaagaaagaactcattcaaattaacatcatggaaagaacagcttttgagaaagaccaaaaagagttcctggagggcaaaggataccgaaaccccaaagtcatcacaaaaatcccgaaatacacattgtatgaatgcgaaaacggccgacgccgcatgctgggaagcgcaaacgaagcacaaaaaggcaaccagatggtcctccccaaccacctgatgaccctactctaccacgccaaaaactgcgaagcgtcggatggcaaatcactagcatacatcgaatcacatcgggaaatgtttgccgaactcctcgacagcatctcagagttcgcctcacgctatacccttgcagacgcgaacctggagaaaattaacacaatattcgagcaaaacaaatccggcgacgttaaagtaatagcacagtccttcgtaaacctgttggagttcaacgcaatgggagcaccagcctcgtttaaatatttcgaaacgaatatcgaacgcaaacgatacaacaatctgaaggaattgttaaacgcgacaatcatctaccaatccatcacgggcctgtacgaagcccgcaagcgcttagacgattga

SEQ ID NO: 6434 - RNA, 4005 nt, synthetic construct
  misc_feature 1..4005: note = Cas9 variant
  source 1..4005: mol_type = other RNA
atgaagaatccgtacacaatagggctggacatagggacgaacagcgtaggctgggccgtattaaccgaccaatacgacctagtcaagcgcaaaatgaaagtcgccgggaacagcgacaagaaacagatcaaaaagaatttctggggagtacgcctatttgacgacggacaaacagcagtagaccgaagaatgaacagaaccgcccgccgacgaatagagcgccgaagaaaccgaatctcctacctgcaagaaatcttcgcagtcgagatggctaacatagacgccaatttcttctgcaggttaaacgatagcttctacgtcgactccgaaaaacgcaacagccggcacccctttttcgccacaatagaagaagaagtcgcttaccacaaaaactaccgcaccatctaccacctgagagaggagctcgtcaactcgagcgaaaaggccgacctacgcctagtctacctagcgctagctcatataatcaaatacagagggaacttcctcatagagggcgcccttgacaccaaaaacacatccgtagacgaggtctacaaacaattcatccaaacatacaaccaagtgttcatgagtaacatcgaagaaggagcactcgccaaggttgaggaaaacacagaagtcgcaagcatactagcaggcaaattcacccgacgggaaaaattcgagcgaatactacggctctacccaggcgaaaaatcgacaggcatgtttgcccagttcataagcctcatcgtagggaacaaaggcaacttccaaaaagtcttcaacctggtagagaagacggacatcgaatgcgcaaaagacagctacgaggaagaccttgaagcactcctcgcaatcattggcgatgaatacgcagagctattcgtggccgccaaaaacacctacaatgccgtcgtgctttcatcaataatcaccgttactgctacagaaaccaacgccaagttgagcgcaagcatgattgagcgatttgacgcacacgaaaaagaactcggagaactaaaagcattcatcaaactacacctcccaaaacaatatcaggaaatattcaacaacgccgaaatagatggatacgccggctacatcgacggaaaaacaaagcaggtagacttctacaaatatctcaagaccaccttagaaaatgtagaaggcgcagactatttcatcacaaaaatcgaagaagaaaacttcctccgtaagcaacggacgttcgacaacggagtcataccacatcagcttcacctcgaggagctcgaagcgatactccaccaacaggcgaaatattaccccttcctccgcgaaggctacgataaaataaaatctcttgtcacgttcagaatcccctacttcgtcggcccgctcgcgaacggacaatcggagttcgcatggctgaccagaaaagacgatggtgaaatacgaccctggaacatcgaagaaaaagtcgacttcggaaaatcagccgtcgacttcatagaaaagatgaccaacaaagacacctacctaccaaaagagaacgtactcccaaaacactcattgtgttaccaaaagtacatggtctacaacgagctgacaaaaatccgctacatcgacgaccaaggaaagacaaactacttcagcggacgggaaaagcaacaaatcttcaacgacctctttaaacaaaaacgcaaagtaaagaaaaaggacctcgaactattcttacgtaacattaaccacatcgaatcccccacgatcgaagggctagaagacagcttcaacgcaagctacgccacctatcacgacctgcttaaggtcggcctcaaacaagagatcctcgacaacccccttaacacagaaatactggaggacatagtcaagatattaactgtattcgaagataaacgcatgatcaaggaacagctggagcaattctcagacgtgttggacggcgtcgtactgaagaagctggaacggcgccattatacgggatggggaagactgagcgcaaagctcctcgtcggcatacgcgacaagcaatcccatctgacgatcctcgactacctgatgaacgacgacggcctcaaccgcaacctcatgcaactgatcaatgactcaaacctctccttcaagtcaataatcgaaaaagagcaggtatccaccaccgacaaggacctccagagcatagtcgctgacctagccggaagcccggcaataaagaaagggatcctacaatcacttaagattgttgacgaacttgtatcaatcatgggctacccgccacaaacaatcgtcgtcgagatggctcgtgaaaatcagacaacaggaaaaggcaaaaacaactccaaaccaagatacaaatcgttagaaaaggctataaaagactttggatcacagatcctcaaagagcacccgaccgacaaccaggaactcaaaaacaacagactctacctctactacctccagaacggaaaggatatctacacaggccaagaactggacatccacaacctttcgaactacgacatagaccacatagtgccacaatcattcatcacagacaacagcatagacaacctagtgcttacgagctcggccggcaaccgcgagaaagggggcgacgtcccacccctcgagatagtcagaaagcgtaaagtgttctgggagaagctgtaccaaggcaaccttatgagcaaacggaagttcgactacctgaccaaagccgaacgcgggggactaactgaggcagacaaagcgcgcttcatccacaggcagctagtcgaaacaaggcaaatcacgaaaaacgtcgcaaacatactacaccaaagattcaacaaggagactgacaaccacggcaacaccatggaacaagttcgaatcgtcaccctaaaatcagcactggtcagccagttcagaaaacagttccaattatataaggtacgcgaagtcaatgattaccaccatgcgcacgacgcctacctcaacggcgtcgtcgccaacacactactaaaggtgtacccacaactcgagccagagttcgtctatggcgaataccaccaatttgactggttcaaggccaataaagccaccgccaaaaagcaattctacacgaacataatgttgttcttcgcacaaaaggagcgcataatcgacgagaacggcgagatcctatgggataagaagtatctagaaaccataaagaaggtactagactaccgccaaatcaacatcgttaaaaagaccgaaatacagaaaggggaattttcgaaagccaccatcaagccgaaaggaaactcatccaagctcatccccaggaaagagaactgggacccagtaaagtacggtggcctcgactccccaaacatggcatacgcagtaatcatcgagcacgcaaaggggaaaaagaaaatagtcatcgaaaagaaattgatccagatcaacatcatggaaagaaaaatgttcgaaaaagatgaagaggcgttcctagaggaaaagggataccaccagccaaaggtcctaaccaagctcccgaaatacaccctatacgaatgtgagaagggacgacgccgcatgctaagctcagccaacgaagcccaaaagggcaaccaactcgtactttcgaaccacctcgtcagcctgctctaccacgccaaaaactgcgaggcatccgacgggaaatccttaaaatacatcgaggcacaccgcgaaacgttctcagagcttctagcccaggtttccgagttcgctaccaagtacaccctagccgacgctaacctgagcaagataaacaacctttttgaacaaaacaaggagggcgacatcaaggctatcgcacaatccttcgtagacctcatggccttcaacgccatgggcgccccggcctcgttcaaattcttcgaggcaacaatagaccgcaaacgatacaccaacctaaaggaactcctaagcagcaccatcatctaccaatctatcacaggcctgtacgaatcgcgcaaacgactggatgactga

SEQ ID NO: 6435 - RNA, 4005 nt, synthetic construct
  misc_feature 1..4005: note = Cas9 variant
  source 1..4005: mol_type = other RNA
atgggtagaaagccgtacatcctgagcctagacatcgggaccggctcagtcggctacgcatgcatggacaaaggctttaacgtcctcaaataccacgacaaggacgccctcggtgtatacctcttcgacggcgccttaaccgctcaagagcgccgacaattccggacatcccgcaggaggaagaaccgacgaataaaacgcctcggactgctccaagaactgctcgcaccattagtccaaaaccccaacttctaccaattccagcgccaatttgcctggaaaaacgacaacatggacttcaagaacaaaagcctttccgaggtgctgtcattcctcggatacgagtcaaagaaatacccaaccatataccacttgcaagaagcactgctcctcaaggacgagaaattcgacccggagctcatctacatggcgctgtaccacctggtcaagtaccgcggccatttcctcttcgatcacctgaaaatcgaaaacctaacaaacaacgacaacatgcacgacttcgttgaactcattgagacttacgaaaacctcaacaacattaaactaaacctagattacgagaaaaccaaagtgatctacgaaatcctcaaggataacgaaatgaccaaaaatgacagggccaagcgagtcaaaaacatgcaaaagaaactcgaacaattctccataatgctcctcggcctgaagttcaacgaaggtaaactcttcaaccacgccgacaacgccgaagaactgaagggagcgaaccaaagccacacattcgcagacaactacgaagaaaatctcacccccttcctcactgtagaacaatcagagttcatcgaacgtgcaaacaaaatctacctcagcctgacattacaagacatcctgaaagggaagaaaagtatggctatgtccaaagtggccgcctacgataaattccgaaacgaactgaaacaggtaaaggacatcgtgtacaaagcggactccacacgcacacagttcaagaaaattttcgtatcaagcaagaaaagcctaaaacaatacgacgcaaccccaaatgaccagacattcagctccctctgtctcttcgatcagtacctaatccgacccaagaaacaatactcactactcatcaaagagctcaagaaaataatcccgcaagacagcgaactatacttcgaagccgaaaacgatacgctgctcaaagtcctaaacactaccgacaacgcgagcatccccatgcagatcaacctatacgaagccgaaactatactgcgcaaccaacagaaataccatgcagaaatcaccgacgaaatgatcgagaaagtgctcagcctcatccaattcagaatcccttactatgttggccccctggtcaacgaccacacagccagcaaattcggctggatggagcgcaaatcgaacgaaagcataaaaccatggaactttgacgaagtggtcgataggagcaaaagcgctactcagttcattcgcagaatgaccaacaaatgctcatacttaatcaacgaagacgtgctccccaaaaactctctcctatatcaagaaatggaggtcctcaacgaactcaacgcaacccaaatacgcctacaaaccgaccccaaaaaccgcaagtaccgcatgatgccacagatcaagctctttgccgtcgagcacatcttcaagaaatacaaaaccgtctcccactcgaaatttctggaaataatgcttaactcgaaccaccgagaaaacttcatgaaccacggcgagaaactgagcattttcggcacccaagacgacaagaaattcgcctccaaactatcgagctaccaagacatgacaaaaatattcggcgacatagaaggaaaacgagcccaaatcgaggaaataatacaatggataacaattttcgaagacaaaaagatactcgttcaaaaactcaaagagtgctatccagagcttacctcaaaacaaatcaaccagctcaaaaagctaaactacagcggctgggggcgcctgtccgagaagctcctcacacacgcctatcaaggccacagcataatcgagctactacggcactctgacgaaaatttcatggaaatactaactaacgacgtatacggattccagaacttcataaaggaggagaaccaagtacaaagcaacaaaattcagcaccaagacatcgcaaacctcaccacctctcccgcgcttaagaaagggatctggtccacaatcaaacttgtacgtgagctaacgtccatcttcggagaacccgaaaagataatcatggagttcgccaccgaagaccaacaaaagggaaaagaacagaaatcccgaaagcaactatgggacgacaacataaagaagaacaaattaaaaagcgtagacgaatacaaatacataatagatgtagctaacaaactaaacaacgaacaactccagcaagaaaaactgtggctttaccttagccagaacggtaaatgtatgtatagcggtcagtcaatagatctagacgctctgctatcgccaaatgccaccaaacactacgaagtcgaccacatattcccgcgctccttcataaaggacgacagcatcgacaacaaagtgcttgtcataaagaaaatgaaccaaaccaagggtgaccaggtaccactacaattcatccaacagccctacgaacgaatagcatactggaaatccctaaacaaggccggccttatctctgacagcaaactgcacaaactcatgaaaccagagttcaccgctatggacaaggaaggcttcatccaaagacagctcgttgaaacacggcaaatcagcgtgcacgtacgcgacttccttaaggaagaataccccaacaccaaggttataccgatgaaggccaaaatggtctccgaatttcggaagaaattcgacatccccaaaatccgccaaatgaacgatgcgcatcacgctattgacgcatacctgaacggcgtagtataccacggggcccaactcgcatacccaaatgtcgacctgtttgacttcaacttcaaatgggaaaaagtccgcgaaaaatggaaagcactcggcgagttcaacacaaaacaaaaatcccgagaactcttcttcttcaagaaactcgagaaaatggaagtctcgcagggggaacgccttatctcgaaaataaaactcgacatgaaccacttcaagatcaactactccaggaagctagcaaatataccccaacaattctacaaccagaccgccgtctccccaaaaaccgccgaattgaagtacgaaagcaacaaatctaatgaggtagtctacaagggacttaccccctaccagacttacgtcgtagccattaaatcagtgaacaaaaagggcaaagagaaaatggaataccaaatgatcgaccattatgtcttcgacttctacaaattccaaaacggcaatgaaaaagaactagctctctacctcgctcagcgcgaaaacaaagacgaagtgctagacgcacagatcgtctatagcctcaataagggcgaccttctatacataaacaaccacccttgctatttcgtttcacgaaaagaagtaataaacgctaaacaattcgaactcacggtcgaacaacagctgtccctctacaacgtcatgaacaacaaggaaacgaacgtcgaaaagctcctcatcgaatacgacttcatcgcagaaaaggtgataaacgagtatcatcactacttgaactccaaactgaaggagaaacgagtccgcaccttcttctccgagagcaaccagacccacgaagactttatcaaggcactagacgaactctttaaagtcgtaacggcaagcgcgacccggtccgacaaaatcggctcccgcaaaaactcgatgactcaccgcgccttcctggggaaaggaaaagacgtgaagatagcctacaccagcatcagcggcctcaagacaaccaaaccaaaatccctcttcaaactcgccgaatcccggaacgaactctga

SEQ ID NO: 6436 - RNA, 4005 nt, synthetic construct
  misc_feature 1..4005: note = Cas9 variant
  source 1..4005: mol_type = other RNA
atgaaaaatccctacaccatcggcctagacatcggaacgaactccgtagggtgggctgtcctaaccgaccaatacgacctcgtaaaacggaaaatgaaggtcgccggaaacagcgataagaaacaaatcaagaaaaacttttggggagtccgcctctttgacgagggagaaaccgcagcggacagaaggatgaaccgaaccgcccgccgccgaatagaacgccgccgtaatcgcatcagttacctccaggagatatttgctctagaaatggcaaacatcgacgcaaacttcttctgccgtcttaacgacagcttctacgtggacagcgagaaacggaactcgcgacaccccttcttcgcaacgatagaggaagaagtggcctaccacaaaaactaccggaccatctaccacctccgagaagaactcgtcaactctagcgagaaagcagacctacgcctcgtctacctagccctagcgcacattataaaatacaggggaaacttcctgatcgaaggggcgctcgatactaaaaacaccagcgtagacggagtctataagcaatttatccaaacatacaaccaagtgttcataagcaacatcgaagaaggcaccctggccaagatggaagaaaacacaaccgtcgccgacatcctcgcgggcaaattcaccagaaaagagaaactagaaagaatcctccaactctaccccggtgagaaaagtacagggatgttcgcccaatttatcagcctgatcgtaggttcaaagggaaatttccaaaaagtattcgacctagtagagaaaaccgacattgaatgtgccaaagactcgtacgaagaggacctggaagccttactggcaataataggtgatgaatacgccgagctattcgttgccgcgaaaaacacgtacaacgccgtcgtcctcagcagtataataaccgtcacggacacggaaacaaacgccaagctgagtgccagcatgatcgaacgattcgacgcacacgaaaaagacttaagagaactgaaagcgtttatcaaactacacctccccaaacaatacgaagagatcttcagcaacgtcgccatagatggctacgcgggatacatcgacggaaaaaccaaacaagtagacttctacaaatacctcaaaacgctactcgagaacatcgagggggccgactacttcatcgccaaaatagaagaagaaaacttccttcgcaagcagcgaacgttcgacaatggtgccatcccacaccaacttcacctcgaagaactagaagcgatcctacaccaacaagcaaaatactacccgttcttcaaagaggcttacgacaaaataaaatcgctcgtaaccttccgtatcccatacttcgtgggcccactggcaaacggacagagcgactttgcctggctcaccaggaaagccgatggcgaaatacgtccctggaacatagaggaaaaggtcgacttcgggaaatcagcagtcgacttcatagagaaaatgacaaacaaagatacatacctaccaaaagaaaacgtcttacctaaacacagcctatactaccaaaaatacatggtatacaatgaactaacaaaagtacgctatatcgacgaccaagggaagacaaattacttctctggacaagaaaaacaacaaatatttaacgactacttcaaaaagaaacggaaagtatcaaagaaggatctagagcagttcctacggaacatgagccacatcgagtcgccgacaatcgagggactcgaagacagcttcaacagctcttatgcaacataccacgacctgctcaaggtcggaataaagcaagaagtcctggaaaaccccctaaacaccgagatgctggaggacatcgtaaaaatcctcacagtcttcgaggacaagcgcatgataaaggaacaactacaacaattctcagatgtacttgacggtgccgtcctaaagaaactagaaaggagacactacacaggctggggacgcctctcggcaaaactccttgtagggatccgagacaaacaatcgcacctcaccatccttgactacctaatgaacgacgacgggttaaatagaaacctaatgcaattaatcaacgacagcaacctgtcgttcaagagcatcatcgaaaaagagcaagtaagcacgacggacaaagacctccaatccatcgtggccgacctggccggaagcccggcaatcaagaaagggatcctccaatcactaaaaatagtagacgagcttgtaagcatcatgggatacccgccccaaacaatagtcgtcgaaatggcaagagagaaccagaccaccgtcaaaggaaagaacaacagccggcccagatacaagtcactcgaaaaggccataaaagagttcggaagccagatcctgaaagaacaccccacggacaaccaagaactacgcaacaacagactctacttatattacctgcaaaacggaaaagacatgtacacggggcaagaacttgacatacacaatctctcaaactacgacatcgaccatatagtaccccagagctttataactgataacagcatagacaacctagtcctcacatctagcgcgggcaacagagaaaagggcgacgacgtaccacccctggaaatagtgcgaaaacgcaaagtcttttgggaaaaactcttccagggcaacctaatgagcaagagaaagttcgactacctgaccaaggcagaacggggcggcctgaccgaggccgacaaggccacattcatccaccggcagctcgtcgagacacgtcagatcacgaaaaacgtcgccaacattctccaccaaaggtttaacaacgaaaccgacaatcacggaaataatatggagcaggtccgaatcgtgatgctgaaaagcgccctggtctcgcaatttcgcaagcaattccagctctacaaagttcgggaagtcaacgactaccaccacgcacacgacgcttatctcaacggagtcgtagcaaacaccctcctgaaggtgtacccgcaactcgagcccgagttcgtgtacggagaataccaccagttcgactggttcaaagcgaacaaggcgaccgcaaagaaacaattctacaccaacataatgctattcttcgcccagaaagagcgaatcatcgacgagaacggagagatactctgggacaagaaatatctagagacaatcaagaaagtcctcgactatcgtcagatgaatatagtcaagaaaaccgaaatccaaaaaggcgagttcagcaaagcgaccataaaaccaaagggaaactcctctaagctaatccctaggaaagaaaactgggaccccatgaaatacggcgggctggacagcccaaatatggcttacgctgtcataatagaacatgctaaaggcaaaaagaaagtcgttttcgaaaagaaaatcataagaatcaccatcatggaacgaaaagcgttcgaaaaagacgaaaagagcttccttgaaaaacaaggataccggcaaccgaaagtgctgaccaagctgcccaagtacacactgtatgaatgcgagaatggacgcagacgcatgctcgccagcgccaacgaggcacagaagggaaaccagcaagtccttaaggggcaactcataacgctactgcaccacgcgaaaaactgcgaagcaagcgacgggaaatcactagactacatagaatccaacagggaaatgttcggagaactcctggcacacgtatccgagttcgcgaaacgctacacactagccgacgcgaacctgtccaaaatcaatcaactcttcgaacagaacaaagacaatgatattaaagtcatagcacagagcttcgtcaacctgatggcatttaacgccatgggtgcccccgccagcttcaaattcttcgaagcgacgatagagcggaaaaggtacaccaacctaaaggaactcctaagcgccacaattatctaccaatcaatcacggggctttacgaagcgcgaaagagactagacggctga

SEQ ID NO: 6437 - RNA, 4005 nt, synthetic construct
  misc_feature 1..4005: note = Cas9 variant
  source 1..4005: mol_type = other RNA
atgaaaaacccgtacacaatcggccttgacataggcaccaacagtgtcgggtgggcggtcctaactaaccaatacgaccttgtcaaacgtaagatgaaagtggcaggaaatagtgacaaaaagcagatcaaaaagaacttctggggagtccgactgttcgacgacggacaaacggcagtcgaccgccgaatgaatcggacagcccggcgccgcatagaacgccgccggaaccgaatttcctatctccaggaaatattcgcagtcgaaatggccaacatcgacgcgaacttcttttgcagactcaacgacagcttctacgtggactctgaaaaacgtaactctcgacacccctttttcgcgaccatcgaagaagaagtagcctaccatgacaactaccgcacaatataccaccttcgcgaggagctcgtgaactcaagcgaaaaagccgacctaaggctcgtctacctagcactagcacacataattaaatatcgaggcaacttcctcatcgagggcgcgctggatacgaaaaacacatcggtcgacgaagtgtacaaacagttcatccaaacatacaaccaagtattcatgtcaaacatcgaagaaggagccctagccaaagtcgaagaaaatcttgaggtcgcatcaatactcgccgggaagtttacaaggcgagaaaaattcgagcgaatcctgcggctctaccccggcgagaaaagcacggggatgttcgcgcagttcatctccctcatcgttggcaataaaggaaacttccaaaaggtattcaacctcgtagaaaagacagacatcgaatgcgccaaggacagttacgaagaagacctggaggccctcctcgcgattatcggcgacgagtacgcagaactcttcgtcgcagccaaaaacacgtacaacgcagtcgtcctaagctccataatcacggtaacagctacggaaacaaacgcgaaactatccgccagcatgatcgaacgattcgacgcacacgaaaaagacctcggcgaactgaaagccttcatcaaactccatctgcccaaacaataccaggaaatcttcaacaacgccgctatcgacggctacgccggctacatcgacggaaaaacgaagcaagtcgatttctacaaatacctaaaaaccaccctcgaaaatgtagaaggagccgactactttatcacaaagatagaggaggaaaacttcctgcgcaagcagcgcaccttcgacaatggcgttattccccaccaactacacctcgaggaactcgaagccatcctacaccaacaagcaaagtactaccccttcctcagagaagactacgagaaaatcaaatccctcgttaccttccgaatcccatatttcgtcggacccctcgccaagggccaatccgagttcgcctggctgacaagaaaagcggacggagaaatacggccgtggaacattgaagaaaaggtagacttcggcaaatcagccgtagacttcatagagaaaatgacaaacaaggacacgtacctcccaaaagaaaatgtcctccccaagcactcactctgctaccagaagtacatggtctataacgaactcacaaaggtacgatacatcgacgaccagggcaaaacaaactactttagcggccaagaaaaacagcaaatcttcaatgacctgttcaagcaaaaacgcaaggtaaagaagaaagatctggaactattcctgcggaacataaaccacatcgaaagccccacaatcgaaggcctagaggacagcttcaacgcctcctatgccacataccacgacttattgaaagtaggtatgaaacaagaaagcctcgacagcccactgaatgccgaaatgctcgaggacatcgtcaaaatactaacggtattcgaggataaacggatgatcaaggaacaacttcaacagttctccgacgtactcgacggtgtagttctcaagaaactcgaaagacgtcactacacggggtggggcagacttagcgccaaactactcgtcgggatacgggacaagcaaagtcacctaacaattctcgactaccttatgaacgatgacggccttaaccgaaaccttatgcaacttatcaacgacagcaacctcagcttcaaaagtattatcgaaaaggaacaagtgagcacaaccgataaggatctccagagcatcgtcgcagacctggccggaagcccagcaatcaagaaaggcatactacaatccttaaaaatcgtcgacgaactggtcagtatcatgggatatcccccacaaaccatagtggtcgaaatggcccgcgaaaaccagactacagtaaaaggcaaaaacaacagccgaccccgctacaaatcgctggaaaaagcgatcaaagagttcggctctcagatcttaaaagagcacccaaccgacaaccaagagctcaaaaacaaccgtctctacctctactacttgcagaacggcaaagacatttacaccggccaggaactggacatacacaacctctctaactacgacatcgaccacatagtcccccagagcttcataacagacaacagtatagacaacctcgttctcactagctcagcagggaaccgcgagaaaggcggtgacgtgcctccgctcgaaatcgttcgaaagaggaaagtattctgggaaaagctctaccaaggcaacctgatgtccaaacggaaattcgactacctaactaaagccgaacgaggaggtctaacggacgcggacaaagcgcgattcatacaccgtcaattagtcgaaacccggcaaatcaccaaaaacgtcgccaacatcttacaccaaagattcaacaacgaaacagacaactacggcaatacaatggaacaagtacgcatagtcaccctaaaatccgcattagtctcgcaattcagaaagcaattccaattgtacaaggtcagagaggtgaacgactatcaccacgcacacgacgcctatcttaacggagtggtcgccaacacgctactcaaggtctacccccagctcgagccagagttcgtatacggcgaataccaccaattcgactggttcaaggcaaacaaggcaaccgccaaaaagcagttttacaccaacataatgcttttcttcgcccaaaaggagcgtatcattgacgaaaatggtgaaattctatgggataaaaagtacctggaaaccatcaaaaaggtactagactacaggcaaatgaacatagtcaaaaagaccgaaatacaaaaaggggagttcagcaaggccaccatcaagcccaaagggaacagcagcaaactgatccccaggaaagaaaactgggatccgatgaaatacggcggcttggactcacctaatatggcatacgccgtaataatcgaacacgcaaaaggaaagaagaaaatagtcatagaaaagaaactgatccaaatcaacataatggaacggaaaatgttcgagaaagacgaagaagccttcttagaggaaaaagggtaccgacaccccaaagtcctcacaaaacttcccaaatacaccctctacgaatgcgagaaaggacggcgcaggatgctcgcttccgctaacgaggcccaaaaaggtaaccaactcgtcctgagcaaccatctcgtcagcctcctgtaccacgcgaaaaactgtgaagcatctgacggaaaatcgctaaaatacattgaagcccaccgagaagcgttctcggaactcctagcccaggtctccgagttcgccacccgatacaccctcgccgacgccaacctatcgaaaattaacaacctattcgaacaaaacaaagaaggcgacataaaggcaatcgcacagtccttcgtagaccttatggtcttcaacgccatgggggcccccgccagcttcaaattcttcgaagccacaatcgaccgaaaaagatacactaacctcaaggaactgctatcgagcacgataatataccaaagcataacggggctgtatgaaagcagaaaacgactagacgattga

SEQ ID NO: 6438 - RNA, 4005 nt, synthetic construct
  misc_feature 1..4005: note = Cas9 variant
  source 1..4005: mol_type = other RNA
atgaaaaacccctacaccatagggctcgacataggaacaaattccgtaggctgggccgtactcaccgaccaatacgacctagtaaaacgtaaaatgaaagttgccggcaattcagacaagaaacaaatcaaaaagaacttttggggagtacgtctttttgacgaaggcgaaaccgccgccgaccgccgaatgaacagaaccgcccgccgccgcatcgagcggcgacgcaacagaataagttacctacaagaaatcttcgccctcgaaatggcgaacatcgacgccaacttcttctgtaggttaaacgacagcttctacgtcgattccgaaaaacgtaactcccgccacccattcttcgccacgatagaggaagaagtcgcctaccacaaaaattacagaaccatctaccacctccgagaggagctcgtaaactccagcgagaaagcggacctccgcctggtatatctagcgctcgcacacatcataaaataccgaggcaacttcctgatcgagggagcacttgacaccaagaacacaagcgtggacggtgtttacaaacaattcatacaaacctataatcaagttttcatctccaacatcgaagaaggtaccctagccaaaatggaagaaaacaccaccgtggcaaacatcctcgccggcaaattcactagaaaagaaaaacttgaacgcatactccaactgtatccaggcgagaaatccaccggaatgttcgcgcagttcataagcctcatagtcggctccaaaggcaacttccaaaaagttttcgacctcgtagagaaaacagacatcgaatgcgcaaaagacagctatgaagaagacctcgaagccctcctggccataataggcgacgaatacgcagaactattcgtagccgccaagaatacctacaacgccgtagtcctttccagcataataacagtaaccgacacagaaaccaacgcgaaactttctgcttccatgattgaacggttcgacgcgcacgagaaagacttaagcgaactcaaggcattcattaaactccacctcccaaagcaatacgaagagatcttcagcaacgttgcgatcgacggatacgcaggctacatcgatggtaagaccaagcaagtcgacttctacaagtacctcaaaacactgctcgagaacatcgaaggcgcagactacttcatcgccaaaatcgaagaagagaacttcctacgcaaacaacgcacctttgacaacggcgctatcccccaccagctacacctggaagaactagaggctatcctccaccagcaagcaaagtactacccattcctaaaagaagcctacgacaaaattaaatcacttgttacattccgaatcccatacttcgtcggccccctcgcaaacggacaatccgacttcgcctggctgacccggaaagccgacggcgaaatcagaccatggaacatcgaggaaaaggtcgacttcggcaagagcgccgtcgactttatcgagaaaatgacaaacaaggatacctatctgcccaaggaaaacgtcctgccaaaacactcactttactaccaaaagtatatggtgtacaacgaactcaccaaagtacgttacatcgacgatcagggcaagaccaattatttctccggccaggagaaacaacaaatcttcaacgactacttcaaacagaagagaaaagtctccaaaaaggacctcgaacaattcctacgcaacatgtcacatattgaatccccgacgatagaaggactagaagacagcttcaactcatcatacgccacgtaccacgacctcctcaaagtcggcataaaacaggaggtcctggagaatccactcaacatggagatgctcgaggacatcgtcaaaatcctcacagtgtttgaggacaagcgaatgatcaaagaacaactacaacaattctccggagtcctcgatggggcggtgctcaagaaattggaacgccgccactacacaggctggggccgcctctcggcaaaacttctggtgggtatccgggacaaacaaagccacctcactatactcgattacttaatgaatgacgacggcttaaaccgtaacctaatgcagcttataaacgatagtaaccttagcttcaagtcaattatcgagaaagagcaagtaagcactaccgacaaagatctacaatccatagtcgcggacctagccggatcccccgcaatcaagaaagggatactccaatccctcaaaattgttgacgagctagtaagcataatgggttacccgccccaaaccatcgtcgtagagatggcgcgcgaaaaccaaaccacagtaaaaggcaaaaacaacagccgaccacggtacaaaagcctggaaaaagccataaaagagttcggctcccaaatactgaaagaacacccgacagacaatcaagaactccggaacaacaggctctatctatattacctacaaaacggaaaagacatgtatacgggtcaagaactagacatccacaacctcagcaattacgatatcgaccacatcgtaccccaatcattcatcaccgacaacagcatcgacaacctcgtgctaaccagctctgctggaaaccgagaaaagggtgacgacgtacccccgctagaaatagtccggaagcgaaaggtcttctgggaaaagctctttcagggcaatctcatgagcaaaagaaagttcgattacctcacaaaggccgagagagggggcctaactgaagccgacaaggcgaccttcatacatcgtcaactcgtagaaacacgccaaatcactaaaaacgtcgcgaacatcctccaccaacgtttcaacaacgaaaccgacaatcacggcaataacatggaacaggtacgcatcgtcatgctgaagtccgccttagtctcccaattccgcaaacaattccaactctacaaagtacgtgaagttaacgactaccaccacgcacacgacgcctacctcaacggcgtcgttgcgaacaccctgctcaaagtatatccccaactggaacccgagttcgtatacggagaataccaccaattcgattggttcaaggccaacaaagccacagctaaaaagcagttctacaccaacatcatgttattcttcgcacagaaagaacgaatcatcgacgaaaacggtgaaatcctctgggacaagaaatacctagaaacaataaagaaagtactggactacaggcaaatgaacatcgtcaagaaaacagagatccaaaaaggcgagttttccaaagcaacgattaaacccaaaggaaactccagtaaactcatccctagaaaagaaaactgggacccaatgaaatacggaggtttagactcccccaacatggcctacgccgttatcatcgaacacgctaaagggaaaaagaaaatagtcttcgaaaagaagatcataagaattactattatggaaagaaaggcgtttgaaaaagatgaaaaatcctttctcgagaaacagggctaccgtcagccgaaagtattgacaaaactaccaaagtacaccctatacgaatgcgagaacggccgcagacgcatgctagccagcgccaacgaggcacaaaaaggcaaccaacaagtgctaaaaggccaacttattaccctgctccaccacgccaaaaactgcgaagcctctgacggaaagagcttagactacatagagagcaaccgcgagatgtttggcgagctcctagcacacgtctccgagttcgcgaagagatacacccttgcggacgccaacctcagcaaaattaaccaactcttcgaacagaacaaagacaacgacataaaagtcatagcccaatcattcgtcaacctaatggccttcaacgctatgggggcccccgcctcctttaaattcttcgaggcgactatcgagcggaaacgttacacaaacctgaaggagctcctcagagcaacaataatctaccaatcgatcaccggcctctacgaagccagaaagcgactcgacggctga

SEQ ID NO: 6439 - RNA, 4005 nt, synthetic construct
  misc_feature 1..4005: note = Cas9 variant
  source 1..4005: mol_type = other RNA
atgaagaacccgtatacaatcggcctagacatcggaacaaactcagtaggatgggcggttctaaccgaccagtatgatctcgtaaaaagaaagatgaaggtggcaggcaactccgacaagaaacaaattaagaaaaacttctggggcgtccgactattcgacgaaggggaaaccgcagcggataggagaatgaaccgaacggcaagacgccgcatagagcgccgccggaaccgaatatcctacctacaagaaatattcgcccttgaaatggcaaacattgacgccaatttcttttgccgcctaaacgactccttttacgtggattcggagaaaaggaactcacgccaccccttctttgcgaccatcgaagaagaggtggcctaccacaaaaactaccggacaatctaccacttgcgagaggagctagtcaactcctcagaaaaagctgacctccgactggtctacctcgccctcgcacacatcatcaagtaccgcggaaactttctcatcgaaggagccttagataccaaaaacacctcggtcgacggcgtgtacaagcagttcatacaaacatacaatcaagtattcatatccaacatcgaagaaggcaccctagccaagatggaggaaaatacgaccgtagccgacatactagcagggaaatttacgcggaaagaaaagctagaacgaatactccaattataccccggcgagaaaagtaccggtatgttcgcccagttcatcagcctcatcgtcggaagtaaaggcaacttccaaaaggtgttcgaccttgtagagaaaacagatatagaatgtgcaaaggactcctatgaagaagaccttgaagccctcctagcaatcatcggagacgaatacgccgagctattcgtggccgccaaaaacacctacaacgcagtcgttctaagctccatcatcacggtaacggacacggaaaccaacgccaaactatcggcctcgatgatagaacggtttgacgcccatgagaaagacctatccgagctgaaagcattcatcaagctgcatctacccaaacaatacgaagagatcttctcaaatgtggcgatcgacggatacgcaggatacatcgacggcaagaccaagcaagtagacttctacaaataccttaagacactactcgagaacatagagggagccgactacttcatcgccaaaatcgaggaggaaaactttctacggaaacaacgcactttcgataacggcgccatcccacatcagctgcaccttgaggagctggaagccattctgcaccaacaggccaaatactacccattcctcaaagaggcctacgacaaaatcaagtccctcgttacattccgcataccctacttcgttggccccctagccaacggccaaagcgacttcgcatggctcacccgcaaagctgacggggaaatccggccctggaacatcgaagaaaaagtagacttcggcaaatcagcggtcgacttcatcgagaaaatgaccaacaaggatacttacctccccaaagaaaacgtcctcccaaaacactcactatattaccaaaaatacatggtctataacgaactcacgaaagtccgatacatcgacgaccaaggcaaaaccaactacttcagcggccaggaaaagcaacaaatatttaacgactactttaaacaaaagcgcaaggtttcaaagaaagacctggaacaatttctacgaaatatgtcccacattgaaagccccacaattgaaggcctagaagactccttcaactcaagctacgcgacctaccacgatttactgaaagtaggcatcaaacaggaggtgctcgaaaaccccctcaacaccgaaatgctagaagatatcgtgaaaatactaacagtctttgaagacaagcgtatgatcaaggaacaactacaacagttctctgacgtcctggacggcgcagtcctcaaaaagctggaacgacgtcactacaccggctgggggcgcctttccgcgaaactcctggtcggcattcgtgacaaacaatcacacctcaccatactcgactacctcatgaacgacgacggactcaacaggaaccttatgcaactaatcaacgacagcaacctctccttcaagagcatcatagaaaaagaacaagtcagcaccacagacaaagacctccaaagcatcgtcgccgacttagccggcagcccggccatcaaaaaggggatcctgcagtcactcaaaatagttgacgagctagtcagcatcatgggctacccaccccagacaattgtcgtcgaaatggctcgcgaaaaccaaaccacagttaaaggcaaaaacaacagccgtccgcgctacaaaagtctcgaaaaagccattaaagagtttggttcccagatactaaaagaacaccccacagacaaccaagaacttcggaacaaccgactttacctatattacctacaaaacgggaaagatatgtatactggacaggagttagacatccacaacctctccaattatgatatcgaccacatcgttccccaatccttcatcacagacaatagcatcgacaatctagtcctgactagctcagccggcaaccgcgaaaagggtgacgacgtcccacctctcgaaatcgtccgaaagcgaaaggtattctgggaaaaactattccaagggaacctaatgagtaagcggaaattcgactacctgacgaaagccgaacgaggaggcctcaccgaagccgacaaagccacgttcatacaccgacaactcgtggaaacccgacaaataaccaagaacgtcgccaatatactgcaccaacgattcaacaacgaaacggacaaccacggaaacaacatggagcaagtgcgcattgtcatgctaaaatccgccctcgtctcacagttccgtaaacaattccagctctacaaagtccgcgaagtcaacgactaccatcacgctcacgacgcatacctcaacggcgtggtcgccaacacgctcctcaaagtttatccccagttagagccggagttcgtgtatggtgaataccaccaattcgattggttcaaagccaacaaggcaaccgccaagaaacaattctataccaacatcatgctgttcttcgcccaaaaagaaaggatcatcgatgaaaatggggagatcctctgggacaagaaatacttagaaacaataaagaaagtgctcgactaccgtcagatgaacatcgtcaaaaagacggaaatccaaaaaggcgagttcagcaaagctaccattaaaccgaaaggcaactcttccaaactgatcccaaggaaagaaaactgggatcccatgaaatacggcggcctcgactcaccaaatatggcatacgcagtaattatagaacatgcaaagggcaagaagaaagtggtcttcgagaagaaaattatccggataacgattatggagaggaaagcattcgaaaaagacgaaaaatctttcctagagaaacagggctacaggcaacccaaagtgctgaccaaactccccaaatacaccctctacgagtgcgaaaacggcagaagacgcatgctcgccagcgccaacgaagcccaaaaaggaaaccaacaggtactcaaaggacaactcataacactcctccaccacgctaaaaactgcgaggcatccgacgggaaatcactcgactacatagaaagcaaccgtgaaatgttcggcgaactattagcccacgtatccgagttcgccaaacgctacacgctcgcagacgccaacctctcgaaaatcaaccagttattcgaacaaaataaagacaacgacatcaaggtaatcgcccaatcgttcgtaaacctgatggcgttcaacgccatgggcgctcccgcctcctttaaattcttcgaagcgaccatcgaaagaaagcggtacacaaacctcaaggaactcctgagcgctacaatcatataccaaagtataaccggactctacgaagcacgcaaaagactagacggctga

SEQ ID NO: 6440 - RNA, 4005 nt, synthetic construct
  misc_feature 1..4005: note = Cas9 variant
  source 1..4005: mol_type = other RNA
atgaaaaacccttatactatcggtctggacataggcaccaactccgtcggttgggccgtcctcaccaaccaatacgacctcgttaaacggaagatgaaggtcgccggcaactccgataagaaacaaatcaagaaaaacttctggggagtccgactcttcgacgacgggcagaccgccgtcgaccgccgaatgaatcgaacagccagacgccgaatcgaacgccgacgcaatcgaattagctacctccaggaaattttcgcagtagagatggccaacatagatgcaaacttcttctgccgcctaaacgattctttctacgtggacagtgaaaaacgcaactcccgccaccccttctttgcaaccatagaggaggaagtcgcctaccacgacaattaccggaccatctaccacctcagagaggagctcgtaaacagctccgaaaaagcggatctccggctggtctaccttgcgctcgcccacatcataaagtaccgtggcaacttcttaatagagggagctctagacaccaagaacaccagcgttgacgaagtctacaaacaatttatacagacctacaaccaagtcttcatgagcaacatcgaagaaggggccctcgcaaaagtcgaagaaaacctagaagtagcgtccatcctcgccggcaaattcactcgccgcgaaaaattcgaacgaatcctccgtctataccccggcgagaaatcaaccggaatgttcgcgcaattcatcagcctcatagtcggaaacaaaggcaacttccaaaaagtgttcaacctggtggagaaaaccgatatcgagtgtgcaaaggattcatacgaggaggacctggaagcgctcctcgcgatcatcggcgacgaatacgcggagctattcgtcgctgctaagaacacctacaacgccgtagtcttatcctcgatcataaccgtaaccgcgacggaaaccaacgcaaaactcagcgcgtccatgattgagcgattcgacgcccacgagaaagacctaggcgaactgaaggccttcataaaactccacctccccaagcagtaccaagagatcttcaacaacgccgcgatcgacggctatgccgggtacatcgacggcaaaaccaaacaagtcgacttctataaatacctcaagacgacgctcgaaaacgttgaaggcgccgattactttatcactaagatcgaagaagagaacttcctacgaaaacaaagaacgttcgataacggggttatcccgcaccaactgcacctcgaagaactggaagccattctccaccaacaagccaagtactaccccttcctcagagaagactacgagaaaatcaaaagcctagttactttccgaatcccctacttcgtcgggccgctcgccaagggccaaagcgaatttgcatggctcactcgcaaagcagatggcgaaatccggccctggaacatcgaagaaaaagtagacttcgggaaatccgccgtcgacttcatcgaaaagatgaccaacaaagacacctatctgcctaaagagaacgtactacccaaacattcactctgctatcaaaagtacatggtatacaacgagctgaccaaggtgcgctatatagacgaccagggcaagacaaactatttctcgggacaagagaaacagcagattttcaacgacctatttaaacagaaaaggaaggtaaagaagaaagacctagaactatttctaaggaacatcaaccacatcgaaagtccgacaattgaaggcctggaggacagctttaacgcttcctacgctacgtaccacgacctcctaaaggtcggaatgaaacaagaaagtctcgattccccactgaatgcagaaatgttagaagacatcgtcaagatcctgaccgtgttcgaggacaagcgcatgatcaaggagcaactccaacaatttagcgatgtcctcgacggcgtcgtactaaagaaactagaacgtagacactataccggttggggaagactatcggccaaactactggtagggatccgggacaagcaaagccatctaaccatactagactacctaatgaacgatgacggccttaacagaaatcttatgcagctaatcaacgacagcaacctctcctttaaatcgataatcgaaaaggagcaggtaagcacaaccgataaggatctccagagcatcgtcgcagaccttgccggcagccccgcaattaagaaggggatcctacaatctctaaaaatagttgacgagctggtatctatcatgggatatccccctcagaccatcgtcgtagaaatggcacgtgaaaaccaaacaactgttaagggcaaaaacaactcgcgtccacgctacaagagcctcgaaaaggccatcaaggagttcggctcacagatcttgaaagagcacccgaccgataaccaagaattgaaaaacaaccgactatatctgtactacctacaaaacggaaaggacatctacactggacaggaactcgacatccacaatctgagcaactatgacatagaccacattgtgccccagagcttcataacagacaactcaatagacaatctagtcctaacctcaagcgccgggaacagggaaaagggcggtgatgtcccgcccttggaaatcgtccgcaaacgtaaagtcttctgggaaaaactgtaccaaggtaacctgatgtctaagcgcaagttcgactacctcactaaagccgaacgcggaggactcaccgacgctgacaaagcccgattcatacatcgccagctagtagaaaccagacagatcaccaaaaacgtcaccaacatcttacaccaacgattcaacaacgaaaccgacaactatggtaataccatggaacaggtccgcatagtaaccctcaaatccgcactcgtctcccaattcagaaagcaattccaactgtataaagtccgggaagtcaacgactaccaccatgcccacgatgcctacctcaatggcgtagtcgctaacacactactgaaagtctacccccagctcgagccagagttcgtctacggcgaataccaccaattcgactggttcaaagcaaataaggcgaccgctaaaaagcaattctacaccaacatcatgttattcttcgcgcaaaaggaacgtatcatagatgaaaacggcgaaatactgtgggacaagaagtacttggaaacaatcaagaaagtgctcgactaccgccaaatgaacatcgtgaaaaagaccgaaatacaaaaaggcgagttctccaaagccacgatcaagccgaaggggaactcaagcaaacttatccctcgtaaagaaaactgggatccaatgaaatacggcggtctcgactcaccaaatatggcttatgccgtcatcatcgaacacgccaaaggcaaaaagaaaatcgtaatagaaaagaaactgatacaaatcaacatcatggaacggaaaatgttcgaaaaagacgaagaagcattcctcgaagaaaaaggataccgccaccccaaagtcctaaccaaactgcctaaatacaccctgtacgaatgtgaaaaagggcgacgccgtatgctggcaagcgccaacgaggcgcaaaaggggaaccaacttgtactctcgaaccacctcgtctccctcctctaccacgctaaaaattgcgaggcctcagacgggaaatccctgaaatacatcgaggcacaccgagaagcattctcagaactactagcccaggtatcagagttcgcgacccgctacaccctggcagacgccaacctatccaaaattaacaatctattcgaacaaaataaagaaggcgacataaaagccatcgcccaatccttcgtcgacctcatggtattcaatgccatgggagccccagcgtctttcaagttcttcgaagcaaccatagacaggaaaagatacacgaacctcaaagaactactcagttcgaccattatctaccaatccataaccggactatacgagtcacgaaaacgactagatgactga

SEQ ID NO: 6441 - RNA, 4005 nt, synthetic construct
  misc_feature 1..4005: note = Cas9 variant
  source 1..4005: mol_type = other RNA
atgaagaaagaatacaccataggcctggacataggaacaaatagcgtcgggtgggcagtccttacagaaaactacgacctggtcaaaaagaaaatgaaagtctacggaaacacagaaacgaaatacctcaagaaaaatctctggggagtgcggctattcgacgaaggagaaacagccgcagaccgcagattaaaacgtaccacccgacgccgatattcacgccggcgcaacagaatatgtcggctccaagatttattcaccgaagaaatgaaccaggtcgacgccaacttcttccacagactacaagaatcgttcctagttccagacgaaaaagagttcgaacggcacgcaatattcggcaaaatggaagaagaagtgtcatattaccgcgagttccccacaatctaccatctgcgcaaacacctagccgacacgtcagaacaagccgatctccgacttgtctatctagccctagcccacatagtgaaataccgaggacacttcctaatcgaaggcgaactcaacaccgaaaacagctccgtcagtgaaacattccgaacgttcatacaagtgtacaaccaaatattcagagagaacgaagttccgctcgccgtacccgacaatattgaggagctattcagcgaaaaagtcagccgtgcaagaaaagtcgaagcaatcctatccgtttactcagaagagaaatccacaggcacgctagcgcaattccttaaactcatggtcggcaaccaaggacgattcaagaaaaccttcgacctagaagaagatggcatcatccaaatccccaaagaagaatacgaagaagaactcgagaccctcctagcaatcataggcgacgaatacgcggagatcttctcagcgacaaaaagcgtgtacgatgctgtcgcgctaagcggcatcctatcagtcaccgacggagatactaaagccaaactctcggcgtctatggtcgaacggtacgaagcccaccaaaaagacctagtacaattcaaacagttcataaggaaagaactgccagaaatgtacgccccaatatttagggacaactcagtttctgggtacgccggctacgtggagaactcgaaagtggtcacacaagcagagttctacaaatacataaagaaagccatagagaaagtaccaggagcagaatacttcctagagaaaatagaacaggaaacattccttgacaaacaacgtacatttaacaacggcgtaatcccacaccaaatacatctcgaggaactggaggcgatcatccagaaacaagccacctactaccccttcctagcagacaacaaagaagagatgaaacagttggtaaccttcagaataccgtattacgtaggacccctcgccgacggtaactcaccgttcgcttggttagagcgaatctcctcggagccaatccgacccggaaacctggcagaggtagtcgacatcaagaaaagtgcgaccaaattcatcgaacgcatgaccaacttcgacacctacctaccaaccgaaaaagtgctccccaaacatagcatgatctacgaaaaatatatggtatacaacgaacttacgaaagtctcttacgtcgacgaaagaggtatgaaccaacggttctcaggcgaagagaagaaacaaatcgtagaggaactgttcaaacagagccgcaaagttaccaagaaactactagagaaattcctcagcaacgagttcggcctagtagacgtggccatcaaaggcatcgaaaccagcttcaatgcaggatacggaacctaccacgattttctcaaaatcggaatcacacgagaacaattagacaaagaggaaaattcagagacactggaagagatcgtcaaaatactcacagtcttcgaagaccgcaaaatgatccgcgagcagctgaagaaatacacatacctcttcgatgaggaagtgttaaagaaactagagcgcaggcactacactggatggggacgcctaagcgccaaacttctcatagggataaaagagaaacgcacccacaaaaccatcctcgactacttgatcgaagacgacggaggtaaacaacccataaaccgaaacctcatgcaattaatcaacgacagcgacctctccttcaaatccgagatcgccgaagcccaatcagacatgaacaccgaggacctacatgaagtggtccaaaacctcgccggatccccagcaatcaaaaagggcatactccagtccctaaagatcgttgacgaactggtcgatatcatgggttccctacccaaaaacatcgtcgtagagatggcccgagaaaaccaaacgacgagccgaggacgcaccaactcaaacccgaggatgaaagccctggaagaagccatgcggaacttgcgaagcaacctactaaaggaatatccaacggacaaccaagcgcttcaaaatgaccggctctatctttattacctacaaaacggcaaagacatgtacacagggctggacctgagccttcacaacctctcatcctacgatatagaccacatagttccacagagctttaccacagacaacagcctagacaaccgcgtactcgtctccagcaaagaaaaccggggcaagaaagatgacgtaccatcaaaggaagtagtccaaaagaatataacgctgtgggaaacgctcaagaatagcaaccttatatcccagaagaaatacgacaacctaacgaaggggcttcgcggaggactaaccgaagacgacagagcacacttcattaaaagacagctagtagaaacaagacagataacaaagcacgtagcacgaatcctcgaccaacgattcaactcccagaaagacgaagaaggcaaaaccatccgagcagtacgggtggtgaccctaaagagctcactcaccagccagttccgaaagcaattcgccatacacaaggtacgagagatcaacgactaccaccacggacacgacgcctacctaaacggagtcgtcgccaatagcctactaagggtatacccgcagctgcaaccagagttcgtctacggcgactaccccaaattcaacgcctacaaagcgaataaggcaactgccaagaaacagctatatacgaacataatgaaattctttgcagaagacgccgtcatcatcgacgaaaacggagaaatactgtgggacaaaaagaatattgcaacagtcaagaaagtcatgtcgtacccacaaatgaatatcgtcaagaaacctgaaatccaaacggggagcttcagcaaagagacaataaaaccgaagggcgacagtgacaaactcataagccgaaaaaccaactggagccccaaattatacggcggcttcgactccccacaggtcgcctatagcgtcataatcacctacgagaaagggaaaaagaaggtccgagccaaagccatcgtcggaatcacaatcatggaacaaagcctatttaagaaagacccggtcagcctactcgaagagaaaggctacgccaacccagaagtactaatccacctaccgaaatatacactctatgaactggagaacggacgacgtcgcctcctcgcgtccgccaacgaagcacagaagggcaatcaactggtactacctgcatcgctcgtgacattactctaccatgcgaaacaagtcgacgaagactctggcaaatccgaagagtacgtaagagaacaccgagctgagttcgcagagatcctaaactacgtccaggccttctccgaaaccaaaatactcgcaaacaagaacctacagaccatactcaaactctacgaggagaacaaggaggccgacataaaggaaattgcagagtccttcgtaaacctaatgaaattttcagcatacggagcccccatggacttcaaattcttcggcaagaccataccacgctcacgatacacttcagtaggggagctcctctcagccacaatcataaaccagtccatcaccggtctgtacgaaaccagacgaaagctcgtcgattga

SEQ ID NO: 6442 - RNA, 4005 nt, synthetic construct
  misc_feature 1..4005: note = Cas9 variant
  source 1..4005: mol_type = other RNA
atgcgcaagccctacactataggcctcgatataggaacgaacagtgtcggatgggcggtcctcacagaccaatacaacctggtcaaaaggaaaatgaaagttgcaggctcagcggaaaagaagcagatcaaaaagaatttctggggcgtgcgactcttcgacgaaggggaagtggccgcaggccgacgaatgaacagaaccacaagaaggcgaatagaacggaggcgaaaccgcatcgcctacctacaggaaatattcgccgcggaaatggccgaggtagacgcaaacttcttttaccgactagaagactccttctacatcgagtccgaaaagcgccactcccgacaccccttcttcgctaccatcgaggaagaagtggcctaccacgaagaatacaagaccatataccacctacgtgaaaaactcgtaaacagcagcgacaaagcagacctcaggctcgtctacctagcactcgcccacataatcaagtatcgaggaaatttcctcatcgagggcatgctcgacaccaagaacacgagcgtagatgaagtctttaagcaattcatacaaacgtataaccaaatcttcgcgagcgacatagaggaagggtccctaaccaggctcgaggaaaacaaggaggtggccgaaatcctctccgaaaagctaacccgccgcgaaaaactcgacaaaatactcaaattatacacaggagagaaaagcacagggatgtttgccagattcatcaacctgatcataggcagtaagggtgacttcaagaaagtcttcgatctcgacgaaaaagccgagatcgagtgcgcgaaagacacctatgaggaggacctggaagccctcctcgccaaaataggcgacgaatacgcagagatatttgtcgcagcaaagagcacttataacgctgtcgtcctctccaatatcatcaccgtgacagacaccgagacgaaagccaaactcagcgcctccatgatcgaacgtttcgacaagcacgcaaaagacctaaaacggctcaaggcctttttcaaaatgcaactgccagaaaaattcaatgaggtctttaacgacattgagaaggacggctacgcaggctacatcgacggcaagacaacacaagaaaaattttataagtacatgaagaagatgctagctaacatagacggcgctgattacttcatcgaccagattgaggaggaaaacttcttaaggaaacaacggaccttcgataacggcaccattccacaccaactacacctggaggagctggaagccatcctgcaccaacaagcgaaatactacccgttcctacgcaaagactacgagaagattaggtctctcgtaacgttccgcataccatacttcatagggccccttgccaacggccagagcgacttcgcctggctgacgcgaaaggctgacggcgagatccgcccgtggaacatcgaagaaaaagtcgacttcggcaagtcagccatcgacttcatagaaaagatgacgaataaagacacgtaccttcccaaggagaatgtactaccaaaacacagcctatgctaccaaaaatacatggtctataatgagctgacgaaaatccgctacatcgacgaccaaggaaagacgcaccacttcagtggccaagaaaagcaacaaatattcaacggactcttcaaacaacagcgcaaagtcaaaaagaaagacctcgaacgattcctctacacaatcaaccacatcgaatctcccacaatcgagggtgtcgaagacgccttcaactcgtccttcgccacctaccacgacctacaaaagggtggggtaacccaggaaatcttagacaacccgctaaacgcggatatgcttgaagaaatagttaaaatcctaacggtattcgaggacaagcgcatgataaaggaacaactccaatccttcagcgacgtcctcgacggaacgatactaaagaaactggaaaggcggcactacacaggctgggggcgtttgtcagccaagctactcacaggtatcagagacaaacactcccacctgactattctcgactacctaatgaacgacgatggcttaaatcgcaacctcatgcagttaataaacgactccaacctgtccttcaagagcatcatcgaaaaagaacaagtctcaaccgccgacaagggaatccaaagtatcgtggcagaactggcagggagccccgccatcaaaaagggcatactacagtccctcaaaatcgtcgatgaactggtaggcatcatggggtatccgccacaaacgatcgtggtcgaaatggcgcgcgaaaaccaaacgactgggaaaggcaagaacaactccaaacccaggttcatctccctcgagaaggccattaaggagttcggcagccaaattctcaaggaacaccccaccgacaaccagtgtctcaaaaacgacaggctctacctctactacctacaaaacggaaaggacatgtacaccgggaaagaactagacatacacaacctatcaaactacgacattgatcacataatcccgcagagcttcatcacggacaacagcatcgacaatcgggtcctagtgagttccaccgcgaacagggaaaagggcgacaacgtgccactcctcgaagtcgtccgaaaacgaaaggccttctgggagaaactataccaagcaaaattaatgtcaaagcgtaaattcgactaccttaccaaagcagagcgcggcggactgaccgaagccgacaaagcgaacttcatccaacgccaactggtcgaaacacgacaaatcaccaaaaacgtagcaaatatactttatcaacgcttcaactgcaaacaggacgagaacggcaatgaagtagaacaagttcggatcgtcacgttaaagagcaccctagtgtcgcaattccgaaagcagttccaactatacaaagtccgagaagtcaatgactaccaccacgcacacgacgcctacctcaacggcgtagtggcgaacactctcctcaaggtgtacccacagctggaacccgagttcgtctacggcgactaccaccaattcgactggttcaaggcgaataaagctaccgcaaagaaacagttctacacgaatatcatgagattcttcgccaaagaaaaccaaatcatagacaaaaatggcgaaatactctgggacaacagatatctagacacgataaagaaagtactcagttaccgccaaatgaacatagtgaaaaagacggaaatacaaaaaggagagttcagcaacgccaccgtaaaccctaaaggaaactcgtcaaagctaataagccggaaggcggactggaacccaatcaaatacggcgggttcgacggcagcaacatggcctactcgatcgtgatagaatacgaaaagcgcaaaaagaaaacggtgataaagaaagaactcatccagatcaacatcatggaacgagtcgcatttgaaaaggaccaaaaggcgtttctcgaagaaaagggttactactcgcccaaagtactgacaaaaatcccgaagtacaccctatacgaatgcgagaacgggcgacgacgcatgctcggatcggccaacgaagcccaaaaaggaaaccagatggtgctaccaaatcaccttatgacccttctgtaccacgccaaaaactgcgaagccaacgacggggagtccttagcatacatcgagatgcaccgggaaatgttcgcagagctcctcgcctacatcagcgagttcgcaaagagatataccctggctaacgaccggttggagaaaatcaacatgttcttcgaacaaaacaagaaaggcgatatcaaagttatcgccaagagcttcgataaattaaaggtcttcaacgccttcggcgcccctcgcgatttcgagttctttgaaacgacaatcaaacggaagcgatactataatataaaggaactcctcaatgccacaatcatctatcagtcgatcaccggcctctacgaagccagaaaaagactcgaagattga

SEQ ID NO: 6443 - RNA, 4008 nt, synthetic construct
  misc_feature 1..4008: note = Cas9 variant
  source 1..4008: mol_type = other RNA
atgaaaaactacaccatcggcctcgatataggcaccaatagcgtggggtgggctgtcataaaagacgacctgaccctcgtccgcaaaaagatcaaaattagcggaaacacggataagaaagaagtaaagaaaaacctatggggctcgttcctgttcgagcaaggtgacacagcgcaggacaccagggtgaaacgaatcgcccgacgccgatacgaacggcgacgcttccgtattcgagaactacagaaaatattcgacaaatccatgggagaggtcgactcaaacttcttccaccgcctcgacgaatccttcctcgtcgaagaagacaaagaatatagtaaataccccatcttcagcaacgagaaagaagataaaaactactacgacaaataccccacaatctaccatctgagaaaagacctagccgacagcaaccaaaaagccgacctgcgcctaatatacctagccctcgcccacatgatcaagtatcggggccacttcctcatcgaaggcgacctaaaaatggacggaatcagcatcagtgagagcttccaagagttcatcgacagctacaacgaagtatgcgcacttgaagatgaaaacctagaaatcatatacaatgacgaactgctaacccagatcgaaaacatcttcaaacaggacatctcacggtccaagaaactagaccaagccatcgccctcttccaaggggtaaaacgtcagtcgctctttggaatattcctgactctcatagtcgggaacaaagcaaacttccagaaaatcttcaatctagaagacgatattaaactagacctcaaagaagaagactacgacgagaacctagaagaactcctgagtaacatagacgaagggtatcgagatgtattcctgcaagcaaagaacgtctacaacgcaatcgaactcagcaagatcctaaagaccgacggaaaagaaacgaaggcgcccctatcagcccagatggttgaactctacaatcaacaccgcgaagacctcaaaaagtacaaagactacatcaaggcctacttgccggaaaaatacggagagaccttcaaggacgccaccaaaaacggctacgcgggctatatcgacggaaaaacaagtcaagaagacttctacaaatttgtaaaagcccaactcaaaggagaagagaacggagaatacttccttgaggccatcgagaatgaaaacttcctgagaaaacaacggagcttctacaacggagtcatcccctaccaaatccacctacaagaactcacggctgtcctagatcaacaagaaaagcactactccttcctcaaggaaaaccgagataagatcatcagcctgctaacgtttcgcataccgtactatgtcgggccactagcaaagggggagtcacgcttcgcatggctcgaacgatccaacagtgaagagaaaatcaaaccctggaacttcgacaagatagtcgacattgacaagagcgccgaactcttcatagaaaacctaacctcaagggacacctacttaccagacgaacccgtcctccccaaaaggtctctcatatatcaaaaattcacaatattcaacgaactcacgaaaatcagctacatagatgagcgcgggatactccaaaacttctcctcccgagagaagatcgcgatcttcaacgacctcttcaaaaacaaaagcaaggtcaccaaaaatcaacttgtgaaatacatcgaaaacaaagagcaaatcatcgcaccggagattaaggggatcgaggatagcttcaacagcaattacagtacatacatcgacttaagcaaaatccccgacatgaagaaactactagagaaagacgaggacgagatactcgaagaaataataaaaatcctcaccatcttcgaagaccgaaagatgaggaaacgacaactcatgaagttcaaggataaactatcagaaaaagccatcaaccagctgagcaagaaacactacaccggctggggacagctatccgagaaactcatcaacggcattcgcgacgagcagtcaaacaaaacgatactcgactaccttattgaggacaacggttgcccgaagaacatgaaccgcaacttcatgcagctcataaatgacgacaccctctccttcaaggagaaaatccgcaaggcgcaagacatcaaccaggtaaacgacataaaagagatcgttaaagacctacccggctccccggccatcaagaaagggatataccagagcatccgcattgtcgacgagatcatccggaaaatgaaagaccgaccgaaaaacatcgtgatcgaaatggcccgtgaaaatcaaacaactcaagaaggcaaaaacaagtccaaagcccggctaaagaaaatccaggagggcctagagaaccttgacagcgtccatgtagaaaagcaagctctggacgaggaaatgcttaaatcaccaaaatactacctttactgcctacaaaacggcaaggacatatatacgggaaaggacctcgatattgggcaactccagacatacgacatagaccatatcataccaaggagcttcatcaccgacaactcgttcgacaacctagtcctcacaagctccaccgtcaaccgcggcaaactcgacaacgtcccaagtcccgacatagtccgccaacagaagggattctggaagcagctcctccgcgccggtctaatgtcccagagaaaattcaataaccttaccaaaggcaagctgaccgaccgagaccgacaacaattcataaaccgccaactggtagaaacacggcagatcaccaagcacgtagccaatcttctgtcccaccacctaaatgagaaaaaggaagtaggcgagatcaatatcgtactactcaaaagcgcactaacctcccagttcagaaagaaattcgatttctacaaagtgcgagaagtcaacgattaccatcacgcgcacgacgcctaccttaacggggtaatcgccctaaaactactcgaactatacccctacatggcaaaggacctaatttacggaaaatacagctaccaccgcaaaattgaaggcgacaaggccacacaagccaagtacaagatgtcaaacatcatcgaacgtttctcgcaagacctactggccaacccagacggcgaaatcgcctgggagaaggacaaggaccttaacacaatccggaaagtactctcctcgaagcaaatcaatatcataaagaaagcggaagagggaaaaggtcgcctcttcaaagaaacaataaattcgcggccatccaagaagacggaaaaacgcatcccaatcaagaacaacctcgatccgaacatatacgggggctacatcgaagagaaaatggcctactacattgccatcaattacctagaaaatggtaaaacaaagaaagccatagtcgggatatccataaaagataagaaagacttcgaaggccagaccaccgaatacctcggcaaaatcggattcaataaagcaagcatcatcaactcgttcaaaaactacactctattcgaactagaaaacggcagccggcgaatgatagtcggggcctccaaagaaaacgacagcaaaggggagctccagaaaggcaaccagatgtacctcccacaaaacttacttgaatttgtataccatctaaagcactacaacgaagacgaaacatcccacaaattcatcgtcgagcacaaagcctacttcgacgaactcctcaactacattgtggagttcgcaaataaatacctcgaacttgagaactcgatcgagaagatcaaggacctctaccacgggaaaggcccagacgtcgaagaaaaggagctagtcgagagcttcattaacctactagccattactaaatgcggaccagccgccgacataactttccttggagaaaagatctcaaggaaaagataccggtccaccaactgcctctggggatcagaagtgatattccaatcacccacagggctctacgaaactcgactacgcctagaatga

SEQ ID NO: 6444 - RNA, 4011 nt, synthetic construct
  misc_feature 1..4011: note = Cas9 variant
  source 1..4011: mol_type = other RNA
atggacgacaattaccaactcatgcacgccaaaggcaaatacgggtacggcacaagaatctacagcgaaggacagacagccgcagaccgccggggcttccgaacgacccggcgccgcctgaaccgaagaaaatggcgcctccgtcttctccaggactttttcgaaccatatatcctcccccaggatgaagccttcttcatacgccagaagcagtccaacctcgttccccaagacacgaagaaacagtacccggaaagcgtccttttcgacgacacatcagacaaggacttctacacggaataccccacaatctaccacctcaggcaggccctcatgacggaaaacaggcagttcgacattcgcgaggtctacctcgcgatccatcacatcgtcaagtaccgcggccattttctaaacaacgcgcccgtgaaaaccttcaaaagcggcaaccttgacctggctatcaaattcaacgagttgaacgaagaatttaagtccgtttaccccgacctcgaactacaattcaacctagaccaaatcgacgaaatcaaaaagatcctgctagactccacaaaatcacgattcgacaggcagggcgaagcagtgaagctcatctacactgtatcagaggtaaaaaccatcgaaaaactacagaataaaatcgtcaagcaattcctcagcggaatactgggactgaatacacgattcgacgtcctcaccaatacggagtcggacgactccatgtggaaattctcactcgacagtgagtcaagtgacgacgccctcgatgagataatagcccaactagatgaccccgcgatacacgtcgtagaactggtgaatgagatccactccagtataaccctcgcaggcatagtacccgaaggacagggcctcagcgagtcgatggtcgagaaatatgaagcccacaaagcccatctgcaactcctaaaagcagtagaaaagctggtcgacaaaaaggccgccgacaaactagaagttgcctatgaccagtatatcaacggcaaagacagcaagcaattcatcaaagaggacttctataaggccgttcagagcgagatcaaaggagtcgccggtgacgaggtagccgaaataaaccagctcatcgaactggaccagttcatgcctaagcaacgcacgaaagagaacggtgccatcccccaccagctccaccagcacgaattggacgtcatcatcgagaaccaaagcaaatattacgattggctaggagagaaagtcggcaacgaatacaagctagacaaactggtcagcttccgagttccctactacgtggggccactcgtcgacaccgcctcaaaagagaagaaagacgaaacacgattcgcctggatggtacggaaaaacccagagtcgaccgaagccattacaccgtggaactttgaagacatcgtcgacaaaaacgcctctgcggaaaacttcataaagcgaatgacaaccaaggacaaatacctcttgaacgaagacgttctgcccaagtgcagtctactcacccaggacttcgaagtgtacaatgaacttaacaatatacgcgtcaacggggagaaattcacagccgagcagaagcaattgatccacgacgagctgttcaccaaacatgccagcgtatccataaaacaactaaaagacttcttagtctcagaattaatgtacgtccgtgacaacctcaaagtggaaggtctagcagacgaaaagaaacttatgagctcattatctacacaattcgactaccagaaaataatccccgaccaaatcaatgacgtaaaataccgcgaagacatcgaacaaatcatagaatggtccacaatattcgaggacgctgcaatattcaagaccaaactaaaagaaatcgactggctcaccgacgaacaacgaaataagctcgcgaacaaacggtacagaggctggggatccctcagcaaacggcttttagcctgcctagtagacgaaaacggccaacgcataatagacatactacgggactcgagcgacaacttcatgatgatcgtaaacagaccggagttcaagcaagccatatttgacgagaacgccaatctcaccgagaccaatagcaaaaaggacatgttcgaaatgatcgacaatttctacacctcaccacaaaacaagaaagcaatccgtcaagtactcctcgtcgtgcaagacatacaaaatgcgatgggaggggtggcgccacaaaagatcttcatcgagttcgcccgcgaagacgaagtaaacggccgacgcaccaacagccgatattcgcaaattcgagaaatgtacagcaaagtcaccgacgacgttataaacaagaccgtccgcggggagctcgaagctaacaaaggcagtctcaacaaagagaaactattcttgtacttcctacagggcgggatagacctgtattcggggaagaccatcaacatcgacaacatatcctcgtacgacgttgaccacgtcctcccgcagagcttcattaaggatgactcaatcaacaacaaagtcctagtcaacgcaaaaggcaaccgcgtgaaaaacgacaacgtacccatggaactcttcggtgccaaaatgtaccccacatggaagagaatggttgacactggcattatgtccaaagccaaattcaagaacctcaccctcaacccggacaacgtagacaagttcaaagcagaaggattcataaaccgtcagctagtcgagacccggcaaatcatcaaacttgtagctcaaatactaaacgacaaactaggcgacgacacgaaaatagtatcagtgaaagcaaacctaacccacgacatgcgagtcttcttcgacttcccgaaaaaccgtaacgtcaacaactaccaccacgcctttgatgcatacttatccgctttcgttggcacctacctctacaaaaggtaccccaagttacagccttatttcgtatatggagagttcaagaaaatggataagttaaagaacatgaccagcttcgactttctacgcgacctgaaacacacggacaaagttgtcgacaaagacacgggcgaaatcatcgccgataagctcgcggtaataacaaacatgaacaaaatctacgacttcaagaaagtcctagtcacccatgaagtacacgaaaactcaggcgctatgtatgaccagaccctctacccggcaaaactagacaaatcactcggacgcaaaggagccaaacaactaatccccaaaaaggacgacatgcccacagccctctacggcggatacaccggctcaaaagacgccttcatgagcatcgtacgcctcaaaaagaaagacgaagtctactacaaagtcattgggatccctgtgcgcatcgccgactccgtacagcacggcaaagaggtcgacgtcgaagcactcacccaattcatagaaacaaagttcaccaaagaaaacctcaataaaaagaccggggagataacacgcaaagtagaatggttcgaattggtgctccccaaagtgctattcggacaggccgtattcgacggcggtcaacccttcatgctcggctcctccacttaccctcacaacctacgcgagctcgtgctcacaaaagacagcgtcaagaagatcgcaggcaaagagtcgaacaaaagctatctcgacgcatacgacgaaatcatggaggccatgaacaaatacttccctctatacgatacgaacaagttccgcgaaaaagtcatcgaaggccgatccaaattcatagatctcccagacaaagacgagtacgagaacaataagctagtccaggtgggaaagtcaaccataatagaccgaatgttcatcggcctgcacgcaaacgcggcacgaacagacctcaagaacatcgggatcaccaccccattcggattcatgcagcaggcttccggaatcaagttaaccaaggacaccgtcgtgctgtttcaaagtagtaccggcctcttcgagcgaaaggtcgccctgaaggacctctga

SEQ ID NO: 6445 - RNA, 4011 nt, synthetic construct
  misc_feature 1..4011: note = Cas9 variant
  source 1..4011: mol_type = other RNA
atgaccaaagactacaccataggactagatatagggaccaatagcgtcggttgggcagtactgaccgacgactaccaactgatgaaacgaaagatgtccgtgcacggtaacaccgagaaaaagaaaatcaaaaagaacttctggggcgcacgactattcgacgaaggccaaacggccgagttccggcgtacaaagcgcaccaaccgcaggcgcctcgctcgccgcaaataccgactatcaaagctgcaggacctcttcgcagaagaactatgcaaacaagacgactgcttctttgtccgccttgaagagtccttcctagttcccgaggaaaaacaatacaagccagcctccatcttcccgacgctggaagaagaaaaagaatactaccaaaaatatcccactatatatcacctccgccaaaaacttgtcgactccacagaaaaggaagacctccgactcgtttacctggcgctagcccacctcctcaagtaccgaggccacttcctttttgaaggttaccttgacacggaaaacacaagcatcgaagaatccttccgcgtatttctagaacagtacggaaaacagtcggaccaaccgctgattgtgcaccaaccggtactcaccatccttacagacaaactatccaagactaagaaagtcgaagagatcctcaaatactacccgaccgagaaaataaacagcttctttgcacaatgcctaaaactcatagtgggcaaccaggcaaactttaaacggatctttgacctagaggccgaggtgaaactacaattcagcaaagaaacgtacgaggaggacctggaatcattattagagaaaatcggagacgaatacctcgatatctttctacaggccaaaaaggttcacgatgctatcctactaagcgagatcatatcctctaccgtaaagcacacccaggccaaactaagtagtggcatggtagaacgctacgaaaggcataaagcagacctggccaaattcaagcaattcgttaaggaaaatgtcccccaaaaagcaaccgtattcttcaaagacaccaccaaaaacggctacgcgggatatatcaaaggtaagacgacccaagaggagttctacaagttcgtcaagaaagaactgtcaggtgtggtggggagcgagcccttccttgagaagatagaccaagaaaccttcctactcaagcaacgcacctacactaacggcgtcatcccacaccaagttcacctcatagaattgaaggcgattatcgaccaacaaaaacaacactacccgttcctagaagaagccggacctaagataatagccctcttcaaatttcgcatcccctactacgttggcccactcgcgaaggagcaggaagcatccagcttcgcatggatagagcgaaaaaccgctgaaaagatccacccctggaacttctcggaggtcgtcgacatagaaaaatccgccatgcgtttcatacagcgcatgacgaaacaagatacatacctaccgaccgaaaaagtgctacccaagaactccctgctctaccaaaaatacatgatattcaacgaactcacaaaggtatcctacaaagacgaacggggcgttaaacaatacttcagtggagacgaaaaacagcaaatctttaaacaactattccagaaggaacgcggaaaaataaccgtgaagaaactccaaaacttcctatatactcactaccacatagaaaatgcacacatattcggaatcgaaaaagcattcaacgccagctactcaacataccacgacttcatgaaactcgccaaaaccaaccaaaagtccatgcaagaatggctcgaacagcccgaaatggagcccatattcgaggacattgtaaaaatcctcaccatattcgaggaccgccaaatgatcaagcaccagctatccaaataccaagaagtcttcggagaaaaactcctaaaagagttcgccagaaaacactacacagggtgggggcgattcagcgcaaaactcatccacggcattcgcgacagaaagaccaataaaaccatcctcgactacctgataaacgacgacgacgtcccggctaaccgcaatcggaacctcatgcagctgataaacgacgaacatttgagctttaaagaggaaatcgcaaaagcaaccgtcttctccaaacataaaagcctggtcgacgtaatacaagacctgcccgggtcaccagccatcaagaaaggcatctggcaatccctaaagatagtcgaggaactaatcgctatcataggatacaagcccaaaaatatcgtcattgagatggcccgcgaaaaccagaaaactcatcgaaccaagccccgtctaaaggcgctcgaaaacggtctcaagcaaattggctccaccctcctgaaggaacaaccgaccgacaacaaagctctccaaaaagagcgcctctacctctactacctgcaaaacggccgagacatctacactggcgagccactcgacattgagaacctacaccaatacgaagtggatcacatcatccctcgctcctttatcgtcgacaacagcatagacaacaaggtcctggttgcatccaaacagaaccagaagaaacgcgacgacgtaccaaacaaacaaatcgtaaacgaacaacgcatattctggaatcaactaaaagaagccaaactcataagccccaagaaatacgcatacctaactaaaatcgaactcacgccggaagacaaagcccggttcatacaacgacaactcgttgaaacccgccagatcaccaaacacgttgccaacatcctacaccagagcttccatcaagaagaagaaggcaccgactgcgacggagtccaaatcatcacactcaaggccacactgacctcccaattccgccaaacattcggactctacaaggtacgcgaaatcaacccccaccaccacgctcacgacgcttacctgaatggcttcatcgccaacgtactactaaaacgctacccaaagctcgcaccagagttcgtatacggcaagtacgtaaaatattcccttgcgcgcgaaaacaaagcaaccgcgaaaaaggaattttactcaaacatacttaaattcctcgaatccgacgaacccttctgcgacgaaaacggtgagatctactgggagaagtcctaccacctcccacggatcaaaaaggtgctaagcagccaccaagtaaacgttgtgaaaaaggtggagcagcagaaaggaggtttctacaaagaaacggtaaacagtaaagaaaaacctgacaaactcattgagagaaagaacaactgggatgtaacgaagtacggtggcttcggatcccccgtgatcgcatatgcaatcgctttcgtatacgccaagggcaaaactcagaaaaagacacgggcaatcgaagggatcacgatcatggagcaagccgcgttcgaaaaggaccccaccacatttctgaaagacaagggattcccccaagtcaccgagttcatcaaactacccaagtacaccctcttcgagttcgacaacggccgaagacgattcctcgcctcccacaaagaaagccaaaagggcaacccgttcatcctcagtgaccaactcgtcacgctcctctaccatgcccagcactacgacaaaatcacctaccaagagagcttcgactatgtcaacacccacctctccgatttctcggcaatactcacagaagtgctcgcattcgccgaaaagtatacactagcagacaagaacatagaacgaatccaagaactatacgaagaaaacaaatacggcgaaatcagcatgatagcccagagcttcctccaactcctacagttcaatgcaataggcgctccggcagacttcaaattcttcggcgtcaccataccgcgcaaacggtacacgtcactaacggaaatctgggacgcaacaataatctaccaatcagtaacgggcctctacgagacccgaatccgcatgggggacttatgggccggggagcaatga

SEQ ID NO: 6446 - RNA, 4011 nt, synthetic construct
  misc_feature 1..4011: note = Cas9 variant
  source 1..4011: mol_type = other RNA
atgaccaaggactacacaatcggcctagacatcggcaccaacagcgtaggctgggccgtcctaaccgacgactaccagcttatgaaaagaaaaatgagtgtacacggcaacaccgaaaagaaaaagataaagaaaaacttctggggagcccggctgttcgacgaaggccagactgccgagttccgtcgaaccaaaagaacaaacagacggcgccttgcccgtcgaaagtaccggctttccaagctccaggaccttttcgccgaggaactctgcaaacaagacgactgctttttcgtcagactcgaagaatcattcctcgtcccagaggaaaagcaatacaagcctgcgtccatctttccaacgctagaggaagaaaaagaatactaccaaaaatacccaacaatctaccacttacgtcagaaacttgtggactcaaccgagaaagaagacctccgactcgtctacctggccctcgcccacctcctgaaatacagaggacatttccttttcgagggcgacttagacaccgaaaacacatcaatcgaagaatccttccgtgtctttttggaacaatactcaaaacaaagcgaccaaccgctaatagtccatcaacctgtacttaccatccttaccgataagctcagcaagaccaagaaagtcgaagagatactaaagtactaccccacggagaagatcaactccttcttcgcgcaatgcctcaagctaatcgtaggaaaccaagcaaacttcaaacgcatatttgacctcgaagcagaagtcaaactgcaattctccaaagaaacctacgaagaagacctggaatcactactcgagaaaatcggcgacgaatacctcgacatattccttcaagccaaaaaggtacacgacgctatactgctcagcgaaataatatccagcacagtgaaacacacaaaggcaaaactctcgtccggcatggtcgaacgctacgagcgacacaaagctgacctagccaaatttaagcaattcgtcaaggaaaacgtcccccagaaggctacagtcttcttcaaagacaccaccaagaatggatatgcaggatacatcaaaggaaaaacaactcaagaagagttctacaagttcgttaagaaagagctatccggcgtagtcggcagcgaacccttcctcgagaaaatcgaccaagaaacattcctcctcaaacagaggacctacaccaatggagtaattccccaccaggttcacctgatcgaactcaaagccataatcgaccaacaaaaacaacactacccattcctcgaagaagctggtccaaaaataatagccctcttcaaatttcgcatcccctactacgtcgggcctctggcgaaagaacaagaggcctcctcgttcgcctggatagaacggaaaacagccgaaaagatcaacccatggaacttctccgaagtagtcgacatagagaaaagcgctatgcgttttatccaacgaatgacaaaacaagatacgtatctacctaccgaaaaagtcctccccaaaaactcactcctctaccaaaaatatatgatcttcaacgaactaaccaaagtatcctacaaagacgagcgaggcgtaaaacagtatttttccggagacgagaaacaacaaatcttcaaacaactgttccaaaaagaacgcggaaagataaccgtaaagaaactccaaaacttcttatacacacactaccacatcgagaacgcacagatattcggcatcgaaaaagcatttaatgcgtcctactcaacataccacgacttcatgaaactggccaaaaccaaccagaaagcaatgcaagaatggctggaacagcccgaaatggaacctatcttcgaagacatagtcaaaatactcactatctttgaagaccggcaaatgataaaacaccaactaagcaaataccaggaggttttcggagaaaaacttctcaaagaatttgcacgcaaacactacaccggatggggccgcttctcggccaaactcatccacggcatacgggaccgcaaaactaacaaaaccatactggactatctcatcaacgacgacgatgtccctgcaaacaggaaccgaaacctaatgcagttaataaatgatgaacacctcagcttcaaagaggaaatagcaaaggccacagtcttcagcaaacataaatcactcgtggatgtaatccaagacctccccggctcccccgctattaagaaaggaatatggcaatccctgaagatagtggaagaattgattgccatcatagggtacaaacccaaaaacatcgtcatagaaatggcccgggaaaaccaaaagacacaccgcacaagccccaggctaaaggccctagaaaatggacttaaacaaattggcagcacgctgctcaaagaacaacctaccgataacaaggccctccaaaaagaaagactgtacctatattacctacaaaacggacgggacatgtacacaggggaaccgctggagatagaaaacttacaccaatacgaagtagaccacatcatccctcggtctttcatcgtcgataactcaattgacaataaggtcctcgtcgcctcaaaacaaaatcaaaagaaacgagacgatgtaccaaagaaacaaatcgtgaacgagcaacggatattctggaaccaattgaaagaagcaaaactgatctcccccaaaaagtatgcctatctgacaaaaatcgagctcacaccagaggacaaggcccgcttcatccaacgacagctagtcgaaacgcgacaaattacgaagcacgtggccaacatcttacaccaatcgttcaaccaagaagaagaagggactgactgcgacggggtccaaatcatcaccctgaaagccacgctgacaagccaattccgccagacgttcggactctacaaagtgcgagaaatcaacccccaccaccacgcccatgacgcctatctaaacggcttcatcgctaacgtgctgcttaagcgataccccaaactagctccggagttcgtctacggtaagtacgtaaagtactccctcgcacgcgaaaacaaggccactgcaaagaaagagttctattcaaatatactcaaattcctcgaatcggacgaacctttctgcgacgaaaacggcgaaatctactgggaaaaatctcatcacctcccccgcataaagaaagtactctcatcccaccaagtaaacgtagtcaaaaaggtagaacagcaaaagggcggattctacaaggagactgtcaactccaaggaaaaacccgacaagctcatagaacgtaagaacaactgggacgtgacaaaatacggcggcttcggttcccccgtaatcgcctacgccatcgccttcgtatacgccaaagggaaaacccaaaagaaaacccgcgcgatagaaggcataaccataatggaacaagccgcgttcgaaaaagatcccacgaccttcttgaaagagaaagggtttccacaggtcaccgagttcataaaattgcccaaatacaccttattcgaatttgataacggccgacgcaggttcctggcaagccacaaggaatcccagaaaggcaacccattcatcctctccgaccaacttgttacccttctttaccacgcccaacactacgacaaaatcacctaccaagaatcgttcgactatgttaacacgcacctctcggacttttcagcgatcctaacggaagtactcgcgtttgcagaaaaatacaccctggccgacaagaacattgaacggatccaggaactttacgaggagaacaaatacggagagacgtccatgatcgcccagagcttcctccaactcctccaattcaatgcgatcggagcccccgctgatttcaaattcttcggagtcaccataccacgaaagcgctacacctccctcaccgaaatttgggacgccaccatcatttatcagagcgtcactggtctatacgaaacccgcatccggatgggcgacctctgggccggggaacaatga

SEQ ID NO: 6447 - RNA, 4014 nt, synthetic construct
  misc_feature 1..4014: note = Cas9 variant
  source 1..4014: mol_type = other RNA
atgaagaacatgaagaaaccctacaccataggactcgacatcggcacgaactcagtgggctgggccgttctcaccgaccagtacgacttggtaaagcggaagatgaaaatcgccggcgactcggagaagaaacagatcaaaaagaatttctggggagtccgactcttcgacgagggccaaaccgcagccgatcgccgcatggctcgaaccgcgagacgccggatcgaacgtcgaaggaataggatcagttacctccaaggcatattcgccgaagaaatgtccaaaactgacgcaaacttcttctgcaggctgagtgacagtttctacgtcgacaacgagaagcgaaacagtcgacacccattcttcgcaacgatcgaagaggaagtcgaataccacaaaaactatcccacaatatatcatctacgagaggagctagtcaacagcagcgaaaaagccgacctccggctcgtatacctggcgctcgcacacataatcaaataccgcggcaactttctaatcgaaggggcacttgatacccaaaatacgagcgtcgacggcatctacaagcaattcatacaaacttacaaccaagtttttgccagcgggatagaagacggaagcctgaaaaagctggaggataacaaagacgtcgctaagatactggtggaaaaagtaacaagaaaagaaaagctcgaacgaatactaaaactctaccccggagaaaagagcgccggtatgttcgcccaattcataagcctgatagtaggcagtaagggcaacttccagaaacccttcgatttaatcgagaaaagcgacatcgaatgcgcgaaagactcctacgaagaagacctggaatcgctgctggcactaatcggggacgaatacgcggaacttttcgtggcagcgaagaatgcctatagcgccgtcgtgctctcaagtatcataaccgtcgcagaaaccgaaaccaacgcgaaactcagcgctagcatgatagagcgcttcgacacacacgaagaagacctcggagaactgaaggcattcataaagctccacttaccaaagcactacgaagaaatattttcaaatacagaaaaacacggctacgctgggtacatcgacgggaagaccaaacaagccgatttctacaaatacatgaagatgactttagagaacatcgagggcgccgactacttcatcgccaaaatcgaaaaggagaatttcctgcgaaaacagcgaacattcgacaacggcgccataccccaccaactacacctagaggaactcgaagcaattctgcaccagcaggcgaagtactacccgttcctaaaagaaaactatgacaagataaaatccctagtcactttccgaataccatatttcgtggggcctctggccaacggacagagcgagttcgcctggttgacccgcaaagcagacggggaaatccgcccctggaacatcgaagaaaaagttgacttcgggaaatccgccgtagacttcatcgaaaagatgacgaataaggacacgtatctcccaaaagaaaacgtgctccccaaacattccctatgctaccaaaaatacctagtatataatgaactgacaaaagtccgctacatcaacgaccagggcaagacgtcatacttttccggccaagagaaagaacagatattcaacgatctgttcaaacaaaagcgcaaggtcaaaaagaaagacctagaactattcctaagaaacatgagccacgtcgagagccccacgatcgaaggcctcgaagacagctttaacagctcctacagcacataccacgacctcctcaaagtcgggattaaacaagagatattagacaacccagtcaacacagagatgctagaaaacatagtcaaaatcctaaccgtattcgaagataaaagaatgataaaagaacaacttcaacaattctctgacgtattagatggggtggtactgaagaaactagaacgcaggcactacacggggtggggcaggctgtcagccaaactcctaatggggatcagagacaaacaatcacacttaactatcctggactacctaatgaatgacgacggattaaaccgcaacctcatgcaattaatcaacgactcaaacctatccttcaaaagcattatcgagaaggaacaagtcacaaccgccgacaaagatatacaaagcatagtagctgacttagcagggtcaccagcaatcaagaaagggatactacagagcctgaaaattgtcgacgagctggtgtccgtcatgggctatccccctcaaacgatagtcgtagagatggcccgcgaaaaccaaaccacaggaaaaggtaagaacaacagccgaccccgctacaaatccctcgaaaaagcgatcaaagagttcggatcacaaatactaaaggagcaccccaccgacaaccaggagttacgcaacaatcgactctacctatattacctacaaaatggcaaagacatgtacaccggccaggacctagacatccacaacctctctaactacgacatcgaccacatagtcccccaaagtttcatcaccgacaatagcatcgacaaccttgtcctgacctcctcagcaggtaacagagagaagggagacgacgttccacccctcgagatcgtacggaagcgcaaagtattctgggagaagctctatcagggaaacctcatgtcgaaaaggaaattcgattatctaacgaaagcagaaagaggagggctcaccgaagcagacaaagcgcgcttcatccaccgccagctcgtcgagacgcgccagatcactaaaaacgtcgccaacatactccaccagcgctttaactacgaaaaagacgaccacgggaacaccatgaaacaagtcagaatagtaaccctgaaatccgccctagtctcccaattccgcaagcaattccaactgtacaaggtccgcgacgtaaatgactaccaccacgcacacgacgcatatctaaacggagtagtggctaacacgctgctaaaggtatacccacagctggaaccagagttcgtctacggcgactaccaccagttcgactggttcaaagcaaataaggcaaccgcgaaaaagcaattctataccaacataatgttgttcttcgcacagaaggacagaataatcgatgaaaacggtgaaatactctgggacaaaaagtacctcgacacggttaagaaagtgatgtcgtaccgccaaatgaacatagtcaagaaaaccgagatccaaaaaggagagttcagcaaagccaccatcaagcccaaaggcaattcaagcaagctaatcagccgaaaaaccaattgggacccaatgaagtacgggggtctggactcacccaatatggcttacgccgtggtaatcgaatacgcaaagggaaagaacaagctagtgttcgaaaagaaaatcataagagtcaccatcatggagcgaaaagcctttgagaaagacgaaaaagcctttctagaagaacagggctaccgacaaccaaaagtcctggcaaaactgccgaagtacactctatacgaatgtgaggagggtcgcaggcgaatgctcgcaagcgcaaacgaggcccagaaagggaaccaacaagtgctcccgaaccatctcgtaaccctcctacaccacgtggccaactgcgaggtatccgatggaaagagtctcgactacatagaaagcaaccgagagatgttcgcggaactgctcgcacacgtatccgagttcgccaaaagatacaccctcgcagaagcgaatctcaacaagattaaccaactgttcgaacaaaacaaagaaggcgacatcaaagcaatcgcgcagtccttcgtcgaccttatggcattcaacgcaatgggggccccggcgtcgttcaaattcttcgaaaccacgatcgaaaggaaacggtacaacaacctaaaagagcttttgaacagcacaataatctatcaatccataacagggctatacgaaagccggaagcgactcgacgactga

SEQ ID NO: 6448 - RNA, 4014 nt, synthetic construct
  misc_feature 1..4014: note = Cas9 variant
  source 1..4014: mol_type = other RNA
atgaagaaattcgagaactactacttgggcctcgacataggcaccagctcgataggatgggctgtcacaaacagccaatacgacatcctcaaattcaacggaaagtacatgtggggaacacgcctcttccccgaggcaaacaccgcacaagagcgccgcattcaccgctcgagccggcgacgactaaagcgccgcaaggaacgaatccaaatcctgcaaatgctattcgacaaagaaatcgcaaaaatagacagcggcttcttccaacgcctcaaagacagcaaatattacaaggaagacaaaaccgaaaaacaaaccaactctatcttccatgacaaagactactcagacaaagagtatcaccaagacttcccaaccatctaccacctcagaaagttcctcctcgagggaaacaagccaaaggacatacgctttgtctacctagcgctgcatcacatcctcacccaccgagggcacttcctattcccagacatggaagtctcaaacgtcacagaattttcgaacatcttcagcgagctcaaacaatacctctacgatgaaatggatttagactttgagtggaagaacggaaagctaaatgaagttgaaaacatacttaaggaccggaacctcgcaaaatccgaaaaggagaaaaagctctgcggaataattgaactcgaagggaagatcgacaaccagcgcaaagcaatgatcgggatgatgtgtggctgcaagaagaaattctcagacctattccaaaatgaaaactaccgcgaactagagatcagctcgttctccttcgccgatagcagctacgaggagaaacgcgacgaactagaagggatcctcgccgagaacatactctgcctggactacctaaagacgatatacgactggggcaagctgagcgacatactacaaggagaggaatctatcagcgtcgcgaaagtaaaatcctacgaagaacaccagctcgatctcaaataccttaagaatatcctgaagctctacagccataaggaaaaagaaaacgtgttccgcaagaaagaaggcaaatacccaaaatacatatccggaaaactgtcccaagaagagttcaacaaaagcattaagaaaatccttgaggaaataaaatccgtgaaacaggaagaccgaaaagtcttcgacaccttacttaaacgagccagcaacaacctcctatgccccaagcaggttatcaaagaaaacggagtcataccttaccagatacataaattcgagctagagaaaattctaagaaacatggcagacttcttcccgatgcttaaagagaagaaagacggcaaaaccctctccgagaaaataatcagcgtgttcaccttccggattccgtactacgttggacccctcaaccaaaatagcgaccgcgcctggctcgtgaaaaacaaagatgaaaagatatacccgtggaacttcgaagaaatagttaaccttgaagaaagcgccgagaaattcattcagaacctcactaacaagtgcacgtacctagtgctcgaagatgtcctaccgaaaagctcaatcctctattctaaattcatggtactcaacgagcttaacaacctcaaaatcgatggggaggcaatctcagtagacctcaagcagaaaatatacctcaacctcttccaaaaatacaagaaagtcactctgaagaaactcaaagggtacctaaaaagtgaaaacattctaatcgacacctccacccaaatcacaggcatcgacggtgacttcaaaagctccctcggctcatacttagatttctacaacattctcggtgacaaggtgaaaacagacttcggaaagaaactaatagaaaattgtatcctgtggataaccctctacacaggcgaaaagaaacttttaaagaataaaatcatcgcgaactacaaaggtgaactaagcgaagaggagatcaagaaaattgtcaacctcaaatacaaagactggggccgcctgagctacgccttcctagaagagatccagagcgcgtccctcgagaccggagaactccgcaacataatccagatgatgtgggagacaaacaacaatctcatggagctcctttcctccaactatcaattcctatccgaaatagaaaaacgaaactccgtcgtcgccataggaaaggagttcaactacgaaaccatcttaggcgactcctacgcctctcccagcgtaaagcgaatgatatggcaatctctcagcgtcgtggacgaaatcaaaaagatcatgaagaaagccccaaagaaaatcttcatcgaaatggcccgccaagaggacatgaagaaagaaagaaaagaatcccgtaaaagtacattcttgacgctctataaatcaatcaaagaagaaggccgcgactggatcaaggaaatcgagaactggagcgactcagagttccgatccaagaaactctacctgtattacacccaaatgggcaaatgcatgtacacaggagaaaagatctcccttgaccagctattcaacaaaaacatctacgacatcgaccatatatacccccgctcaaagaccaaggacgactcaatcgaaaacattgtcctcgtgaaacggaacattaatgctaaaaagaccgacgagtaccccctggaacgcaacatccagcaaaagcagcacgatttctggaagatgctccacagtaagaaactaataggagacaagaaatatgagagactcactcgaaccacagagttcaccgacgaggaactctccgactttatcgcacggcaattagtagaaaccagacagtcgactaaaatcgtcgcggacatacttaaaaacctattcccagaaacgaaaatcgtctacgtcaaggccaacctcacatcagacttcaggaagaactttaagatactcaaatcgcgcgacattaacgactaccaccacgcccacgacgcctacctaaatatcgtaaccggcaacgtctacaacataaaattcacggacaaccccagaaacttcataaaggacaagaaactggaaggcaagaaatacaacttaaaagtagagaaaatcttcgaataccggaaggaaaacgagagcttctggaaccccaaaaccatggtcactaagatcgaaaactacatctttaaaaagcgcccccagttcacccgctactcgtttgagcagcatggcggattctttgaccaaaacatagtcgacaaagagagctgcaaaaagggcaccggatacatccccataaaaagctccaacgccatactttacaacaccagcaagtatggaggatacggatctgttacaggtacctacttcttccttgtagagcacaccatgaaaggcaagcgtatccgcacgatcgagatgatgcccctctacctgagcaaaaagattcactccaaagaggagctagaaaaatactgcaaagaaaaactcgagctacaaaagccctccgtacggctcgcacgcatcaagtacaacagcctactcaagataaacggattcccataccacatcacgggaaaaaccaacgactcgtactggatcatgtcggcgatacagctcctcctaagcaagaactattacgagtacctcagaaaactatatatcttctgcaaagaagaacgcctggaagaagagatagtcggcgaaaagaacatcaagctctatacctgcatactagaaaaactggaaaaatcaatctactcccacaaactccttaacatcaattacaacggtaaatctaaaaatcttaaggacatactggaatccgagaaggaaaatttcctgctactaagcgagaaaaagcaggcgcagatactcatagaaatcttcacgctactcgaaagcaacaacttcggcgcgaacctcgagtccttcggctgtggcaagaaatgcggcatcacgaaaatcaacaaaaatatagacaaactagaagaggtgctactcataaaccaaagccccaccggccttttcgaaaactcgatagacctcaagaaagtatga

SEQ ID NO: 6449 - RNA, 4014 nt, synthetic construct
  misc_feature 1..4014: note = Cas9 variant
  source 1..4014: mol_type = other RNA
atgaagaaagactatgtaattggactagacatcggaaccaacagtgtaggatgggcagtaatgaccgaagactaccaactggtcaaaaagaaaatgcccatctacggcaatacggagaagaagaaaattaagaaaaacttctggggcgtcagactgtttgaggaaggacacacagccgaagatcgccgcctgaaacgcaccgcgcgacgcagaatctcacgacgccgaaaccgcctcaggtacctgcaggccttcttcgaagaagcaatgaccgacttagacgaaaacttcttcgcaagactccaggagagcttcctagtccccgaagacaagaaatggcatcgacaccccatcttcgcaaaactagaagacgaagtcgcataccacgaaacctaccccacaatttaccacctaagaaagaaactcgcggactcctcagaacaagcagatctccgcctaatctacttagcgctcgcccacattgtcaaatacaggggacatttccttatagagggcaaactctcgacggagaatatctccgtgaaagaacaattccaacagttcatgatcatatacaaccagactttcgtcaacggcgaatcacgactcgtcagcgctccacttccagaaagcgtcctcattgaggaagaattgaccgaaaaagcatcaaggacaaagaaatccgagaaagtactccagcaatttccccaggaaaaagcgaatggactgttcggacaattcctcaaactgatggtcggaaataaagccgacttcaagaaagtcttcggactcgaagaagaagcaaaaataacctatgcctccgaatcatacgaagaagacctggagggcatcctcgccaaagtcggcgacgagtatagcgacgtctttctagccgccaaaaacgtctatgacgccgtcgagctgagtaccatccttgccgactccgacaagaaatcacacgcaaaactcagctcatctatgatagtccgcttcacggaacatcaagaagacctcaagaaattcaaacggttcatcagggagaactgccccgacgaatatgacaacctattcaaaaacgaacagaaagacggctacgcagggtacatcgctcatgccggcaaagtatcccagctaaaattctatcaatatgtaaagaaaatcatacaagacatcgcaggcgcagagtacttcctagagaaaatcgctcaagaaaacttcctccgcaaacaacgaaccttcgacaacggcgtcataccccaccagatccatctcgcggagctccaagccatcatacaccgacaagcagcctactacccattcctcaaagagaaccaagagaaaattgagcaactcgtcaccttcaggatcccatactacgtaggcccactctcaaagggcgacgccagcaccttcgcctggctgaagcgccaaagcgaagaaccaatcaggccctggaacctacaagagacagttgacttagatcagtcggccacagcattcatcgaacgaatgacgaacttcgacacgtacctcccttctgagaaagtactccccaagcacagcttattgtacgaaaagttcatggtcttcaacgaactgaccaaaatatcctacaccgacgaccgaggcataaaagcaaacttctctggcaaagagaaagagaaaatattcgactacctgttcaagacaagaagaaaggtgaagaaaaaggacatcattcaattctaccgcaacgaatacaacacagaaatagtcacgctgtcgggcctcgaagaagatcaattcaatgcctccttctccacctaccaagacctcctcaagtgcggcctaacccgagccgaactcgatcacccggacaatgcggaaaaactcgaggacataatcaagatactaaccatcttcgaagaccgacaacgcatcagaacgcaactctcgacgttcaaaggccaattcagcgccgaagtactcaagaaactcgaacgcaaacactacaccggctggggcagactatcgaagaaactgatcaacggaatatacgacaaagaatccggaaaaaccatactaggctatctgatcaaagacgacggcgtatcaaaacactacaacagaaacttcatgcagctcataaacgacagtcaactctctttcaagaacgccattcagaaggcccaatcctctgaacacgaagagacactctccgaaacagtcaacgaactcgcaggctcacccgctatcaaaaagggcatctatcagtccctcaaaatcgtcgacgaacttgtcgcaatcatggggtatgcccccaaacgcatagtagtagaaatggctagagaaaaccagaccacatctaccggcaaacggcgttctatacaaagactcaaaatagtagagaaagcgatggccgaaattgggtccaacttgctaaaggaacaacctaccaccaacgagcaactacgggatacaagactgttcctatactacatgcaaaatggaaaagacatgtataccggcgacgaactaagcctacacagactttcgcactacgacatcgaccacatcataccccaatccttcatgaaagacgactcactcgataacctcgtcctcgtaggctccaccgaaaaccgtggaaaatccgacgacgtcccctcaaaagaggtcgtaaaagacatgaaggcctactgggagaagctgtatgcggcaggcttaatcagtcagcgcaagttccagagactcactaaaggcgaacaagggggcctaaccctagaagacaaagcccacttcatccaacgtcaactggtagaaacacgccaaataacgaaaaacgtagccggcatactagaccagaggtacaacgctaactcgaaggaaaagaaggtccagatcatcacgctcaaagcctcactcacctcacaattccgatcgatattcggactatataaagtccgcgaagtcaacgactaccaccacgggcaggacgcgtacctaaactgcgtcgtggcaacaacgctcctcaaagtctacccaaacctggcaccagagttcgtatacggagaataccccaaattccaaacattcaaagaaaacaaggccacagccaaagcgataatctatacgaaccttctgaggtttttcactgaagacgaaccccgcttcacgaaggacggggaaatcctatggagcaactcctacctgaaaaccatcaaaaaggaactaaactaccaccaaatgaacatcgtcaagaaagtcgaggtccaaaaaggcggattcagcaaagaatccatcaagccgaaaggtccaagcaacaagctcattcccgtcaagaacggactagacccgcaaaagtacgggggatttgactccccgattgtcgcttacacagtactctttacacacgaaaaaggcaagaaaccgcttatcaaacaagaaatcctaggcatcaccatcatggagaaaacacggttcgaacagaacccgatactgttcctagaagaaaaaggattcctcaggcctcgtgtgctaatgaaactgcccaaatacacactgtacgaatttccagaagggcgacgccgcctactggcttccgctaaagaagcccagaaaggcaaccaaatggtgcttcctgaacacctcctcaccctcctataccatgccaaacagtgcctcctaccaaaccaatccgaatccctcacttacgtagaacaacaccaacccgagttccaagaaatactagaacgagtcgtagacttcgccgaggtccataccttagcaaaatcaaaagtacaacaaatcgtaaaactattcgaggccaaccaaactgccgacgtgaaagagatcgctgcaagtttcatccagctcatgcaatttaacgccatgggagcgcccagcaccttcaaattctttcaaaaagacatagaacgcgcacgctatacctccatcaaagaaatctttgacgccacaatcatatatcagagcacgacaggcctgtacgaaacccgcagaaaagtagtggactga

SEQ ID NO: 6450 - RNA, 4014 nt, synthetic construct
  misc_feature 1..4014: note = Cas9 variant
  source 1..4014: mol_type = other RNA
atgaagaaggactacgtcatcggtctagacatcggaaccaactcggtgggatgggcagtcatgacagaggactaccagctagtcaaaaagaaaatgcccatatacgggaacacggaaaagaagaaaataaagaaaaacttttggggcgtacgccttttcgaggagggacacaccgccgaggaccgccgcctcaaacgcacagcccgcagacgcatctcacgaagaaggaatcgcctacgctacctccaagccttcttcgaagaagccatgaccgacctagacgagaatttcttcgctcgcctacaagagtcattcctcgtcccagaagacaaaaagtggcaccgccaccccatattcgcaaaactcgaggacgaagtagcgtaccacgaaacctatccaacaatctaccacctccgaaagaagctcgcagactccagcgagcaagcagaccttcgattaatatacctggcactggcacacatcgtcaagtacaggggccactttctaatagagggaaagctctcaacagaaaacacaagcgtcaaagaccaattccaacaattcatggtcatatacaaccaaacattcgtgaacggagaaagcagactcgtttcagcacccctccctgaatcggtcctaatagaagaagaactcacagaaaaagcgtcccgcaccaaaaagtcagaaaaagtactccaacaattcccacaggaaaaggctaacggcctattcggccaattcctcaaactcatggtcggcaacaaagccgacttcaagaaagtcttcggtctagaagaggaggccaaaataacctacgcctcagaatcctatgaggaggacctcgagggtatcctggccaaggtcggagacgagtacagcgacgtcttcctagccgccaaaaatgtgtatgacgcggtagaactatcgaccatactcgccgactcggacaagaaatcacatgcaaaactctcgtcgtccatgatcgtccgtttcacagaacaccaagaagacctaaagaaatttaaacgcttcatacgagaaaactgcccagacgagtacgataatctattcaaaaacgaacagaaagacggatacgccgggtacatcgcacacgcaggcaaagtcagtcaactcaaattctaccagtacgtgaagaaaataatacaggacatagctggcgccgagtatttcctcgagaaaatagcgcaagaaaatttcctcaggaagcaacgtacgttcgacaatggtgtaataccccaccaaatccatctcgcggaactacaggctattattcacaggcaagcagcctactacccattcctaaaggagaaccaggagaaaatcgagcaactggtaacattccgcatcccatactacgtaggccccttgtccaaaggcgacgcctcaacattcgcatggcttaagcgacaatccgaggagccgatccggccctggaaccttcaagaaactgtcgatctcgaccagtcagcgacggcattcatagaacgcatgacgaattttgacacatacctcccaagcgagaaagtcctaccaaaacattcacttctctacgagaaatttatggtattcaacgaactaaccaaaatatcctacacagacgaccgcggtataaaagccaacttctcaggcaaagaaaaggagaagatattcgactacctattcaagactagacgaaaggtcaaaaagaaagacatcatacaattctaccgtaacgaatacaacacagaaatcgttaccctttccggcctagaagaggaccagttcaacgcctccttctcaacctaccaagatttactcaaatgcggattaacacgagcagaactcgaccaccccgacaatgccgaaaaattagaggacatcataaaaatccttaccatcttcgaagacagacagcgcatcagaacacaactatccaccttcaaaggccaattctccgcggaagttctaaagaaactagaacgcaaacactatactggttggggccgcctatcgaagaaactaatcaacggcatttacgacaaagaatcaggtaaaacaatcctcgactacttaatcaaagacgacggggtcagcaaacactacaaccgaaacttcatgcaattgattaacgactcacagctcagcttcaaaaacgccatacaaaaggctcaatcgtgcgaacacgaagaaaccctgtctgaaacagtcaacgaactcgcgggtagtccggccatcaaaaagggcatctaccagagccttaagatcgtagacgaactggtagccatcatgggctacgcaccaaaaagaatcgtcgtcgagatggcccgtgaaaaccaaaccaccagcacaggcaaacgcagatccatccaacggctaaagatcgtcgaaaaggcgatggcggaaataggctcaaacctcctcaaagagcaacccacaaccaacgaacaactacgcgacacccgacttttcctctattatatgcaaaacggaaaagacatgtacaccggcgacgaactctcgttacaccgattaagccactacgacatcgaccacattatccctcagagcttcatgaaggacgactcgctagacaacctcgtcctagtaggatcaaccgaaaaccgcggtaaatctgacgatgtacccagcaagaaggtcgtaaaagacatgaaagcatactgggaaaaactatacgccgcagggctaatatcccaacgcaaatttcagcggctgaccaagggcgaacagggtggcctcacccttgaggacaaagcccacttcattcaacgacagctcgttgaaaccagacaaataacaaagaacgtcgcaggcattttagaccaacggtacaacgcaaagtccaaagaaaagaaagtgcagatcattacgcttaaagccagcctcacatcgcaattccgatccatattcggcctctacaaagtacgagaagttaacgactaccaccacggtcaagacgcctacctcaactgcgtcgtcgccaccacactgcttaaagtgtacccgaacctagcccccgagttcgtctacggcgaataccccaagtttcaagccttcaaagaaaataaagccacggcaaagaccatcatctacaccaacctcatgcgcttcttcacggaggatgaaccccgcttcaccaaagactccgagatactatggagcaacagctatctcaaaaccatcaagaaagaactaaactaccaccaaatgaacatcgtcaagaaagttgaagtccaaaaaggaggcttctccaaagaatcaatcaaacccaaggggccctcaaacaaactaattcccgtcaaaaacggacttgatccccaaaagtacggtggatttgacagcccggtagtagcctacacagtactgttcactcacgaaaaggggaagaagcccctcattaaacaggaaatactagggataaccataatggagaaaactcggttcgaacaaaacccaatcttgttcctcgaggaaaagggattcctaagaccgcgcgtactcatgaaacttcccaagtacacactctacgagttccccgaaggtcgtaggcgcctcctagcaagcgccaaagaagcccagaagggcaaccagatggtcctcccagaacatctgctaacactactctaccacgccaagcaatgtctcctccccaaccaatcagagtcgctagcatacgtggaacagcaccaacccgagttccaagaaatcctggaacgggtcgtcgatttcgccgaggtgcacacactagcaaaatccaaagtacaacaaattgtaaaacttttcgaggccaaccagaccgctgacgtcaaagagatcgccgcctcattcatccaactcatgcaattcaacgccatgggcgcgccaagcaccttcaaattcttccagaaggacatagaacgagcccgttacacctcgatcaaggaaatcttcgacgctacgataatctaccaaagcaccaccggcttgtacgaaacaagacgcaaagtcgtcgactga

SEQ ID NO: 6451 - RNA, 4014 nt, synthetic construct
  misc_feature 1..4014: note = Cas9 variant
  source 1..4014: mol_type = other RNA
atgaagaaagattatgtcatcggcctcgacataggaaccaactccgttggttgggccgtgatgaccgaggactaccaactcgtcaaaaagaaaatgccaatatatggcaacactgagaagaagaaaatcaaaaagaacttctggggcgtccgcctcttcgaagaaggccacaccgccgaggaccgacgactaaagcggaccgcccgccgccgcatctcacgcagacggaaccgcctgcgatacctacaagccttcttcgaggaagcgatgaccgccctagacgaaaacttctttgcgcgactccaagaatcctttctggtcccagaagacaagaagtggcaccgtcaccccatcttcgctaaactagaagacgaggtcgcgtaccatgaaacgtatccaacaatataccacctacgcaagaagctcgccgactcatcagagcaggcagacctgcgcctcatctacttagccctggcccacatagtcaaatacagaggacacttcctcatcgaaggaaagctgtccacagagaatataagcgtcaaggaacaattccagcaatttatgattatctacaaccaaacattcgtgaacggagaaagccgcctcgtgagcgcgccactccccgaatccgtcctaatagaagaggaactaaccgagaaggccagccgaacaaagaaaagtgaaaaagttctccaacaattcccccaagagaaagcaaatggcctcttcggccaattcttaaagctgatggtcggaaacaaagcagactttaagaaagtgttcggactagaagaagaagcaaagatcacgtacgcttcagaaagctacgaggaagacctagaggggatactcgccaaagtcggagacgaatactcggacgtctttctagccgcaaagaacgtatacgacgcagtcgaactctccacaatcctcgcagattcggacaagaaaagccacgccaaactctcatcatcaatgatcgtgcgcttcaccgaacaccaagaagacctgaaaaacttcaaaagattcatccgcgaaaattgccccgatgagtacgacaacctattcaagaacgaacagaaagatgggtatgcgggctacatcacccacgccggcaaagtttcgcagctcaagttctaccagtacgtcaaaaagataatccaagacatagcaggcgcagagtacttcctagagaaaatagcccaggaaaacttcctccgcaaacaacgaacatttgataacggagtaatcccacaccaaatccacctcgccgagcttcaggcaattatacaccggcaagccgcctattacccgtttctgaaagagaatcaagagaaaatagaacagctagtcacgttccgcataccatactatgtgggaccccttagcaaaggagacgcgaacacttttgcctggctcaaacggcaatctgaagaaccaatacgcccctggaacctccaagaaaccgtcgacctcgaccaatccgccaccgccttcatcgagaggatgacaaacttcgacacctacctgccgtcagaaaaagtactcccgaaacactcactactctacgaaaaattcatggtctttaacgaactaacaaaaatctcatacaccgatgaccgaggaatcaaagcaaacttctcaggcaaagaaaaagagaagatcttcgactacctcttcaaaacacggaggaaagtcaagaagaaagacatcatccaattctaccgcaacgaatacaacacagaaatcgtcaccctctccggactcgaagaggatcaattcaatgcctcgttctccacctaccaagacctcttgaaatgtgggctgacccgagcagaactcgaccaccccgataatgcggagaaactagaagacatcataaagatccttaccatcttcgaagatcggcaacgcatcaggacccagctctcaaccttcaaaggacaattcagcgcagaagtcctaaagaaattagagcgcaaacattacaccggttggggtcgcctaagcaagaaactaattaacggtatctacgacaaagaaagcgggaaaacaatactcgactatctaatcaaagacgatggcgtcagcaaacactacaaccggaacttcatgcagctcattaacgactcacagctttcattcaaaaacgccatccagaaagcccaatcaagcgagcatgaggagaccctgagcgagaccgtgaatgagctcgcaggatctccagcgataaagaaaggcatataccaatcactgaaaatagtcgacgagctcgtcgcgatcatggggtacgcgcccaaacggatagtcgtcgaaatggcgcgggaaaaccaaacgacgtccactggaaaaagaagatcaatccaacgcctcaaaatcgtcgaaaaggccatggccgaaatcggtagcaacctactgaaagaacagccaacaacaaacgaacaactgcgtgacacacgcctgttcctatactacatgcaaaacgggaaggacatgtacacaggcgacgaactcagcctacaccgactcagccactacgacatagaccacataattcctcagagctttatgaaagacgactcgttagacaacctcgtactcgtcggaagcactgaaaatcgcgggaaatcagacgatgttccatctaaagaagttgtcaaagacatgaaagcatactgggaaaaactgtacgcggcgggcctcatctctcaacgtaagttccagcggcttaccaaaggggaacagggcggcctcaccctcgaagacaaagcccatttcatccaacggcagctagtggaaacgcgccaaatcaccaaaaacgtagccggcatccttgaccagcgatacaacgcgaaatctaaagaaaagaaagtacagatcatcaccctaaaagcgtccctcacatcacagtttcgatccattttcggactctacaaagtacgagaagtgaacgactaccaccatggccaagacgcctacctcaactgcgtggtcgccaccactctcctaaaagtctaccccaacctcgcccccgagtttgtatacggtgaataccccaaattccagacattcaaagaaaacaaagccaccgccaaagccataatctacaccaacctattacgattcttcacggaagatgagccacggttcaccaaggacggcgagatcttatggagcaactcgtatttaaagaccatcaagaaagagctcaactaccaccagatgaacatcgtgaagaaagtcgaagtccaaaaaggcggcttcagcaaagaatcaatcaaacccaaagggccctccaacaaactcatccccgtaaagaacggcctagatccacagaaatacggaggtttcgatagccccatcgtcgcctacacagtcctatttacacacgaaaagggaaagaagccgctaatcaagcaggaaatcctcggcatcaccatcatggagaagacccggttcgagcagaaccctatcctctttcttgaagaaaagggcttcctccgcccgcgcgtgctcatgaagctcccaaaatacaccctgtaccaattccccgagggccggcgacgcctcttggcctccgccaaagaggcccaaaaaggcaaccaaatggtcctaccagaacatttgctaaccctactctaccatgccaaacagtgcctcctccctaaccagtcagaatcgctggcgtacgtagaacaacaccaaccggaatttcaagaaattttagaacgggtcgtcgacttcgcagaagtccacaccctcgccaaaagcaaagtccagcaaatcgttaaactgttcgaagccaaccagaccgcagacgtcaaagaaatcgcagcctcgtttatccaactaatgcagttcaatgcgatgggcgcgccctcaacattcaagttcttccaaaaagacatcgagcgtgcccggtacactagcatcaaggaaatattcgatgctacgatcatctaccagtcaaccaccggcctgtatgaaacccgcagaaaagtagtcgactga

SEQ ID NO: 6452 - RNA, 4014 nt, synthetic construct
  misc_feature 1..4014: note = Cas9 variant
  source 1..4014: mol_type = other RNA
atgaaaaaggactacgtgatcggactggacatcggcaccaacagcgtaggatgggcagtcatgaccgaagactaccagctcgtcaaaaaaaaaatgcccatctacggaaatacggaaaaaaaaaaaatcaaaaagaacttctggggggtccgactgttcgaggagggacacacagccgaagataggaggctcaaacgaaccgcacggcgccgcatcagcagacgccggaaccgcctaagatacctgcaggccttctttgaggaggctatgaccgacctggacgaaaacttcttcgcgcgtctccaggaaagcttcctagtccctgaggacaaaaagtggcaccgccaccccatcttcgcaaaactagaagacgaagtcgcgtaccacgaaacatacccaactatctatcacctacgcaaaaagctggcggactccagcgagcaagccgacctccggctcatatacctcgcactcgcccacatcgtcaagtaccgcggccacttcctgatagaaggaaaactatccacagagaacataagcgtaaaagagcagttccaacaatttatgatcatatacaaccagacatttgtcaacggggagtcgaggctagtcagcgcccctctccccgaaagcgtccttatcgaagaggaactcaccgaaaaagcatcacggacaaaaaaatctgaaaaagtgctacaacaattcccccaagaaaaggctaacggcctgttcggccagttcctcaaactcatggtcggaaacaaagcagatttcaaaaaagtattcggattagaggaggaagcaaaaatcacctacgcatccgagtcttacgaagaagacctagaaggcatcttagccaaagtcggagacgagtactcagacgtctttctggcagccaaaaacgtatacgacgcagtagagctctcaacgatcctcgctgacagcgacaaaaagtcacacgccaagctcagtagctccatgatcgtccgctttacagaacatcaagaagacctcaaaaaattcaagaggttcatcagagaaaactgccccgacgagtacgacaatctattcaagaatgaacaaaaggatggatacgcgggctacatcgcccacgccggcaaagtctcccagctcaaattctaccaatacgtgaaaaaaatcatacaagacatcgcaggggccgaatacttcctcgaaaagatagcccaagagaacttcctccgcaaacaacgtacgttcgacaacggagtcatcccacaccaaatacacctcgctgaactccaagcgataatccatcgccaggccgcctactaccccttcctaaaagagaaccaggagaaaatcgagcagcttgttacctttcgcatcccctactacgtgggcccactatccaagggcgacgcaagcacatttgcctggctaaaaagacagtccgaagaacccatcagaccatggaatctccaggagacagtagacctcgatcaatctgcaactgccttcatcgagcgcatgacaaacttcgacacatacctgccctccgaaaaagtgctcccgaaacactccctcctttacgagaaattcatggtcttcaatgagctaaccaaaattagttacacagacgacaggggaatcaaagctaacttcagcggaaaagaaaaagaaaaaatcttcgactacttattcaagacccgccgcaaagttaaaaagaaggacattatccaattctaccgcaacgagtataacacagaaatcgtaacacttagcggtctcgaagaagaccaattcaacgcgagcttcagcacataccaagacctcctcaaatgcggcctgacccgcgcagaactcgaccatcccgacaacgccgagaaactagaagacattatcaagatcctaacaatcttcgaggacagacagcgtatacgcacccaactctcaacattcaagggtcaattctcggccgaagtactaaaaaaactcgagcgcaagcactatacaggctgggggcgcctatcgaagaaactcataaacggaatatacgacaaagaatcaggcaaaaccatactcggctacctcatcaaggacgacggtgtctctaaacactacaaccgcaacttcatgcaactaatcaacgattcccagctgagcttcaaaaacgccatccagaaggcccaatcctcggagcacgaagaaacgttatcagaaaccgtaaacgaacttgccggatcccctgccatcaagaaagggatctaccaatcactgaaaatcgtcgacgagctcgtcgcaataatgggctacgcgcccaagcgaatagtcgtcgaaatggcgagagaaaatcaaacaacttctaccggcaaaagacggagcatacaaagactgaagatcgtagaaaaagcgatggccgaaatcggctctaatctcctgaaagaacagcccaccacaaacgaacagctccgcgataccagactattcctatactacatgcaaaacggcaaagacatgtacacgggggatgaactctcactccaccgactaagccattacgacatcgaccatatcataccccaatcatttatgaaagacgacagtctcgataacctcgtcctggtaggttccacagaaaaccgcggaaagtctgacgacgtgcctagcaaagaggtcgtaaaggacatgaaagcgtactgggaaaaactatacgcagccggccttatctcgcaacgcaaattccaacgactcaccaaaggagaacaaggcggcttaactctggaagacaaagcccatttcatccaacggcaactagtcgaaacccgtcagatcaccaagaacgtggcaggaatacttgaccaacgctacaacgcgaactctaaagaaaaaaaggtccaaatcatcaccctcaaagccagcctaacctcccaattcagatccatattcggtctctacaaagtgcgagaagtgaacgattaccatcatggtcaggacgcttacctgaactgcgtggtcgccaccacactcctaaaagtttacccaaacctcgcacccgaattcgtctacggggaatacccaaaattccaaacattcaaagaaaacaaggcaaccgcaaaggcaataatatacacgaatctacttagattcttcacagaagacgaaccacgcttcaccaaagacggcgagatactttggtcaaactcctacctcaagacaatcaagaaggaacttaattaccaccagatgaacatagttaagaaagtcgaagtacagaaaggcggcttctccaaagaaagcataaagccaaagggaccctccaacaaactgatacccgtcaagaacggcttagacccccaaaaatacggaggattcgactcacctatcgttgcgtacaccgtattattcactcacgagaagggaaaaaaacccctcatcaaacaagagatcctcggcatcacaatcatggagaaaacaagatttgaacaaaaccccatcctgttcctagaagaaaaaggtttcctccgcccacgagtcctcatgaagctgccaaagtacacactctacgagttccctgagggccgaagaagactactggcatccgccaaagaagcgcaaaaaggtaaccaaatggtcctccccgagcacctcctaaccctcctataccacgccaagcaatgcctcctacccaaccaatcagaatcgcttgcatacgtcgagcagcaccaacctgagtttcaagagatcctcgaacgcgtcgtcgacttcgccgaggtacacacgctcgcaaaatccaaagtacaacagatcgtaaaactcttcgaggcgaaccagaccgcagacgtaaaagaaatcgccgccagctttatacaacttatgcagtttaacgccatgggcgcaccctccaccttcaaattcttccaaaaagacattgagcgcgcgcggtacacctcgatcaaagaaatattcgacgctaccatcatataccaatccacaacgggcctttacgaaaccagaagaaaggtcgttgactga

SEQ ID NO: 6453 - RNA, 4017 nt, synthetic construct
  misc_feature 1..4017: note = Cas9 variant
  source 1..4017: mol_type = other RNA
atgcaggactactacctaggactggacataggaacgaatagcgtgggatgggcggtaaccgacgagaactacaacttactacgcaagaaaggcaaagacctatggggcgtccggctattcaaagaagcgcaaccagcgacggaaagaagagggcatagaagcagccgcagacgaacaatacgtaaaagcctacggaaacaactgctccgggaactatttgaagaagaaattaacgcaatcgacaaagacttcttcctccgactcgacgagtccaaatactggctcgaggacaaaaagatagagggaaaatactcactcttcaacgacgaaaacttcacagacaaggactattacgaaaagttcccaacgatattccaccttcgaaaggcgctaatagagtcagacgacaaagaagatataagactgtactttctcgcaataaaccagatgatgaagagaaggggacactttctcatcgacgggaaactaagcaacgtggaggacatcacaccattcaaagagtgcattcaaaacctaataaacgaggaactagacacagagatagaaaccgaattttatgataaagccatcaaaatagtcagcgactactccctgaagaaaacggaaaagaaaaacctaatcaaggacttggtcaaagagacagattctatagaagactccaagaaaattatcaatatattcaaccttttaatatccggcaaatcgaaagtaaacgggatattcgacgacgaggaaatccttgagaaaatcaaggaagacaacaaggaagacttctatctcacatctgagaagtacgaagagaacctagaatatttttcgcagctgctcgactaccgattcgaactaatctcgagtctgaaaagcatctacgactacatcatcctgcaagaggtcctaaaaggcaagaaatatctcagctacgcgcaggtagaacgctacaagaaccacaaagaggacctcagaaaactaaagcagctcatcaagaaatacgacaaaaacgggaaaatatactaccagatattccgagacgaaaactttaaaaaggggtacgtcgcttacctcggttactacaagaagaacaagaagaacgtccctgtgaaaaagtgcgactacgacaccttctcgaagaacataaagagcaccctcgacaaaatctgcgataaagaagacccactgtacatcgaactcatcgacaagatcgaaaagggaggcttcctactgaaacaaatcgtcagcacaaactcggtgatcccgcaccaagtccacgaactagaactcgacaaaatactagaaaacctagaaaagaactacccctcgtttaaggaaatctcggacggcgtctccaaaatagacaaaatcaaaatgatcttcaacttccgcatcccctactatgtaggccccctcaacgactatcacaaagacaaagtaaacagcaacacctggatcgtgaaaaacgaaggatttgaaaacgaaaacatccggccatggaatttctctaaaatcgtcgacgagcacgcatgcgaagaagagtttataaagcgcatgatcaacgagtgtagttacattccaggcgagaaggtcctcccaaagtcatccttgctatattccgaatacatggtcctgaacgaactcaataacctacgcgtaaacggggacaagctcaacccaaagatcaaaaaggagatagtcgaaaacatctacaagaaagagagaaaagtaacgctcaagaaaatacggaactttctaatcatcaacaactacgtggacagcaaagtcgagttcagcggcctgtccgatggcataaaagccaacatgagctcgtacatcgacttcgcggaaatcctagacgacaacttcgacaacaacatggtggaagacctcattgaacagataacgatacacgtcggaaacgtcaaactcctcacagaaaagatatcaaacaagtatcccaacctagagaagaaacaaatcaacaaaattgttaaccttaaattcaaagactgggcccgcttctcccgcaaactgctcgtaggaatcgaaggcacagagaaggagacgggcgaaataaacacaataatagggttcctcagagaaacgaacgagaacttcatggagctcatgtcgaaccggtacactttctccgaggagatcagtgaaatcaaaaagaagtacataccaaacaaactttcgaaacaaatagttgacgacctgtacgtaagcccggccgtcaagaaaatgatctggcaagtcctgaacatcaacgacgaactgatcaaagtacttggcaaacaaccgaaaaagatcttcatcgaaatggccaggggaaaagaggaaaaacccgaagtcaaggactcgcgcaaaaacaagctgatagaactatacaaaaaccttggcaaggaaggcaaagagtggttaaaccgaatagaagacaagacagaagccgactttcgcaaccgcgctctctacttatattacacccaaatggggcgctgcatgtatacgggcgaaataatcgacatagagcgcctctacgacaaagaactctacgacctggaccacatcataccgagaaaaatgaagaaggacgacagcatccacaaaaacctggtcctagtaacgcgcaactcaaatcaatacgaaaagaaagacaactaccccgtccccgaggtcataaaaagtcgcgaaaatgtcaggcatctatggtacgcactcaagaagaaggggctaataacagaggaaaagtacaaccgactaaccaggataaacccgctgagcgacaaggaactcagcgaatttatagaaaggcaactggtagagacacgccaaaccacgaaggtagttaaggacctcttcgaaaattactacacagactctaaaatcgtcacagtcaaagcgggacttgtcagcgaactccggcgtgacttcgaagtactcaaatgccgcgaaatcaacgacctaaatcacgcccacgacgcattcctaaacatcatcgtgggagacgtgtggtcgaaaaagttcacatcaaatccatacaacttcgtaaagaaaaaccgggagaagtacacactgaacaacatatttacgaagaaccagaaggatctccgggggaacgaaatatggaactgtgcagaaggcaaaaagcgtatcattaaaaccttgaacaaaccatccgtcctattcagcgtggagaatttcgaacagaccggccaacttttcgaccagaacataataggcaaacaagactataaggagaagacatcatacgtcccaataaaaggagacgaacggctacaggacatatcgaagtatggaggctaccgaggcataagcggggcatacttcttcatcgtggagcacaccgaaaagaacaaacgagtcaaaacaatcgagtcactgcccatctatatgaaatcgtatgtcgaagaaaacgggctccttgacttctgcactaacgagatgaagctcgtcgatccaaaaatcatcgtaaagaagctaaattacaaatcagagatcatagtcgacggattcaaatacctaatctcagggaaaaccgaaaaccgcctcagcctggagaccaacgaatacctctattggaaccacacacaaaccaccgacataaagaaaatcctcaacataaatgagaaaatagagctggaaaaatacaacggcgacatcgaaagcgagagggaaaacatcataaaatacatccagatcatactcgaaaaattcaagctcaaaccattcatcaaacgacggaacctccccaatatagaaataaacttcgctgactacgagacagagaaactcctacagctcttagtaaacctgatcccgctaaccaccaagtacgtctcgcctgtcgacctaaccgtcatatcaggaagcaagtacgcaggaaaagtgctgatcccaaagaaaatcagcaacctgaacgaagtcatattcattagcaaatcaattaccgggatctacgaatcgcgacgtcgcattatatga

SEQ ID NO: 6454 - RNA, 4017 nt, synthetic construct
  misc_feature 1..4017: note = Cas9 variant
  source 1..4017: mol_type = other RNA
atgaaacaggaatatttcctgggcctggacatgggaacaggatcgcttggttgggcggtaaccgactccacctaccaggtcatgcgcaaacacgggaaagcactatggggaacccggctgttcgagtccgccagcacggcagaggagcgacgcatgttccggacagcccgcagacggctcgacagacggaactggcgcatacaagtcttacaagaaatcttctccgaagaaataagcaaggtagatccaggattcttcctccgcatgaaggaatccaaatactaccccgaagacaagcgagacgcagaaggcaactgcccggaactaccatacgccctcttcgtggacgacaactacaccgacaaaaactaccacaaagattatccgaccatctaccacctacgaaaaatgctaatggaaaccaccgaaatccccgacatcaggctagtctatctagtactccaccacatgatgaaacatagaggccatttcctgctctcgggcgacatatcccaaataaaagagttcaaatcaacctttgaacaactaatccagaacatccaagacgaagaactggaatggcatatatccctggacgacgccgcaatacagttcgtagagcacgtcctcaaagacagaaacctcacgcgcagtaccaagaaaagccggctcattaaacaactcaacgccaaatccgcatgcgaaaaagcgatcctcaacctcctcagcgggggcacagtgaaactgagcgacatcttcaacaacaaggaactcgacgagtcggagcgaccaaaggtgtcgttcgccgatagcggctacgacgactacatcgggatagtcgaggccgagctcgccgaacaatactacataatagcatcagcgaaagcggtatacgactggtctgtcttagtggaaatcctaggaaactccgtgtctatcagcgaggccaaaatcaaggtatatcaaaagcaccaagcggacctcaagaccctaaagaaaatcgtgcggcagtatatgacgaaagaggactacaaacgcgtgttcgtcgacacggaagagaaactaaacaactacagcgcctacataggcatgacaaagaaaaacggcaagaaagttgatctaaaaagtaaacaatgcacccaagccgacttctacgacttcctaaagaaaaacgtcataaaagttattgaccacaaagagattacccaagagatagaatcagagatcgaaaaagagaacttcctaccaaaacaggtcacaaaagacaacggcgtcatcccatatcaagtccacgactacgagctcaagaaaatcctcgacaacctgggaactcggatgcccttcattaaagaaaacgccgagaaaatacagcagctttttgaatttcggatcccctactacgtggggcccctaaaccgcgtggacgacggaaaagacggcaagtttacatggagtgtccgcaaatcagacgcacgaatctacccctggaatttcacggaagtgatcgacgtggaagcctccgcagaaaagttcatacgcagaatgacaaataaatgcacatacctagtaggcgaggacgttctcccaaaagacagcttggtctacagtaagttcatggtgctcaacgaactcaacaacctgcgcctaaacggagaaaagatatccgttgaactaaagcagaggatctacgaggagcttttctgcaagtatcgaaaagtcacgcgcaagaaactcgagcgataccttgtaatagagggcatagcgaagaaaggagtcgaaataaccggaatcgacggagacttcaaagcaagcctgacggcataccacgactttaaagagagactaaccgacgtacagctatcgcaacgcgcaaaagaagcaatcgtcttaaacgtcgtactcttcggagacgacaagaaactcctcaaacagcgccttagcaaaatgtaccccaacctaacaaccggccaattaaaaggaatctgttctctcagctaccaagggtggggaagactcagtaaaaccttcctggaagaaatcaccgtaccagcccccggaaccggcgaggtctggaacatcatgaccgcactctggcaaacaaacgacaacctcatgcagctcctctcacgcaactacgggttcacaaacgaagtcgaggagttcaacacactgaagaaagaaacagacctcagctacaaaacagttgacgaactatacgtctccccagcagtcaaacggcagatttggcaaacgctaaaagtcgtcaaagaaatacaaaaagtgatgggcaacgccccaaaacgagtattcgtggagatggcgcgcgaaaaacaagagggcaaacgatcggacagccggaagaaacagctggtcgagctataccgcgcctgcaaaaacgaagaacgcgactggataacagagctcaacgcccaaagcgaccagcaactccggtcagacaaattattcttatactacattcaaaaaggacgttgcatgtactccggcgagaccatccaactggacgagctctgggacaacacaaaatatgacatcgaccatatatacccacaatcaaaaactatggacgacagcctgaacaaccgcgtactcgtaaagaaaaactacaacgcgatcaaatcggacacctacccactatcgctagacatccaaaagaaaatgatgtcattttggaaaatgctccaacagcaaggattcatcaccaaagaaaaatacgtacggctcgtccgaagtgacgaactgtcagctgacgaactagctggcttcatagaacgccaaatcgtagagacgaggcagtccacaaaagccgtggcaacaatactcaaagaagcgctaccagataccgaaatagtatacgtcaaagcggggaacgtatcaaatttccggcagacatatgaactcctcaaagtacgagaaatgaacgacctccaccatgcaaaggatgcctatctcaacatcgtcgtcggcaacgcctacttcgtgaagtttaccaaaaacgccgcatggttcatccgcaacaaccccggccggtcctacaacctcaagcgcatgttcgagttcgacatcgaaaggagcggcgaaatcgcatggaaggcgggaaacaaaggaagcatcgtaacggttaaaaaggtaatgcaaaagaacaacatcctagtaactcgaaaagcctacgaagtcaagggaggcctcttcgaccaacaaataatgaagaaaggcaaaggacaagtacccatcaaaggcaacgacgaaaggctcgctgacatagagaaatacggaggctacaacaaagccgctggcacatacttcatgctagtcaaatccctagacaagaaagggaaagagatacgcacaatagagttcgtccccctgtatctcaaaaatcaaatcgaaataaaccacgaaagtgcaatccagtacctcgcccaggaacgaggactgaacagcccagaaatactcctatcgaaaatcaaaatcgataccctattcaaagtggacggatttaaaatgtggctctcaggccgcacaggcaaccaactaatcttcaaaggagcaaatcaactcatactgtcacaccaggaagcagctattctaaagggcgtggtcaagtatgtcaaccgcaagaatgaaaacaaagacgcgaagctatcagaacgggacggaatgactgaagaaaaactcctacaactctacgacaccttcctagataagctctcaaacaccgtttactcgatccggctcagtgcacagatcaagaccctcaccgaaaaacgagctaaattcatcggactctccaacgaagaccaatgcatagtcttaaacgaaatacttcacatgttccaatgccaaagcggctcggcaaacctgaaactaatcggaggacccggatcggccggcattttggtcatgaacaacaacatcaccgcatgcaaacaaatcagtgtcattaaccaaagtcctacgggcatctacgaaaaggaaatagatctcataaaactctga

SEQ ID NO: 6455 - RNA, 4017 nt, synthetic construct
  misc_feature 1..4017: note = Cas9 variant
  source 1..4017: mol_type = other RNA
atgacgaaaccatactcaatcgggctcgatataggcaccaattccgtcggctgggcggtcgtcacagacggatacaaagtcccggcaaagaaaatgaaagtgttaggaaataccgacaaaagccacatcaagaaaaacctcctaggcgcactcctattcgattccggcaacaccgccaaagaccgccgacttaagcgcacagcccgtcgccgctatacgcgacgaagaaacagaatcctatacctccaagaaatcttcgctgaagagatggcaaaggccgacgagagtttcttccagaggctgaacgaatcattcctcacaaacgacgacaaagagttcgactcccacccaatcttcggcaacaaagcagaagaagaggcccaccaccacaaattccccactatcttccatctacgaaaacacctcgcagactccacagagaaaagcgatcttcgcctcatttatctagcactcgcacacatgatcaaattccgtggccacttcctgatagagggccaactaaaagccgaaaacacaaacgtgcagaccctattcgacgacttcgtggaagtttacgacaagaccgtcgaagaatcacatcttagcgaaattagcgtttcgtctatattgacggagaaaatcagcaaaagtcgacgcctagagaaccttatcaaatactaccccaccgaaaagaaaaacactctattcggcaacctgatagcgctctcgctcggactgcagccaaacttcaaaacgaatttcaaactgagcgaggatgcgaagctacaattcagcaaagacacttatgaagaagacctcggcgaactacttggcaaaatcggcgacaactacgcagacctgttcatctcagcaaagaacctctacgacgctatcctactcagcggcatactgaccatagacgacaacaccactaaagcgccactctccgcaagcatgataaaacgctacgaagaacaccaggaagaccttgcacagctcaaaaagttcatccggcagaacctcccagaccaatattcagaagtgttcagtgacaaaacgaaagacgggtacgcaggctacatcgacggaaaaaccaatcaggaggcattttacaaatacatcaaaaatatgctaagtaagaccgagggcgccgactacttcctagacaagatcgaccgcgaagatttcctaaggaagcagcgtaccttcgacaacggaagcgtaccgcaccaaatccacctccaagaaatgcatgccatccttcgccggcaaggcgaatactacccattcctcaaagagaaccaagataaaatcgagaaaatcctcacctttaggatcccttattacgtggggcccctcgcacgcaaaggatcccgatttgcatgggcagaatacaaggctgacaagaaggtcacgccctggaacttcgacgacatcctcgataaggaaaagagcgccgaagagttcattacgagaatgacacttaacgacctctacctaccggaagaaaaggtactccccaagcacagcctagtgtacgaaacattcaacgtatacaacgagctaacaaaagtcaaatacgtgaatgaacagggcaaagcaatattcttcgacgctaatatgaaacaagaaatattcgatcatgtgttcaaggagaaccgaaaagtcacaaaagacaagctactaaactacctcaacaaagaatttgaagagttccgcatagtcaacctcacagggctcgacaaagaaaacaaggcttttaattcctcactcggaacataccacgacctccgcaaaatactcgacaagagcttcctggacgacaaagtcaatgagaaaataatcgaagacataatacaaactctaaccctcttcgaagatcgcgaaatgatccggcaacgcctacaaaaatacagcgacatattcacaactcaacaattaaagaaactagaacgacgacactatacgggctggggacgactcagcgccaaactcatcaacggcatacgagataaacaatccaataaaaccatccttgggtacctaatcgacgacggatactcgaatcgcaacttcatgcaactaataaacgacgactcgctaccgttcaaagaagaaatcgccagagctcaagtgatcggcgaaacagacgacctcaaccagctcgtcagcgacatagccggctcccccgcaatcaagaaaggcatactgcagagcctaaaaatagtagatgagctagtcaaagtcatgggccacaaccccgcaaacatcgtcatagaaatggcccgagaaaaccaaaccacagctaaaggtcgtagaagcagccaacagcgctacaaacgactagaagaagccatcaaaaacctggaccacgaccttaaccacaaaatactgaaagagcacccaacagacaaccaagcccttcagaacgaccgactctttctttactacctgcagaatgggcgtgacatgtataccgaggacccccttgacataaatcgcctatccgactacgacatcgatcacatcataccacagagctttatcaaggacgactccatagacaacaaggtactggtctccagcgccaaaaaccgcggcaagagcgataacgtgccctctgaagacgtggtcaaccgaatgcggccattctggaacaaactcctatcctgcggcctcatctctcaacgcaaatactcaaaccttaccaagaaagagctcaaaccagacgacaaagcaggatttataaaacgacaactcgtggaaacgcgacaaataaccaagcacgtcgcccaaatcctcgacgcccgcttcaacacaaaacgcgacgaaaacaagaaagtcatcagggacgtcaaaataatcaccctaaaaagcaacctagtaagccaattccgaaaagacttcaaattctacaaagtacgagaaatcaacgactaccaccacgctcatgacgcttacctaaacgcggtgatcggcaaagcactcttggacgtctacccacaactcgagccagagttcgtctacggagagtacccacacttccacgggtataaggaaaacaaagccacagccaagaaattcttctactcaaacatcatgaatttcttcaagaaagacgacatccgcacggacgagaacggcgagattgtctggaaaaaggacgaacacatctcgaacataaaaagggtcctgtcttatccccaggtcaacatcgtcaaaaaggtggagatccaaaccgtcggacaaaacggcggcctgttcgacgacaaccctaaaagcccactggaagtgaccccctcgaaactcgtacccctaaagaaagaactcaacccgaaaaagtatggcggttatcagaagccaacaaccgcttaccccgtcctgttaattaccgacaccaagcaattaatcccgatatccgtaatgaacaagaaacaattcgaacaaaacccagtgaaattcctaagggaccgcggataccagcaagtaggcaagaacgacttcataaagctgccaaaatacaccctcgttgacatcggggacggaataaaaaggctgtgggcatcctccaaagaaatccacaaaggcaaccaactcgtggtgagtaagaaatcacaaatcctactgtaccacgcacaccacctagacagcgacctaagcaatgactacctgcaaaatcacaaccagcaattcgacgttctattcaacgaaataatcagcttctcgaaaaagtgcaaactcggcaaggaacatatacagaaaatcgaaaatgtgtactcaaacaagaaaaactccgccagcatagaagaactcgccgaaagttttataaaactcctaggtttcacccaactcggggcgacgagcccctttaacttcctaggcgtcaagctcaaccaaaaacagtacaaaggcaaaaaggactacatactaccctgcacggagggaacgttgatccgtcaaagcatcacaggtctatacgagacccgagtagacctaagcaaaatcggggaggactga

SEQ ID NO: 6456 - RNA, 4017 nt, synthetic construct
  misc_feature 1..4017: note = Cas9 variant
  source 1..4017: mol_type = other RNA
atgcgagactactacataggcctagacttgggaacagggagtctgggatgggcggtgaccgacagggaatatgagattatgcgtgcccatgggaaagcactgtggggagtccgcctcttcgacagtgcaaacacagccgaggaaaggagaggattccgcaccgccagacgacgactcgatcggagaaactggagaatcgaactactgcaggaactgttcggggaagatataggaaaagtggacagcggcttcttcctccgaatgaaagagtccaagtacatgccggaagacaaaagagacgtcaacggcaattgccccaaactaccgtacgcccttttcgtcgaggacggctacaccgataaggactaccatcgccaattcccgacaatctaccacctccgcaaatggctcatggaaaccgaggagacgcccgacatccgactggtatacctagcactccatcacatgatgaagcaccgcggacactttctattcagcgggaacatagagaaaataaaagagttccaagaaacattcagacaatacatcggaaaaattagggaagaggaactggacttccacctctgcatcgaaggcgaggaactacgggaaacagaaaacatactgaaggacaaaaacctaacaagaagcgccaagaaaaccaggctcatcaaactgctgggggcgcacaccgcgtgcgaaaaggcagccctgaacctagtagcgggagggacggtaaagctaagcgacatcttcggaaacagcgaattagacgcatgcgagaaaccgaagctcagcttcgcagacgccggctacgacgactacgcaggcatgatcgaagacgaactgggagagcaacacgtaatcatagaaacggccaaagccgtttatgactggagcgtcctggccgacatcttaggagactaccgatgcatcagcgaagccaaagcagccgtctacgagaaacaccaaaaggaccttagacatctgaaagagctagtaaaagaaaacctcggccgagacgtgtacaaagaagtattcgtaaagaccaacgagaaactcccaaactactcagcctacatcggcatgaccaagaaaaacggagtaaaaagtgaaatggagggaaagcggtgcgatcggaaagcgttttacgactatttaaagaaaaccgtcgtaaacgcgatcccggacgagtcgaaaactgaatacctacgcaaagaaatggaaaccgagacattcctacccagacaggtgaccaaggacaacggcgtgatcccgcaccaggtacacctccaagagttagacgcaatcctagagaacttaagcggtaggatcccagcactaaaggaaaacggaagcaaaatacgagacatattcacattccgcatcccatactacgttggcccactgaacggcatagtaaaaggcggcgaacgtaccaactgggtcaggcgcaaaaaggctggcaggatctgtccatggaacttcgacgagatggtggacacaggcgcaagcgcagaagagttcatccgccgcatgacgagtaaatgcacataccttatccacgaagatgtactcccaaagaacagcatgctatactccaagttcatggtactcaacgaactgaacaacgtcagactaaacggagagccgataagcgtggaactaaaacagaaaacgtacgaagacctctttcagcgccaccgcaaagtcactcgaagacgactcacagactacatacgccgagaaggaatagccggacgagacgcggatataacagggatcgacggagattttaaaggatcactaacggcataccacgacttcaaagaaaagttgaccggctgcgaactgagccaagcagacaaagagaacatcatcctaaacataaccctcttcggagaagacaaagcgttactcaaaaagagactaggggcactttaccccgccttaacagagccacaaaagaaggcaatatgcgcgttaagctacaaagggtgggggcgattgagccaacgcctactagagggaatcaccgcaccagcccccgaaaccggggaaatctggacagtcatcagggcaatgtgggaaacgaacgacaacttaatgcaggtcctcagcgagaagtactgctttgccgcagcaatagacgaagaaaacgcgggggaagaattaaaagagatcacatacaaaacggttgaacaaatgaacgtaagcccggcggtgcggcgacaaatatggcagagcctccaagtgataaaagagatctgcaaagtcatgggcgggccgccgaagagagtcttcgtcgaaatggcccgggagaaaatggaatccaaaaggaccgaaagccgcaagaaacggcttatagacctctataagaaatgcagagaagaagaacgtgactggatagaagagttgggcaacaccgaggaaacgcgcctacggtccgacaagttgtacctctactacacacaaaaaggacggtgcatgtatagcggcgaagtaatcgagctagaggaactatgggataatcgcaagtacgacatcgaccacatctacccgcaatcgaaagtcatggatgacagcctcgacaacagggtcctggtcaagaaagaatacaacgccgacaaaacggacgaataccccataagagccgatatccgcggaaaaatgcgggcgttctggagaatcttgagagaggaagggtttatatcaaaagaaaaatacaaccgactcacgaggggtactggcttcgagccatcagagctcgcgggattcatagcacgtcaactggtcgaaacgcggcaaggaactaaggctgtagccagcgtcctaaagcaagtgttcccagaaaccgacatcgtatacgcaaaagcgcgagtggcaagccaattccggcaagagttcgatctgatcaaagtccgagaaatgaacgacttacaccacgccaaagacgcatacgtaaatatagtggtgggcaacgtctactacacgaaattcacctccaatgcggcgtggtatgtcaaggagcacccggggagaagttacaacctaaagaaaatgttcaccagcgaaagagatgtcgcacgcaacggagaaaccgcctggagagcagggaactccggcacaatagcaacagtcaaacgcgtgatggggaaaaacaacatactggtgacacgcagatcctacgaggtcaaagggggcttgttcgaccaacaactcatgaaaaagggcaaaggacaagtgcctatcaaaggacgcgatgaacgactcgcggacatcgacaagtacggaggctataacaaagcagcagggacctactttatgctcgcagaatcagaagacaagaaaggagccaaaatacgctccgtagaatacgtcccactctacctctgcaactgcatagaaaaagacgaagaggccgccaagaaatacttacaaaaagaaaggggactgaaaaatccccgcgtcctaatcgcgaaaataaaaatagacaccctattcaaagtggacggcttctacatgtggctcagtggacgaaccggaaaccaactcatattcaagggggcgaatcagctgatactgagcgaaccagatatgcggatactcaagaaagtcctcaaatatgtaaatagaaagaaagagaacaaaaacgccgtactcggcgaacatgaccaactacctgagacagacctgatccgtctttatgatgttttcctagacaaaatcgaaaacacagtctatcacgtgaggctgtcagcgcaacaagggacactcaccaaaaacaaagacacgttttgcgagttatccaacgaggacaaatgtatagtcctgtcagaaatactgcacatgttccaatgccaatccggcagcgcgaatctaaaactaattaagggtcccggcagcgccggaatattggtattaaacaacataatcagcaaatgcaaccaggtcagtataatccaccaaagcccgacgggaatctacgagcaagagatagacctcaaaaagatctga

SEQ ID NO: 6457 - RNA, 4020 nt, synthetic construct
  misc_feature 1..4020: note = Cas9 variant
  source 1..4020: mol_type = other RNA
atgaacaaagcctataccctaggactggacatcggcaccaactcggtcgggtgggcagtcgtgacggacgactacagactaatggccaaaaaaatgcccgtacactccaagatggagaaaaaaaagatcaagaaaaacttctggggggctcgcctgtttgatgaaggacagacagccgaagaacgacgcaacaagcgcgccaccaggcgacgccttcggagacgcaagtaccgaatacttgagctccaaaagatcttctccgaagaaatattaaaaaaagacagccacttcttcgcccgcctcgatgaatcattcctaatcccagaagacaaacagtacgcacgattcccaatttttcctacactgttagaagaaaaagcctactaccaaaactacccaaccatctaccacttacgccaaaaactggcagatagtaccgaaaaagctgatatacgcctggtctatctggccctcgcccacatgataaaataccgcggacacttccttttcgaaggagaactcgacacagaaaacacatccgtagaagagacattcaaagaattcatagacatatacaacgagcaattcgaggagggaataatcttctacaaggatatcccactaatccttaccgacaaactctcaaaatcaaaaaaagtagaaaaaatactacaatactaccctaaagaaaagacaacaggatgccttgcacaattcctcaagctaattgtcgggaaccaaggcaatttcaaacaagccttccacttagacgaagaggtcaaaatccaaatttctaaagaaacatacgaggaagacctcgaaaagctactacgcaaaagcaatgaggagatgatcgacgtattcctgcaagtaaagaaggtctacgacgcgatcctactcagcgatatcttaagcaccaagatgaaggacacgaaagcaaaactctccgccggcatgatcgaacgctatcaaaaccacaaaaaagacctggaagaactcaaacagtttgtccgagcacacctccacgaaaaagtcacagtcttttttaaagacagctctaaagacggatacgccggatacattgacggcaaaacaacccaagccgacttctacaaattcctcaaaaaggagcttaccggcgtacccggttcggaaccgatgctagcaaaaatcgaccaggagaactttctactcaaacagcgcacgccgacgaacggagtcatcccacaccaggtccacctcacggagttcaaggcaataatcgaccaacaaaagcaatactacccattcctagagaaatcaaaggaaaaaatgatacaactcctcacattccgtataccctactacgtcggtccacttgcccaagacaaagaaacctcctcctttgcgtggttggaacgaaaaaccaccgaaaagattaagccgtggaatgctaaggacgtcatcgactacggggcatcggccaccaaatttatacaacggatgattaattacgacacgtacctcccaaccgaaaaggtgctacccaagtactccatgctatatcaaaaatacaccatattcaacgaactcacaaaagtcgcctacaaggacgaccgcggaatcaagcaccaattcagcagtgaggagaaattacgcatcttccaagaacttttcaagaaacaacgccgagtcaccaaaaaaaagctacaacacttcctaagtgcgaactacaacatcgaagacgccgagatcctaggcgttgacaaggtctttaactcaagctacgccacataccacgactttctggaactcgcgaaaccttacaccgaaaaaatcatcgagctcctggaacagcccgagatggaagaaatgttcgaagacatcgtgaaaatcataacaatcttcgaagacagggaaatggtacggacacaactgaagaaataccagcggattctcggagaggagatcttcaaaaaactcgtaaaaaaaaagtacaccggctggggccgactgagtaaacggctgatcaacgggatcagagaccaaaagaccaacaagaccatactcgactacctaataaacgacgacgatttcccctataatcgcaatcgcaatttcatgcaactcataaacgacgaccacctaagcttcaaagaagaaatagccaaggagctaactcttagcgacaaacaatcgctactagaagtagtagaggccatacccggctcaccggcaataaagaaaggcatctggcaaaccctaaaaatcgtggaagagctgatcgcaataatcggctataaacctaagaacatcgtaatagaaatggcacgagaaaaccaaaccaccaccggaggcaaaaatcgctcaaaaccccgactaaaatccctcgaagaagccctaaagaacttcgattcgcagctacttaaagaacgccccgttgacaaccagtccctccaaaaagaccgcctctacctctactacctccaaaacggcaaagacatgtacacaggggaatccctcgatatcgatcgtctatcggaatacgacatcgatcacataatcccaaggagcttcatcgtggaccacagcctggacaacaaggtcctagtctcgtccaaggaaaatcgactgaagaaagacgacgttccagatagtaaagtcgtgaagcgcatgaaagcctactgggaaaaactcctccgcgcaaacctaatctcggaacgaaaattctcctacttgacaaaacttgaactcacggacgacgacaaggcccgcttcatacagagacagctagtcgaaacccgccaaattaccaagcatgtagcagccatcctacaccaatattttaaccaaacacaggaactagagaaagagaaagacatcagaataataacactaaaatcgtcgctagtatcccaattccggcaagtcttcggcatacacaaagtccgagagatcaaccaccaccaccacgcacacgacgcatatctgaatgcagtagtggctctcgctcttctgaaaaaatacccccgcctcgcccccgagttcgtgtacggcagctttgcgaaattccatctagtcaaagaaaacaaagcgacagcaaaaaaagaattttactccaacatactcaagttcttcgagaaagaagaacagttctgcgacgagaacggcgaaatcttctgggacaaacgcaaacacatccaacaaataaaaaaagtaatctccagccaccaggtgaacatcgtcaaaaaggtggaagtgcagaccggcagcttctacaaggaaaccgtcaataccaaagagaaacccgacaaactcatcaaaaggaaaaacaactgggacgtcaccaaatacggaggattcggaagcccagtcgtagcctacgcggtcgtattcacctacgaaaaagggaagaatcacaaaaaagcaaaagccatcgaggggattaccatcatggaacaggcgctcttcgagaaggacccaatctcattcctgatagaaaaagggtacagcaatgtcaaccagtttataaagctcccaaaatacacactcttcgaactagctaacggccaacggaggatgctcgcctcccaccaagaattacaaaaagccaactcgtttattctccccgaaaaactcgtaacactcctataccacgccaaccactacgacgagatagcgtacaaagactcctacgactacgtgaacgaacacttctccaactttcaggacatcctcgacaaggtcattatattcgcagaaaaatacacaagcgccccgcagaaactcaaccagataattgccacctacgagaagaaccaagaagccgaccgcaaaataatggcccacagctttgtaaacctcatgcaattcaacgcgctcggagcccccgccgacttcaaattcttcgataccactataacccgcaaacgctacacatcgctaaccgaaatatggcagtcgacaatcatctaccaaagcgtaaccggactctacgaaactcgccgcagaatggccgacctgtgggatggggtacaatga

SEQ ID NO: 6458 - RNA, 4020 nt, synthetic construct
  misc_feature 1..4020: note = Cas9 variant
  source 1..4020: mol_type = other RNA
atggagagataccatatagggctagacataggcacaagctcaatcggctgggccgttatcggagacgacttcaaaattaagaaaaagaaagggaaaaacctaatcggtacaagactcttcaacgaaggggcaacagctgccgagagacgcggcttccgaacccaacgacgcaggctaaaccgccgcaaatggcgcctcaaactcctcgaagaaatcttcgacccctacatggccgaggtcgacgagtatttcttcgcccgactcaagtcctccaacctcagcccaaaagacagcaacaagaaatacctgggctcactactcttccccgacaaatccgacagcaacttctacgacaaatatcccacaatctaccatctccgacgagacctaatggaaaaagacgaaaaattcgaccttcgagaaatatacctggccatacaccacatcgtgaaatatagaggtaacttcctggagaaggtccctgccaagaactacaaaaactcgggcgcttccataggcttcctcctcgaagaagtgaactcactctataaggacataatcggtgacgagtcaatcgccatcctcaacagcgagaagttcgaagacgtagagaaaataatactagacgaagaaaccagaaacctggacaaacagaaatcagtcgggaagctcctcgtcgaagacaaaaagaagaaaaacatcgtcaccgccttctccaaagcaatcttcggctacaaatttaacatcgaagacctactgctcatcgaaaacgacgagaaaaacaaactcaccttcaacgacgaaaacatcgatgacatattcaacgagctctcccacagtctggacgacaaacaaatggacctgctcactaagacacgcgaaatctacttcaaattcaaactcaacatgatagtccccacaggatacacgctctcggagagcatgatcgaaaagtacgagatgcacaaggctcacctaaaaatgtacaaagagttcattaacaccctcaacactaaagaccgcaaaattctgaaaaacgcgtactccgactacataaacaccgaaaaagcgaaagcagccaacgcgcaagagaacttctacaagactgtcaagaaaataataaaagacaacaactccgatacagcaaagaaaattatcgtcctaatcgatgaaggaaacttcatgccgaaacagagaactggtgaaaatggagtcataccacatcaactacatcaaatagagctcgatcgaatcatcgaaaaccaggccaagtactacccatggctagcggaggcaaaccccgtcgaaaagaacagaaagtttgctaagtacaaacttgacgaactggtaacattccgcgtgccatactacgtgggccctctgatcgacaagaccgaaagcaataaaaacgaaaaggaaaccaagttcgcgtggatggtccgcaaagccaagggcacgatcacaccatggaacttcgaaaacctcgtcgaccgaacagaatcagcaaacaggttcataaaacgtatgaccagcaaggacacatacatcatcggcgaagatgttttacccgcctcctcccttctatacgagaagtttaaggtcctcaacgaactgaacaacatcaaagtaaacgaaaagaaattggacatcgaacaaaaacaagatatatacctcaatctgttcaccaccgccaaaaacgtcacgaaaaagtctctcgcgacctacctaaactgctcggccgactccatatctggactcagcgacggagagaaattcaatagctccctaagctcctacatagacctaaaagcaatcctagggaacatagtagacgactgcaacaaaaacgaagacctcgagaaaataatcgagtacagcactgtttttgaggatggcaacatttacaaagagaaactttctgagatcagctggctcaccgacgaacagatcgaaaagctcagcaacatccacttcaaaggctggggccggttaagcaagaaactactgacgcaaatcactaacgagaacggcgagcgcataatcgacgccctatggaacacgtcgaataactttatgcaaataatcaacgacgagtccatacaagcgaaactggccgaaatcaacggcaaatacgcgggcaaatccgacctggaagacattctatcggaagcctacacgagcccccagaacaagaaagccatccgccaggttatgaaggtggtcgaagacatcgaaaaagccatgcagtgcgaaccaacatccatctccatcgagttcaccagaaagaaacaaaaatctcgactaaccaacaccagatataagaaaatcagcgatgtctacgagaaaatcgcggatgaagtaatctccgaatacgaactacgcaagctacagagcgaactcgactcgaacgcgaacaacatgcgcgacagatactacctatacttcatgcaactcggccgagacatgtataccggagaaaagatcaatatagacgaacttcaccaacggtatgacattgaccatatcctaccccaatcattcataaaggacgactccatcaacaaccgcgtcctgacaagaaaagacgtaaacaacaaggagaagtctgacaaaaccgccgccgacctctacgccgtcgagatgtcagatttctggcgaaagctccgcaagcaagggctcataaccgaacaaaaatacaaaaacctgctaactaaaagcgactccatagacaagtacgcaaagaaaggcttcatcaagcgacaactcgtagaaacctcacaagtggtaaagctagttgccaacatcctccaggacaaatattcagatacgaaaatcatagaagtgagagccaaacttaattccaacctacgggaggaatacaaactaatcaaaaaccgagctgtgaacgactaccaccacgccattgacggctacctcacaaccttcatcggccaatatctgtacaaaacgtacccaaaactacgcagctactttgtctacaacgactttaaaaagctagactcaaactatctcaaacacatgaagaagttcaatttcctgtggcagctccaggacgacaaaacgatcgatatatatgacaacgtcaacaataagtttgtgttaaacgtccctgaaatgaaaaagtacattcagaagatctataactacaaatacatgctggtctcgaaagaagtgactacaaagaacggcgcattttacgaccaaacgaaatataacgccaaaaccgtcaacctcatcccgatcaagaaaaacaagccgacgaacatatacggcggctacaaaggtaaagtctccagctacatgatgctagtcaaaattaggaagaagaaagaagtaatctacaaattcgtcggggtaccacggctctggactgacgaattagaccgtctcaaagacaccacagaacgcaagatcctgctaaacgaaatagccaagaactccctgtcgaagacggaacaggacttcgaggtaatcctcgacaaagtttactacggccaactaatcatagacggaaaccagaagtacactctcggaagctcagagtacaaatacaacgccatgcaattacacctgtccaaacacgccctcgaggtcctcgccaaagaaaatgtcaaagacgccgagatcaccgacaaagacctcgtatccgtctacgaagaaatcctatcggttgtcaacaaatacttcgaactctatgacataaataaattccggcaaaaactcaacgaggggctagagatattccgaaaattaccagtttacaacgtctatgagtccaacaagataaaacaagtcggaaaatttgaggtcctcaaccgcatcttgatggggctccacgccaacgccatgatcacagacctcaaagtgctaggcattaaaaccaaactaggacaaatgcaagtgaacggcgggataaagctgtccccggacgccaaactaatctaccagagccccaccggcatcttcagccgcgcagtcagggtaaaagacctaggctga

SEQ ID NO: 6459 - RNA, 4020 nt, synthetic construct
  misc_feature 1..4020: note = Cas9 variant
  source 1..4020: mol_type = other RNA
atgagcctgaataccaacaagaaatacaacatcgggctcgacataggcacaacatcggtaggatgggctgtcaccgacgccgacggacaaaaactgctcaaagcgaaaaataaaaacctatggggcgtgtcactcttcgaagccggaaaaaccgctgccgaaaggagaggctaccgctccacacgcaggcgcctcaaccacaggaaattccgactacgcctactcgaagacatgttcgaaaaagagatactctccaaagaccccagcttcttcatccgactaaaagaagcattcctgtcccccaaggatgaacagaaacaattcaaaggcaatatcctgttcaacgacaaagactacacggacgcagactactacgaacagtacaaaactatataccacctacgctacgacctaatttcacaacacagacaattcgatatccgtgaggtctacctggcgatccatcacctcatcaaataccgcggccactttatatacgaggaccagaccttcaccaccgacggcaaccaactccaacaccacatcaaagcgatcatcaccatgatcaactccatacttaatcgaataattattcctgagaccatcgatattaacgtgttcgagaaaaccctactagaccgaaccatgaatcgatccagcaaagtaaagttcctaatagaactaactggtgaggacaaacaggacaaacccctactaaaagagctattcaacctaatcgttggcctaaaagccaaacccgcatccatctttgagcaagaaaacctcgcaaccatcgtcgagacaatgaacatgtctacagaacaagttcaactagacctgctgaccctcgcagacgtactggcggacgaggaatacgatttactactcactgcacaaaagatctactcggccataatattggacgaatcgatggacggatacgaatactttgccgaggccaaaaaggagagttaccgcaagcaccaagaagaactcgtcctcgtcaagaaaatgctcaaatcaaacgcgataacgaacgacgaacgcgccaaattcgaatacttctacaccgactacatcggcgcaaaatcctccaattacgaagagtctaaaatcataaagaaaggcctcagcgccgcctacggaaaatattcaaaagaagaaagactcttcaaacatatcgagctcctcctggccaaggaaaacgtgctaaccacggtagaacacgacctactagagaagaacataacgttcgcctcgctactcccactccagagatcgtcccgtaatgccgtcatcccctaccaagtacacgagaaagagctcgttgcgattctggagaaccaagccacatactacccctttctcctcgaacaaaaagacaacatccacaagctactaaccttcagaatcccctattacgttggtcccctagccgaccaaaaagactcagagttcgcctggatggtccggaaacaggccggtaagatcaccccctttaactttgaagagatggtcgacatcgacgcatcatcggaagccttcatcaagagaatgaccaacaaatgtacctacctaatccacgaagacgtcatcccaaagcacagcttttcttatgcaaagttcgaagtgctaaacgaactgaataagatacgcctggacggcaagccaatagacatcccacttaaaaagcgaatctttgagggactattcctcgagaaaaccaaagtgacccatacatctctcaagaaatggctcgcagaatacgaacacatgaccgtgtcagtcgtacaaggaacccaaaaagaaaccgagttcgcaacctccctccaagccttccataggttcgtcaaaatcttcgaccgagaaacagtcagcaaccccgccaacgaagaaatgttcgagaaaatcatatactggagcacagtcttcgaagacaaaaagatcatgagacgcaaactcagtgaatatccacaactgacagagcaacagcaggtacaacttgcccaagtacgcttccgcggctgggggagactgagccagagacttatcaaccggatcaaaacgcccgtcagcggcgacgaagaccacaagctctccatcaatgagatcctctggcaaacgaatgagaatttcatgcaaataatacggaataaagactacctcttcaagaagatcatcgaggaacagttcgagaacgaaacagccctccttaacaaacagcggatagacgagctcgccacatcgccagctaacaaaaagggaatctggcaagccattaaaatcgtaaaagaactcgagaaggtcctccaacagcccgccgaaaacatctttatagagttcgcacggtccgacgaagagtccaaacgatctaccccacgcgacaaattcatcgaaaaagcatacgcgcaactgaaaaaggaaactgacacgttcaacctagagcacttgaaggaattgaagcaacgatcaaaacaattgagcagccagcgcctcttcctatacttcattcagaacggcaaatgcatgtattccggcgagcacctcgacatagagcgcctagatagctacgaagtcgaccacatcctcccccagtcgtacataaaagacaacagcatcgaaaacctagccctcgtcaagaaagtagagaaccagcgcaagaaagacagcctcctactgaacagcagcatcataaaccaaaactactcccgctgggaacaactcaagaacgccggcctcatcggtgaaaagaaattcaggaatttgacgcgaaccaaaataaccgatagggacaaagaagggttcatcgcacgccagctagtcgaaacccggcaaatcaccaagcacgtcacacaactcctgcaacaagaatacaaagacaccacaaaggtcttcgccatcaaagcaacgctagtatccgacttgcgccgaaagttcgagttcatcaagaaccggaacgttaacgactaccaccatgcgcaagacgccttcctcgtagcttttctaggcacaaacatcacctccaactacccaaaaatcgagatggagtacctcttcaagggataccagcactacctcaacgaggttggaaaatcagcggcaaagccaaaattcaccttcatcgtcgaaaacctctccaaacagcaatacaactccactaccggcgaagtcaaatggaaccctgaagtcgacatcgcaaaactaaagcggatcctcaactttaagcagtgtaacatagtccgcaaagttgaagaacaatcgggcgcactctttaaagagaccatataccccgtagaagaatcctcctccaaaacgatcccccttaagaagcaccttgatacagcaatttacggtggttacacagccgtaaactatgcttcctacgcgctaattcaattcaagaaaggccgaaaactcaaacgggagataatagggatcccacttgcggtccaaactcggatcgacaacagcgaaacatccctacagacatacattgcagaacaaatcaaatccgaggttgagatcctcaacggaagaatcctgaagtaccaactcatctcaaacaacggcaacagactttacatagccggcccccgcgagcgccacaacgcacgccagctaatcgtgtctgatgaagccgcgaaggtgatctggctcatctccaccaaacaagcagtcgaggcaacatttctaaagcattacacgctcgagcacctggaagccgtcttcgaggaactcattagaaaacaggccgccgactatcaaatattcgaaaacctaatcaagaaaatagaggtcaataaagcatacttctattcctgcacctacaacgaaaaagtaaaagtaattgaggaacttttgaaaatcacgcaagcgaacgcaacgaacggcgacctaaaactcctcaaaatgaccaaccgagaagggcgactcggatccgtttccgtcgcactagacttcaaaattatcaaccaatccgttaccggcctttaccagagcattgaggactacaataactga

SEQ ID NO: 6460 - RNA, 4020 nt, synthetic construct
  misc_feature 1..4020: note = Cas9 variant
  source 1..4020: mol_type = other RNA
atgtcgctgaacacgaacaagaaatacaacatcggcttggacatcggaacaacatccgttggctgggcggtcacggacgccgacggccagaagctgctcaaagcgaaaaacaaaaacctctggggagtgtccctattcgaagcggggaaaaccgcagccgagcgtcgcggctaccggagcacgcgccgccgactcaaccaccgcaaattccgccttcgactcctcgaagatatgttcgagaaagaaatcttaagcaaggaccccagcttcttcatccgcctaaaggaggctttcctcagcccaaaagacgaacagaaacaattcaagggaaatatcctcttcaatgacaaggactacaccgacgcagactattacgaacaatacaagaccatctatcatctgcgctacgacctcatctcccaacacagacagttcgacataagagaagtctacctggccatacaccacctcattaagtatcgaggccacttcatctatgaagaccaaacgttcacgacagacggaaaccaactacaacaccacataaaggccatcataactatgataaacagcatactgaacagaatcatcatcccggagaccattgacatcaacgtgttcgagaaaactttactcgacagaaccatgaatcgctcctcaaaggtcaagttcctaatcgaactaactggagaagacaaacaggacaaacccctactgaaagagctgttcaatctaatcgtcggactgaaagcgaaaccggcctccatcttcgaacaagagaacctggctactatcgtcgagacgatgaacatgtccacagaacaagtccagctcgacctattgacgctagcagacgtactcgccgacgaagagtatgatctcctgctaacagcccagaaaatatatagtgccattatactcgacgagtccatggacggatacgagtacttcgcagaagccaagaaagaaagctaccgaaagcaccaagaagaacttgtccttgtcaaaaagatgcttaagtcgaacgccatcacgaacgacgaacgtgccaagttcgaatatttctacacggactacataggagccaaatccagcaactacgaagaaagcaagatcatcaagaagggtctaagcgccgcatacggcaaatattccaaagaagaacgcctgttcaaacacattgaactactactcgcaaaggagaacgttctaaccacagtagagcacgacctgttggagaaaaacataactttcgcgtcgctgctgcccctacaacgctcctccagaaacgcggtaatcccctatcaagtccacgaaaaagaactggtagcaatcctagaaaatcaagcaacttactatcccttcctgctcgaacaaaaagacaacatacacaaacttctaacattccgaatcccctactacgtcgggcccctcgccgatcaaaaggactccgagttcgcatggatggtgcgaaagcaagcaggtaagatcaccccgttcaacttcgaagagatggtcgacatcgatgcatcctccgaagcattcatcaagcggatgacaaacaaatgcacgtacctcatacacgaagacgtcataccaaaacacagtttttcctacgccaaattcgaagtcctcaatgaactcaataaaatccgcctggatggcaaaccaatcgacatacccctaaagaaacgaatcttcgagggtctcttccttgagaaaactaaagtgacacataccagcctcaagaaatggctcgccgaacatgagcacatgacggtaagcgtagtacaaggtacacagaaagaaaccgagttcgccacctcgctgcaagccttccaccgcttcgtgaaaattttcgaccgggaaacagtctcaaacccagctaacgaggaaatgttcgagaaaatcatatactggagcaccgtattcgaagacaagaaaatcatgcgacgcaaactgtcagaatacccccaactcaccgaacaacaacaggtacaactcgcacaggtacgctttcggggttggggccgactctcccagcgactcatcaaccgcatcaaaaccccggttagtggagacgaggaccacaaactcagcataaacgaaatattatggcagaccaacgaaaactttatgcaaatcatacggaacaaagactacctattcaagaaaatcatcgaagaacaattcgaaaacgaaaccgcacttctaaataaacagcgcatcgacgagctagcaacatcgcccgccaataagaaaggcatttggcaagccatcaaaatcgtaaaagagctagaaaaagtactccaacaacccgcagagaacattttcatcgagttcgccagatcggacgaagaaagcaaacgatcgactccacgcgacaaatttatcgaaaaagcatacgcccaactcaagaaagagaccgacacattcaacctagaacacctgaaagagcttaaacaacgaagtaaacaactcagctcccaacggctattcctatacttcatccaaaacgggaagtgcatgtactccggcgaacacctggacatagaacgactcgacagctacgaagtcgaccacatccttccccaatcatacatcaaggacaactcaatcgaaaatctagcgctagttaagaaagtcgaaaatcagcggaagaaagattcactgctcctgaatagctccatcatcaaccaaaactactcccgctgggagcaactcaaaaacgccggcctaataggcgaaaagaaattccgtaacttaacacgaaccaaaatcaccgaccgcgacaaagagggattcatcgcccgacagctcgtcgagacacgccagatcaccaaacacgttacccaactactccaacaggagtacaaggacactacgaaagtattcgccataaaagcgactctggtgtcagacctccggcggaagttcgagttcataaagaaccgcaacgtcaacgactaccaccacgctcaggacgccttcttggtggcatttctaggcacgaacatcacatccaactacccgaaaatagaaatggaataccttttcaaaggataccagcactacctcaatgaagtgggaaaatctgccgccaagcccaagtttacatttatcgtcgaaaacctatccaaacaacagtataatagtaccaccggcgaggttaaatggaaccccgaggtcgacatagccaagctcaaaagaatccttaatttcaaacaatgcaatatcgtcagaaaggtggaagaacaatccggggccctattcaaggagacaatctactcagttgaagaaagcagctccaagaccataccactcaagaaacacctcgacacagccatctacgggggctatacagcagtcaattacgccagttacgccctaatccaattcaagaaaggacgcaaactcaaacgcgaaataataggcatccctcttgcagtccagaccagaattgacaactcagaaacatccctgcagacgtacatagcggagcaaatcaaatcagaagttgaaatcctaaacggccggatacttaaataccaactcatctccaacaacggcaaccgtctctatattgccggcccccgagagcgccataacgcacgccaactcatcgtttccgacgaggccgcgaaagtcatctggctaataagcacaaaacaagcagtcgaggccactttcctcaaacattacaccctagagcacctcgaagccgtctttgaggagctcatccgaaaacaagcggccgattaccagatatttgaaaacctcatcaagaagatcgaggtaaacaaagcctacttctactcctgcacctacaacgaaaaagtaaaagtaatcgaggaactactcaaaatcacacaagcgaacgccaccaacggcgacctcaaactcctcaaaatgacaaaccgcgaaggcaggctcggctcagtaagcgtcgcactggactttaaaataatcaaccaatcagtcactggactgtaccaatcaatagaggactacaacaactga

SEQ ID NO: 6461 - RNA, 4020 nt, synthetic construct
  misc_feature 1..4020: note = Cas9 variant
  source 1..4020: mol_type = other RNA
atgaagaaagaatacaccataggactcgacatcggaacaaacagcgtcggatggtccgtgttaaccgacgattaccgactcgtaagcaagaaaatgaaagtagccggaaacaccgagaaatcaagcaccaagaaaaacttctggggagtcaggctattcgacgaaggacaaaccgcggaagcaagacgctccaaacgaacagcccgccgccgactagcaaggcgccgccaacgcatcttggaactacagaaaatattcgcgccagaaatactgaagatagatgaacatttcttcgcacgactcaacgaatcattcctggtccttgacgagaagaaacaatcgcgacatcccgttttcgcgacaataaaacaagagaaaagctaccatcagacctaccccacaatctaccatctcaggcaggccctggcagattccagcgaaaaagcggacatccggctagtctatctggctatggctcacctactcaaataccgcggccatttcctcatagaaggagaattgaataccgaaaacagctctgtcaccgaaactttccgccaattcctatcaacttataaccaacagttcagtgaagccgacgacaaacaaaccgaaaaactcgacgaagcggtagactgctccttcgtattcacggaaaagatgagtaagaccaagaaggccgaaacactccttaaatatttcccccatgaaaagtcaaacggctacctctcccagttcataaaactcatggtcggcaaccaagggaacttcaaaaacgtgtttggactagaagaagctaaactccagttcagtaaggagacctatgaggaagacctagaagaactactggagaaaataggagacgactatatagacctcttcgtacaggccaaaaacgtgtacgacgcagtcctactctcagaaatactctcagatagcaccaaaaacacccgagccaagttgagcgccggcatgattcggcgctacgacgcccataaagaggatttagtactactgaaacgatttgtgaaagaaaacctacccaagaaataccgagcctttttcggcgacaacagcgtgaatggatacgcgggatacatcgagggccacgcaacgcaagaagacttctacaaattcgtcaagaaagagctaaccggaataaggggctcagaagtcttccttaccaaaatagaacaagagaacttcctgcgcaaacaacgtacatttgacaacggagtcataccccaccaaatccacctcactgagcttagagctatcattgcaaaccagaagaaacactatccattccttaaagaggagcaggagaaactcgaatctctactgacatttaaaataccttactacgtcggcccactcgccaaaaagcaggaaaactccccatttgcatggctcattcgtaaatccgaggagaagatcaagccgtggaacctaccagagatagtggacatggaaggcagcgccgtccggttcatcgagagaatgatcaacaccgacatgtacatgccccacaataaagtcctgccaaagaactcactgctataccaaaaattctcaatctacaacgagctcaccaaagtccgttatcaagacgagcggggccaaatgaactacttctcctcgatagagaagaaggaaatattccacgaactcttcgagaagaacagaaaagtaacgaagaaagatcttcaagagttcctctacctaaaatatgacatcaaacatgcggaactctctggaatagaaaaagccttcaacgcttcatacaccacataccacgacttcctgaccatgtccgaaaacaagagagaaatgaagcaatggttagaagacccagaactagcctccatgtttgaagaaattatcaaaactctgacggtattcgaagacagagaaatgatcaaaactcgacttagccatcacgaagccactctcggaaaacacatcataaagaaactcaccaagaagcactatacaggctgggggcgcctatccaaagaactaatccaaggaatcagagacaagcaatcgaacaagaccatactagactacctcatcaacgatgacgactttccgcaccaccgcaaccgcaatttcatgcagctcattaatgacgacagcctatccttcaagaaagaaataaagaaagcccaaatgataaccgataccgaaaatttagaggaaatcgtaaaagagcttacaggaagcccagccataaagaaaggaatcctgcagagcttgaaaatcgtcgacgagatcgtcggaatcatgggatacgagccagccaacatcgtagtagagatggcgagagagaaccaaaccacgggcaggggattaaaatcctcaagaccaagactcaaagccctcgaagaatccctaaaagacttcgggtcccaactcctgaaagaataccccaccgacaattcctcactgcaaaaggaccgactctacctgtactacctacaaaacggacgggatatgtacaccggcgcacccctagatatacaccgcctcagcgattacgatatagaccacatcattccccgctccttcacgacagataacagtatcgataacaaggtcctcgtaagctcaaaagaaaaccgcctgaagaaagatgacgtccccagcgagaaagtcgtcaagaaaatgcgtagcttctggtacgacctatactcatccaaactaatatccaaacgaaagctagacaacctaaccaaaataaaactgacggaggaagacaaagcaggctttataaaacgacaactcgtggagacacgtcaaataaccaagcacgtcgccggcatacttcaccaccgctttaacaaagctgaagacaccaacgaaccaatccgcaaggtccgaataatcacgctaaagagcgccctggtctcacagttcaggaatcgattcggaatctacaaggtccgagagatcaacgagtatcaccacgcacacgacgcatacctgaatggggtcgtagccctcgcactactcaagaaatacccacaactagccccggagttcgtctacggcgaataccttaaattcaacgcgcacaaagcaaacaaagcaacagtaaagaaagagttctattcgaacatcatgaaatttttcgaatccgacacaccggtctgcgacgaaaacggagaaatattctgggacaaaagcaaatccatagcccaagtaaagaaagtgataaatcatcaccatatgaacattgtcaagaaaacagaaatccagaaaggaggcttcagcaaagaaaccgtcgaacctaagaaagacagcagcaaactgctaccccggaaaaataactgggaccccgcgaaatacggcggcctcggtagccccaacgtagcgtacaccgttgcattcacgtacgagaaaggcaaagcccgaaaacggaccaacgcgctagaaggaatcaccataatggaacgagaagccttcgaacaatccccagtcctcttcctcaaaaacaaaggctacgaacaggcggaaatcgagatgaaattaccgaagtacgccctcttcgaactcgaaaacgggagaaagcgcatggtagccagcaacaaagaagcccaaaaagcaaatagcttcctgctgcccgagcacctcgtaaccctcctgtaccacgctaaacaatacgacgaaatctcccacaaagaatccttcgattacgtcaacgaacaccataaggagttcagcgaggtattcgcccgagtcctagagttcgcgggcaagtacactcttgcggaaaagaacatcgagaaattggagaaaatctacaaggaaaaccaaaccgacgacctggccaaacttgcatccagctttgtcaacctaatgcaattcaacgccatgggagcgcccgcagacttcaagttcttcgacgtcaccatcccacggaagagatacacctccctaaccgaaatctggcaatccaccatcattcaccagtccataaccggactctacgaaacccgaatccgcatgggtaaatga

SEQ ID NO: 6462 - RNA, 4023 nt, synthetic construct
  misc_feature 1..4023: note = Cas9 variant
  source 1..4023: mol_type = other RNA
atgaagaaagaatatacaataggactggacatcgggaccaactcagtcggatggagcgtactaactgatgactaccgcctcgtgtctaagaaaatgaaagtcgcaggcaatactgaaaaatcaagcaccaagaaaaacttttggggcgtcaggctctttgacgaaggccaaaccgcagaagcgagacgcagcaaacggacggcacggagacgactggcacgcagacgccaaagaatcctagaactccagaagatattcgcccccgagatcctaaaaatagacgaacacttcttcgcccgcctcaacgagtccttccttgtcctcgatgaaaagaaacaatctcgacacccggtcttcgctacaatcaaacaggaaaaatcgtatcaccagacctacccaacaatataccacctccggcaagcgcttgccgactcgagcgagaaagcagacataagactggtatacctcgcgatggcccacctcctcaaataccggggccacttccttatcgaaggcgaacttaacactgaaaactcctctgtgaccgaaaccttccgccagttcctcagcacctacaatcaacagttttctgaggcagacgacaaacagacagaaaaacttgacgaagccgtagactgcagcttcgtctttaccgagaaaatgagcaaaaccaagaaagctgagaccctactaaaatacttcccccacgaaaagtccaacggctacctatcccagttcatcaaactcatggtaggcaaccaagggaacttcaaaaatgtcttcggcctcgaggaagaagcgaaactgcaattctcaaaggaaacgtacgaggaagacctcgaggaactactagagaaaatcggcgacgactacatagacctctttgttcaagcgaaaaacgtctacgacgcagtcctgttgtccgaaatcctctcagacagcacgaaaaatacacgagccaaactctcagccggcatgataagacgctacgatgcccataaagaagacctcgtactgctaaaaagattcgtcaaagaaaacctcccgaagaaataccgggcctttttcggagacaacagcgtcaacggctacgcagggtacatcgaaggccacgcaacacaagaagacttctacaaattcgtaaagaaagagctaactggaatccgaggcagcgaagtattcttgaccaaaatcgaacaagaaaacttcctccggaaacaacgcaccttcgataacggggtcataccacaccaaatacaccttaccgaactcagagcaattatagcaaaccaaaagaagcactaccccttcctaaaagaggaacaagaaaaactggaatcactcctaaccttcaaaatcccatattacgtcgggccactagcaaagaaacaagagaactcacccttcgcatggctcatccgaaaaagtgaagagaagataaaaccttggaacctgcccgagatagtggacatggaaggctccgccgtccgcttcattgaacgcatgatcaacacagacatgtacatgccacacaataaggtcctgccgaaaaacagcctcctctaccagaagttctccatctacaacgaactcaccaaagtccgctaccaagacgagcgcggccaaatgaactacttctcaagtatcgagaagaaagaaattttccacgaactcttcgagaaaaacagaaaagtcaccaagaaagatcttcaagagttcctctacctgaagtacgatataaagcatgcggagctgtcaggaatcgaaaaagcattcaacgcctcgtacacaacctaccacgacttcctaacaatgtcggaaaacaagagggagatgaagcaatggctcgaagacccagaactcgcaagcatgtttgaggagataattaagacactaaccgtattcgaggacagagaaatgatcaaaactcgactctcacaccacgaggccacgctaggcaaacacatcatcaagaagctgacaaagaaacactacaccggctggggccgcctgagcaaagaactcatccagggaatccgcgataaacaaagcaacaaaaccatcctggactacctcatcaacgatgacgacttcccccatcatcggaatcgcaacttcatgcaactcatcaacgacgatagcctgtcattcaagaaggagatcaaaaaggcccaaatgattaccgacaccgaaaacctagaggaaatagtaaaagagctcaccggatctcccgccatcaagaaagggatcttgcaatccctaaaaatagtagacgaaatcgtagggatcatgggatacgaacctgcaaacatcgtcgtggagatggctcgagaaaatcaaaccacaggacgcgggctcaaatcctcccgaccgcgactcaaagccctggaagagtctcttaaggatttcggaagtcagctcctcaaagagtacccgaccgataactcatcgctccaaaaagaccgcttatacctatactatctacagaacggacgagacatgtacaccggagcccctctcgacatccaccgactcagcgactacgacatagaccacataatcccccgctcgttcacaacggacaactcgatagacaacaaagtactcgtctcgagcaaagagaaccgactgaagaaggatgacgtcccgagcgaaaaagtcgtaaagaaaatgcggtcattctggtacgacctctactccagcaaactgatctccaaacgaaaactggacaacctcacaaaaatcaaactaacggaggaagacaaagccggattcataaaacggcagctagtcgaaacacgccaaatcaccaaacacgtcgccggcatcctacaccaccgcttcaacaaggcagaagatacaaacgaaccgatccgaaaagtgcgtataatcaccctaaaatccgccctagtcagccaattcaggaacagattcggcatatataaagttcgcgagatcaacgaataccaccacgcacacgacgcatacctgaacggagtagtagcactcgcactgctaaagaaatacccccagctcgctcccgagttcgtatatggcgaataccttaaattcaacgcccacaaagcaaacaaagcaacggttaagaaagaattttatagcaacatcatgaagttcttcgaaagcgatacgcccgtctgcgatgaaaacggcgaaattttctgggacaagagcaagtccatcgcccaggtcaagaaagtgatcaaccaccatcacatgaacatcgtcaagaaaacggaaatccaaaaaggcggattttcgaaagaaactgtggagccaaagaaagactcgtccaaattactcccccgcaaaaacaactgggaccctgcaaaatacggcgggctcggcagccccaacgtggcatacacagtagccttcacgtacgaaaaaggcaaagctcgaaaacgaacgaacgcactagagggaataacaataatggagcgcgaggccttcgaacagtcaccagtactgttcctgaaaaacaaaggatacgaacaagcggagatcgaaatgaaattacccaaatatgcacttttcgaactcgagaacgggagaaagcgcatggtcgcctccaacaaagaagcccagaaggcaaatagcttccttctcccggaacacctagtaacactgctttaccacgccaaacaatatgacgagatcagtcacaaggagtcattcgattacgtcaacgagcaccataaggagttttccgaagtctttgcgcgcgtactagagttcgcaggcaagtacacactcgctgagaaaaacatagaaaaacttgagaaaatctacaaggaaaaccaaaccgacgacctcgcgaaactcgcaagctcgttcgtcaacctaatgcaattcaacgccatgggcgcacccgcagatttcaaattcttcgacgtaactatcccccgaaaaagatacacaagcctcacagaaatctggcaaagcaccatcatccaccaatcgatcaccggcctatatgaaacccgaatccggatgggaaaatga

SEQ ID NO: 6463 - RNA, 4023 nt, synthetic construct
  misc_feature 1..4023: note = Cas9 variant
  source 1..4023: mol_type = other RNA
atgaaaacagactacttcatgggactagacatgggcaccggctccctcgggtgggcggtaacagattcgagctaccacctgtgccgtgcacatggaaaagacctctggggagtacgacttttcgaaacggcccagacggccgaagaacggagagtcttccggtgcaacagaagacgcctagaccgaagaaagagacgcatacaactcctccaagatatattcgcccccgaaatctataagatagacccaggattctttttaagactcaaagaatcccggtacctccccgaagacaaaaagaatctagaagggaaaacaccagaactcccctacgccctgtttgtagacaagaaatacacagacaaagacttccacaaagaatacccaaccatatatcatctccgcctgcgcctgatgcaagaccgcaccccggccgatgttaggctagtctacctggctctgcaccatctcattaaacacagaggccacttcctcttcgctggaatagaggccgacaaagtaaccgacttcagcgccgccttttcagaatttttgcggatcgtacaagagcaagaactcgacatcagcttcacccccgatgaggaatcgagccaaataataaaggaaaccctacaaaacaccaacttcaccagatccaagaaatccacagagctaataaaagggctaaaagccagcacagggtgcgaaaaggccctactgaagctcatctccggatgcaaagtaaaactttccgccgtattcgacgaccctggttgcgacgcttacgaaaaaccacaagtctgctttgccgaatcctcatacgaagactacgccgccatcctagaggacgaactagaagaccgattcatcgtaatagccgcggccaaagccctgtacgactggtcagtcctcgtgaacatactaggcgaagcatcaaccgtcagcgaagccaaagtcggaatatacgaaaaacaccgccgcgatctcaaatatctcaaacacctggtcaaaacaaacctcaccagggaggactaccaagacctattcgttaaggccggtgccaaaaagaacaattactgtgcttatataggcatgaccaagaaaaacaacaagaaggtcgtgctcgaggaaaaacgctgtacgaaggaagacttctacgcctacctcaagaaagagatatactcgaaagtacaagaaaacccagaggccgaatatctgctagaggaactagagaaagggacgttcctcccgcgccaagtctctaaagacaacggcgtgatcccctaccagctacaattcctagagctacagaaaatcctcaaaaacgccgtcgaatacctacccttcctgaaggaggaatccgagaaaatccaacagatcatgacctttcggatcccttactacgtaggcccactcaacggaaagaaggaaggccaaaatacattcgcctgggctgtccgtaaaaacaacgaaccggtatacccgtggaacttcgaagaagtcatcgacaccgaagccagcgccgaacaattcatacggagaatgacaaataaatgcacctacctccccggggaagacgtgctaccaaaagaatcactcctctactcaaaatttatggtcctcaacgaactcaacaatctgcgaataaacggcaccaagatctccgtcgaacttaaacaggagctctacgaaaagctgtttcagcgctaccgtaaagtcagcgcaaagaaactccgggactacctcgtccgcaacggaatcacagagaaagatgccgaaataagcggcattgacggtgactttaaaggcacgctgcgagcgtaccacgactttaaagagaaactaacgggtgttgaactaacagaggcagagaaagaaaccattatcctgaacatcacactcttcggagaagacaaagtacttctcaagaaaaggatgcaaagactcctaccgaacctaaccgaagggcaaaagaaagcaatcgtaacgcttaactactccggatggggccgcctgagccgagaatttctcgaggaagtgcaagcaccaaaccccgaatcaggagaaatcctaagcataatcagggccctctgggaaaccaacgcgaacctaatgcagctcctaagcaaccaatacggataccaagagattctagagcagatgcgcgcagactggaccggacataaactcgattaccaaaccgtagaagaactctacgtcagccccgcggtcaaacggcagatctggcaaacgctacaggtcgtaaaggagttaaagaaagtaatgggaggggaaccaaaacgagtttttctcgaagtcgcgagggaaaagatggaatcagggcgtaccgtcagcaggaagaaacacctcaaggacctctacctcagctgtaagtcagaagaacgcaactggcttgctgaactggaccggcacgaagaacactcctacaggagcgacaggctattcctatactacacccaaaaaggcagatgcatgtactgcggaaaaccgatagacctcggccatctctgggatgtaaacatgtacgacatcgatcacatctacccacaatcaaaagtaatggacgactctatcaggaaccgcgtcctcacctgtcgaacctgcaacgccgagaaaaccgaccactatccgctgaaagccgaaatccgccaaaagatgcgccccttttgggatagcctaaaagcaggcaacttcatagaagaagaaaaatggaaaaggctaatcaggtccgaagagttcaccagcacggaactcgcagggttcatcgaacgccagctagtcgaaacgcgccaatccactaaagctgtcgccgacatactaaaacaagccatgcccgagaccgagatcgtctatgtcaaggcaaagaacgtatccgccttccgacaagacttcaacttcgtcaaaaaccgagacgtaaacgacttccaccacgccaaggacgcatacctgaatatagtggtagggaacacctacttcgtaaagttcacgaaaaacgcgtcctggttcattgaaagaaacccgggaagaagctacaatttaaaacgcatgttcacctcagactacgacgtaatgagtaacggggagatcgcctggaaagccgggaacagtgggaccatcaccaccgtccgaaaaatgatgaagaagaactcagtactattcactcggcgctcgttcgaagttagcggcgggctgttcgaccaacaactcatgaagaaaggaaaaggccaagtctacgtcaagtccggggacgagagactccggagcatcgaaaagtacggaggatacaacaaagctacaggagcctactttatgctcgtagaaagcgaaggaaagaagggagtcaaaaagcgcacaatcgagttcgtcccactctaccgaaaagcagaactcgaagcctctgaagagaaaatgttggaatacctccgaaccgaaatcggactaaaagaaccgcacgtactactccacaaaatcaaaaccgacacgctgttccaagccgacggattcaaaatgcacctcagcggccggacgggaaaacagctagtgtttaaaggggccaaccaattcctcgtggcggaagattacgaaaggctcctaaagaaagtagggaaagtaacggaacagctgaaaaccaacaaaaactacaaaatcaacgactacgacggcataaccgaggaaggactgaaggccctgtacagcgagttcctctctaaactgcaaaaagccccatacggaaatagattaggaactcaagccgaaaccttggaaaacgggaaggaaaaattcgacaagctaagcctagaaaacaaatgccaggtcctttcggagatcctacacttattccaatgtaactcctcagcggctgacctcagcaaactcggaggtcccggtcatggcggcatactcgttttatccaacgaaatcaccaaatgcaacaagatctcaataatccaccagagcccggccgggatctacgaacaggagatagacctgaaaaccctctga

SEQ ID NO: 6464 - RNA, 4023 nt, synthetic construct
  misc_feature 1..4023: note = Cas9 variant
  source 1..4023: mol_type = other RNA
atggagcaggagtactaccttggcctcgacatgggaacggggtccgtcggctgggcagtgaccgattcagagtatcacgtactacgcaagcacggcaaggcgctctggggagtccgactattcgagtcagcatcaaccgcagaggaaagacgcatgttccgaacttcgcgaagacggctcgaccgacgaaactggaggatagaaatactccaagagatatttgcggaagagatcagcaaaaaggacccgggtttcttcctcaggatgaaggagagcaagtactaccccgaagacaagcgggacatcaacggaaactgccccgaactgccctacgcactcttcgtggacgacgacttcaccgacaaggactaccacaagaagttccccaccatataccacctacggaagatgctcatgaacaccgaagagaccccggacatacgccttgtatacctcgcaatacaccacatgatgaaacaccgcggccacttcctacttagcggcgacatcaacgaaatcaaggaatttggcaccaccttctcaaaactcctggaaaacatcaaaaacgaggaactagactggaacttggagttaggaaaagaggaatacgcagtagtggaaagcatactgaaggataacatgctaaaccgctccacgaagaaaacccgattaatcaaagccctaaaagcgaaaagcatctgcgaaaaagcagtattgaacctgcttgcgggagggacggtcaagctctcagacatcttcggcctagaagaactgaacgaaacggagcgacccaagatctcgtttgcggataacggttacgacgactacatcggcgaagtggaaaacgaactgggtgaacaattctacataatcgagaccgccaaagccgtatacgactgggccgtcctagttgaaatccttggcaaatatacttccatctccgaagcaaaggtggcaacttacgagaagcacaagagcgacctacaatttctgaaaaagatagtgcggaaatacctgacgaaagaggaatacaaagacatatttgtcagtacgagcgacaaactaaagaactactcagcctacatcggtatgaccaagataaacggcaagaaagtagacctacagagcaaacgatgcagcaaggaagagttctacgacttcatcaagaagaatgtgctgaagaaactcgaaggccagccagagtacgagtacctgaaagaggaactcgaacgagaaacgttcctgccaaaacaagttaacagagacaacggagtcatcccgtaccaaatacacctgtacgagcttaagaaaatcctcggaaacctcagagacaaaatagacctgatcaaggaaaacgaagacaaactggtacaactcttcgagttccgcataccctactacgtgggccccctcaacaagatagacgacggcaaggagggcaaattcacgtgggcggtccgaaaaagtaatgaaaagatctacccctggaacttcgagaacgtcgtcgacatagaagcgtccgccgagaaattcatacgtcgcatgaccaacaagtgcacctacttaatgggagaagacgttcttccgaaggactcattactatactcaaaatacatggtgctgaatgaactaaacaacgtcaagctagacggagagaaactaagcgtcgagctgaaacaacgcctatatacagacgttttctgcaagtaccgcaaagtgacggtgaagaaaatcaaaaactacttaaaatgcgaaggaatcataagcggcaacgtggaaataacgggcattgacggcgatttcaaagcgtcactgacggcataccacgacttcaaagaaatactaacgggaaccgaactcgcaaagaaagacaaagaaaacataatcacgaacatagtgctttttggcgacgataagaaactactgaagaaacggctaaacaggctatacccacagataacgccaaaccaactcaaaaagatctgcgcgctaagctacactggctggggacggttctccaagaagttcctggaagagatcacagccccagaccccgagactggagaagtctggaacataatcaccgcgctatgggaaagcaataacaatcttatgcagctgctcagcaacgaatacagattcatggaagaagtggagacgtacaacatgggcaaacaaaccaagacactcagttacgagactgtagagaacatgtatgtctccccgagcgtcaaacgccagatttggcaaacactgaagatcgtcaaagaactggagaaagtaatgaaagaatcccccaaacgggtattcatcgagatggcccgcgaaaaacaagaaagcaaaagaacagaaagccgaaagaagcagttaatcgacctatacaaagcctgcaagaacgaagaaaaagactgggtgaaggagctaggagaccaggaagaacaaaaactacggtccgataaactgtacctgtactatacccaaaaaggccgctgcatgtatagtggagaagtgatcgaactgaaggacctctgggacaacacaaaatacgacatcgatcatatctacccccagtcgaagacgatggacgacagcctaaacaaccgggtgctagtaaagaagaaatataacgcaaccaaaagcgataaatatcctcttaacgagaacatcagacacgagaggaagggattctggaaaagcctcctcgacggcggctttataagcaaggaaaagtacgaacgcctaataagaaacacggaactaagccctgaggaactcgcaggattcatcgagcgacaaatcgttgaaacccgacaaagcacgaaggcggtcgcagagatcctaaagcaagtcttccccgaatccgaaatcgtctacgtaaaagctggaaccgtctcccgattccgcaaggacttcgaactactcaaggtcagggaagttaacgacctgcaccacgcgaaagatgcctacctgaacatcgtcgtcggaaacagctactacgtaaaattcactaaaaacgcttcgtggttcataaaggaaaaccccggccgcacctacaacctcaagaaaatgttcacctccgggtggaacatcgagagaaacggtgaagtagcatgggaagtcgggaagaaaggtacaatcgtaaccgtgaaacaaatcatgaacaaaaacaacatcctagtcacccgacaagtacacgaggccaaaggcggtctcttcgaccaacaaataatgaaaaagggaaaaggccaaatagcaatcaaggagaccgacgaacgactcgctagtatcgagaagtacggtggatacaacaaagccgcgggcgcctacttcatgctggttgagagcaaagacaagaaaggcaaaaccataagaacgatcgagttcatccccctatacctgaaaaacaagatagaatcagacgagtcaattgcgttgaacttcctagaaaaaggacgcggactaaaggaaccaaaaatactactcaaaaagataaaaattgacaccctctttgacgtagacgggttcaaaatgtggctgtcgggacggacaggagaccgactactcttcaagtgcgcgaatcagctaattctagacgaaaagatcatcgtgacgatgaagaaaatagtcaaattcatccaacgacgccaagagaaccgggaactgaagctatcggacaaggacggcatagacaatgaagtgctgatggagatctacaacaccttcgtggataaactggagaacaccgtgtaccgaatcagattgtccgagcaggccaaaaccttgatcgacaaacaaaaagagttcgaacggctaagcctcgaagacaaatccagcaccctgttcgagatcctacacatcttccagtgccaatccagcgccgcgaacctcaagatgattggagggccaggcaaagccggcattctcgttatgaacaacaacatcagcaagtgtaacaagataagtataatcaaccagagcccaacagggatcttcgaaaacgagatagacctactgaaaatctga

SEQ ID NO: 6465 - RNA, 4023 nt, synthetic construct
  misc_feature 1..4023: note = Cas9 variant
  source 1..4023: mol_type = other RNA
atgggcgaagaatactttctcggattagacatgggaaccggctcactaggatgggccgtcacggatgacaagtaccaaattctaaggagacacgggaacgctctctggggtgtccgcctgttcgaaaccgcaaacaccgcagaagaacgacgaatgttccgcacaaaccggcgcagactagaccgtcagggctggcgcataaaaatcctacaggagctattcgcagaagagatctgccgagtggacccagggttctacttacggatgaaagaatccaagtactacccggaggacaagcgagatgcaaacggcgaatgccccgcactaccgtacgcactattcgcggacgcccaatataccgacaaagactaccaccgcgagttcccaaccatctaccatttacgcaagatgctaatggaaacggaaacgacccccgacatacgcctagtatacctagcattccaccacatgatgaagcaccgcggacacttcttactctccggcgacatttcccaggtgacagagttccgaaacacctttcttcaaatgatcgctaacatcaaaagcgaagaactagactttagcctcgaaatcgaagaaacgcagatgggccaaatcgaggccgtgctgaaagatcacaaactcacacgctccgagaagaaacggcgactgacacaaatcctaaagccagctaccgcctgcgaaaaagccatcttcacactcctgtccggcggaaccgtcaaactgagcgacatcttcggcaaagcagagctcgacgaaggcgaacgcccgaaaattagtttcgcagacaacggttacgacgactactctgcaagcgttgaggccgatctcggagagcaatactacatcatagaatccgccaaagccgtatacgattggagcgtcttaagcgacatcctgggcgatagcgtaagcatatcagacgcaaaagtcaaactatacgaaaagcacaaaaaggacctcgcgtacctcaagaaagtggtacgggagaatctacccagggaagtatataaccaagtattcgtgaacacggacgaaaaactctgcaactactgcgcctacatagggatggcaaagaaaaacgggcgcaaagttgcactagaaggaaaacggtgcacgagagaagagttcgaatccttcctaagaaagaaaatagtcaacaaaatagaagacaaagaaatccaagaatacctatccgaagagatagaaaaaggcaccttcctcccccgccaagtaacgaaagacaacggcgtgataccgtaccaaattcacctatacgagcttcggaagataatcgacaacctatcaccgaggatgcccttcatacgagacaatggggacaaaataatccaactcttcacgtttcggataccgtactacgtggggcccctcggaaaaggagagggcagcgaaaagttcagttgggccgtccgccgcacagacgaagccatatacccatggaacttcaaagacgtcatagacgtagaagcgagcgcagagaagttcatctgccgaatgacaaacaagtgcacctacctctacggcgaagacgtactcccaaaagactcgccactatactccaagttcatggtcctaaacgaactcaacaacctgaaacttgacggccaatctgtgtcggtagaactgaaacaacggatataccaagaactgttctgccacacgaggaaggtcacccagaagaaactggtaagctaccttgtacgggaaggcatcaccgggaaaaacgttgaaatctccggtatagacggcgacttcaaagcgagcctcacagcctaccacgacttcaaagaaaaactaactggagtcgaactaagtcaacaggaacaggaggaaatcgtccgcaacatcgtccttttcggggaagacaagaagctactcaaacaacggctagaagggagattcccacaactaacccagaaacagatatcggtcatcgcaaccctatcctataaaggatggggaagactctcgcgcgagttcctcgaaaacatcactgtcccagccccaggaacgggagaagtatggaacataatcacggccctgtgggaaacgaacgacaaccttatgcaactgctatatggtgaatacggattccaaacagaaatcgaatgtttcaacgcaaaagagaagaagaaatcactttcgtacgaaaccattgaagaaagctacgtctcgccgtcagtcaaacgccagatctggcaaaccctccaagtcgttaaagaactcaagaaagtgatgagaggcgacccaaaacgcgtctttatcgaaatggcacgcgaaaaccaagaaagcaaacggacggaatcccgcaagaaaacgctcctagacctgtacaagaactgtaagaaagaagaacccgagtggatcgccgaactcaccgagcacctagaaaaactggacgacagccaactcaggaaagacaaactatttctatattacacccaaaaaggacgatgcatgtactccggggaacgcatcgagctcgaagacctatgggacaacacacggtacgacatcgaccacatctacccccagagcaagaccatggatgactccgtcgataacagagttctagtaaagaaagagtacaacgccaagaaaacagacgtctacccgattgcagcagacataagaggtaaaatgagccccttctggaagaaattactcgataacaaactaatatcgaaaaagaaatatgaccggctcgtccgcaccgaagaactaacgcccgaagaactagccggcttcatcgaccggcagctagtagaaactcgtcaatccacgaaggtagttgcagagatcttaaaagaggctttcccggacacagaaattgtttatgtgaaagcgggcaacgtatctaacttcagacacatgtttgacatagtaaaagtccgagaattgaacgacctgcaccacgccaaagacgcatatctgaacatagtagtcggcaacgcctattacgtaaaatttaacaaaaacgccgcatggttcataaaggaaaaccccggacgcagctataacctgaaaagaatgtttgactacgacatacgaagaaataatgaggtcgcatggcttgcaggcagcaccggcaccatcagccaagtaaagaacatggtcagtaaaaaccatatcctggtcaccagaaagagttacgaggtgaccggcggactgttcgaccagcaactgatgaaaaagggaaaaggccaagtccccgtaaaaacgtcggacgagcgccttggaaacattgaaaaatacggaggttacaacaaagcatcaggggcatacttcatgctagtgaaatcgaaaaacaaaaagggcgaagaacaacgcaccatagaatacgttccaatctacctcaaacactatatcgaagagtccaaagaaaacgccctcgattacctcaaaaacgaaagaaaattaaacgaaccagaaatcctcctcgacaaaataaagaaagatacactcttcagagtaaacgggttctacatgtgcctgtcaaaacgaaccggaaaacagctcgccttcaaaggggcgaacgaactgctcctgccagaacccgaaacactgctactcaaaaagataaccaaatacatccagcgccgcaaggaaaacaaagacctaaaactaacaaaacaagacaacataaccgagaaggaacttctcgagctgtacgacgtgttcactgaaaaactaaaccactccgtctatgcggtctgtctaggcacccaggggaaaactctggttcagaaaaagccagccttcgtggccctccccgtcgaggaaaaatgtatcgttctctccgaaatcctccacctgtttcaatgccaatccggcagcgccaatctcaaactcatcggagggcccgcatccgcagggatcctgtatctcaacagtaatatatcagatgccggagagatactcatcattaaccagagcccctcgggcatattcgaaaaacggatagacctcctcagactgtga

SEQ ID NO: 6466 - RNA, 4023 nt, synthetic construct
  misc_feature 1..4023: note = Cas9 variant
  source 1..4023: mol_type = other RNA
atgaagaaagagtacacgatcggcttggacatcggaacaaacagtgtaggatggtcggtcctgaccgacgactaccgtctagtctcaaagaaaatgaaagtagccggcaacactgaaaaatcttcaactaagaaaaacttctggggcgtaaggctctttgacgaaggccaaacagccgaagcacgacgatctaaacgcacagccagacgcagactcgcacgccgccgccagcgcattctggagctccagaaaatattcgcccccgaaatattaaaaatcgacgagcactttttcgcacgactcaacgagagcttcctagtccccgacgagaagaaacaatcccgccaccccgtcttcgcaacaataaaacaagagaaaagctaccaccaaacctacccaacaatctaccacctccgccaagcactcgcagactcctccgaaaaagcggacatcagacttgtctacttagccatggcccatttactgaaataccgcggccacttcctcatcgaaggagaactcaacacggaaaacagctccgtgacggaaaccttccgacaattccttagcacatacaaccaacaattctccgaagccggcgacaagcagaccgaaaagctcgacgaagccgtagactgtagcttcgtgttcacagagaagatgtccaaaaccaagaaagccgaaaccctcctcaaatacttcccccacgaaaagagcaatggctacctgtcccaatttattaaactaatggtcggcaaccaagggaactttaaaaacgtcttcggactcgaagaagaagctaaactgcaattcagcaaagaaacatacgaagaggacctcgaagaactgctggaaaagataggagacgactacatcgacctcttcgtacaagccaagaacgtgtacgacgccgtactattatcagaaatcctttccgactcaaccaaaaacacccgcgcaaaactatccgccggtatgatcaggagatacgacgcacacaaagaagacctagtcctccttaagcgctttgtcaaagaaaacctaccgaagaagtaccgcgcattcttcggggacaactccgtaaacggttacgcaggttatatagaaggacacgccacccaagaggctttctataaattcgtaaagaaagagctcaccggaataagagggagtgaggtattccttaccaaaatcgaacaagagaatttcctcagaaaacaaagaaccttcgacaacggtgtgatccctcaccaaatacacctctcggaactgcgcgcgatcatagccaaccaaaagaaacactacccctttctaaaagaggaacaagaaaaactcgagtccctcctgaccttcaaaatcccgtactacgttggcccactcgccaagaaacaagaaaacagccctttcgcctggctcatcagaaaatccgaggagaaaattaaaccatggaatttacccgaaattgtcgacatggaaggcagcgccgtccgattcatcgaaagaatgatcaacaccgacatgtacatgccccacaacaaggtcctacctaagaactccttactttaccaaaaatttagtatctataatgaactgaccaaggtccgataccaagacgaacgggggcaaatgaactacttcagctcaatcgagaagaaagagatcttccacgagcttttcgagaaaaacaggaaagtcaccaaaaaggatctccaggagttcctatacctcaaatacgacatcaaacacgccgaactctcgggcatagaaaaggcattcaatgcctcatacacaacataccacgacttccttacaatgagcgaaaacaaacgagaaatgaaacaatggctcgaagacccagagctcgcctcgatgttcgaagagatcatcaaaactctaaccgtcttcgaagaccgcgagatgatcaagacccgcctgagccaccacgaagcaactctaggaaaacacataatcaagaaactcaccaagaaacactacaccggctgggggcgcctctctaaagaactgatccagggcatacgagacaaacaatcgaacaaaaccatcctggactacctcatcaacgacgacgacttcccacaccacagaaaccggaacttcatgcaactcatcaacgacgactcactctccttcaaaaaggaaatcaagaaagcccaaatgatcacggacacggaaaacctcgaagaaatcgtgaaagagttgacaggctctccagcaattaagaaaggaatcctacaatcactaaaaatcgtcgacgaaatagtcgggataatgggctacgaacccgccaacattgtagtcgaaatggcacgcgagaaccagactaccggacgaggtctaaaaagctccaggccccgactcaaagctctagaagagtccttaaaagacttcggcagccagctcctaaaagagtatcccaccgataattcgtcactacagaaagaccgcctatacctctactacctccagaacgggcgggacatgtatacaggagccccactcgacattcaccgactaagtgactacgatatagaccacataatacccagatccttcacaacagacaacagcatcgacaacaaagtgctagtctccagcaaggagaatcgactaaagaaagacgatgtccccagtgaaaaagtcgtaaagaaaatgcgctccttttggtatgacctatattcttctaaactgatctcaaaacgcaaactggacaatctcacgaaaatcaaactcacggaagaggacaaagctggattcatcaaaaggcagttggtagagaccagacagataaccaagcatgtagccggcatcctccaccatcgctttaataaagcagaagacaccaacgaccccattcgcaaggtacgaatcatcaccctcaagtcagcacttgtctcgcaatttaggaacagattcgggatatataaagtaagggagatcaacgagtatcaccacgcacatgacgcctatctcaacggggtagtcgccctagccctcctaaagaaatacccacaactagcgcccgaatttgtctacggcgaatacttaaaattcaacgcccacaaagccaacaaagcgacagtcaagaaagagttctactccaacataatgaaattcttcgaatccgacacacccgtatgcgacgagaacggagaaatattctgggacaaatcaaaatccatcgcccaagtaaagaaagtcatcaaccatcaccacatgaacatagtcaagaaaacagaaatccagaaaggcgggttctcgaaagaaaccgtagaacctaagaaagattcctccaaactgctaccaaggaaaaacaactgggaccccgccaaatacggaggcctcggcagccccaacgtagcgtacacagtcgccttcacgtacgagaaaggcaaagctcgcaaacgaaccaatgcgctagagggaatcaccatcatggaacgggaggccttcgaacagtcaccagtgctgttcctgaagaacaagggttatgaacaagccgaaatcgaaatgaaactcccgaagtacgcactcttcgaattagagaacggacgcaagcggatggtagcctcaaacaaggaagctcagaaagccaatagttttctcctaccggagcacctcgtcactctactgtaccacgctaaacaatacgacgagatatcccacaaagaatcattcgactacgtcaacgaacaccacaaagagttttcggaggtcttcgcccgcgtcctcgagttcgcaggaaaatacaccctagccgagaaaaacatcgaaaaactagagaaaatctacaaagagaaccagacagacgacttagccaaactagcaagctcattcgtgaacctcatgcaattcaatgcaatgggggcacccgcagacttcaaattcttcgacgtcaccatcccacgcaagaggtacaccagcctaaccgaaatctggcaatcaacgattatacaccaaagcataacaggcctgtacgagacccgcatacgaatggggaaatga

SEQ ID NO: 6467 - RNA, 4023 nt, synthetic construct
  misc_feature 1..4023: note = Cas9 variant
  source 1..4023: mol_type = other RNA
atggagcaagaatactacctagggttagacatgggcacgggttccgttggctgggcagtcacagacagcgagtaccacgtcctccgcaagcacggcaaagcgctctggggagtccgtcttttcgaatcggcaagcactgctgaggagcgcagaatgttccgaaccagccgccggcgcctcgaccgccgcaactggcgcattgaaatactccaagaaatcttcgcagaagaaatcagcaaaaaggacccagggtttttcctcagaatgaaggaaagtaaatactaccccgaagacaaacgagacatcaacgggaactgcccagaactaccatacgctctattcgtcgacgacgacttcacagacaaagactaccacaagaaattccccacgatctaccatctgcgaaaaatgctaatgaacaccgaagaaacaccagacatccgcttagtgtacctagccatccaccacatgatgaagcaccgtggacacttcctactctccggcgacataaatgagattaaggagttcgggacaaccttctccaagttactggaaaacattaaaaatgaggaactcgactggaacctagagcttggcaaagaagagtacgccgtcgtagaatccatcctaaaagacaacatgctgaacagaagcacaaagaaaaccagactgattaaagcactgaaagcgaaatctatatgcgaaaaagccgtactaaacctcctagccgggggaacggtgaaactgtcggacatcttcggactcgaagaactgaacgagacagaacgaccgaaaatcagcttcgcggataacggatatgatgactacataggcgaggtagaaaacgaactgggggagcaattctacataatcgaaacagcgaaagccgtatacgattgggcggtccttgtagaaatcctaggaaaatacacgtccatcagcgaggctaaggtcgccacatatgaaaagcataaaagcgacctgcaattcctcaagaaaatcgtccggaaatatctcaccaaagaagaatacaaagatatcttcgtgtcaaccagcgacaagctcaaaaactactccgcctacatagggatgaccaaaatcaatggaaagaaagtcgacctccagtccaaacgatgttccaaggaagagttctacgacttcatcaagaagaacgtcctcaagaagctggagggccaacccgagtacgaatatctgaaagaggaactcgagcgcgaaacctttctccccaaacaagtgaaccgggacaacggagtcatcccataccaaatccacctatacgaactgaagaaaatattaggtaatctccgcgataaaatcgacctaataaaggaaaatgaagacaaactcgtacaactcttcgagttccgtataccctactacgtaggccctctcaacaagatcgacgacgggaaggaaggcaagtttacatgggccgtcaggaagtccaatgaaaagatatacccatggaacttcgagaatgtcgtcgacatcgaggcatccgccgagaagttcatacgccgcatgacgaacaaatgtacctatctcatgggggaagacgtcctccctaaggactccttactatactccaaatacatggtcttaaatgaactaaacaacgtaaagctcgatggagagaaactaagcgtcgaattgaaacagcgactatacacagacgtattctgcaagtaccggaaggtcacagtgaaaaagattaaaaactacttaaagtgtgaaggaatcatatccggcaacgtcgaaatcaccggcatagacggtgatttcaaagcgtcattaaccgcataccacgatttcaaggaaatcctcacagggacggaactcgcaaagaaagacaaggaaaatataattacaaacatagtcctcttcggagacgacaagaaactgctgaaaaagcgattaaaccgcctttatccccaaatcactccgaaccaactaaagaagatctgcgccctgtcgtacacgggctgggggcgcttctccaagaagttcctagaagaaatcacagcccctgacccagaaaccggcgaggtgtggaacatcataaccgccctctgggagtccaacaacaacctaatgcaattactcagcaacgaatacagattcatggaggaggtggagacgtacaacatgggcaagcaaacaaaaaccctctcatacgaaacagtcgagaacatgtacgtatccccaagcgtcaagaggcaaatctggcaaacactaaagatcgtcaaggagctagaaaaggtaatgaaagaatcacccaaacgggtcttcatcgagatggcaagagaaaaacaggagtcaaaacggacggagtccagaaagaaacaactcatagacctatacaaagcgtgcaaaaacgaggagaaagactgggttaaagaactcggggaccaggaggaacagaaactcagaagcgacaaactctacctatactacacacaaaaaggacgctgcatgtacagcggggaggtaatcgagctgaaagacctgtgggacaacaccaaatacgacatcgatcacatctacccacagagcaaaaccatggacgacagcctaaacaaccgcgtgctcgttaagaaaaagtacaacgccatcaagagcgacaagtacccactgaacgaaaacatacggcacgagcggaagggtttctggaagtccctgctggacggagggttcatatccaaagagaagtatgagcggctcataagaaataccgaactctcaccggaggagctggcggggttcatcgaacgccaaatagtcgaaacaaggcagtcgaccaaggccgtcgcagagatcctaaagcaggtattccccgaaagcgagattgtgtacgtgaaagccggcactgtgtcacgcttcagaaaagacttcgaactcctaaaggtgcgggaggtcaacgaccttcaccatgccaaagacgcctacttgaacatcgtggtaggaaactcctactacgttaagttcacgaagaacgctagctggttcatcaaggaaaaccccggcaggacatacaacctcaagaagatgttcacctcggggtggaacatcgagcgcaatggggaggtcgcatgggaggtcggaaagaaaggaacgatcgtaacagtcaaacaaataatgaacaaaaacaacatcctggtaacccgccaagtacacgaagccaaaggcggcctcttcgaccaacagataatgaagaaaggcaaaggccagatagcgatcaaagaaacagatgaacgcctggccagcatcgagaaatacggaggctacaacaaggcggcgggagcctacttcatgctcgtcgagtcgaaagataagaaaggcaaaacgatacgaaccattgaatttataccactgtacctcaaaaataaaatagagagcgacgagagcatagcgctcaacttcctggaaaaaggacgtggcctcaaagaacccaaaatcctcctgaagaagatcaaaatcgacacactcttcgacgtggacggcttcaaaatgtggctgagcggacggaccggagaccgcctactattcaagtgcgcaaaccaactgatcctagacgaaaagatcatagtaaccatgaagaaaatagtcaaattcatacaaagaaggcaagagaacagggaactcaaactctccgacaaggacggcatagacaacgaggtcctcatggagatctataacacattcgtagacaaactcgaaaacaccgtctacagaatacgcctgagtgagcaggcaaaaacactcatagacagacaaaaagaatttgaacgactatccctagaagacaagtcatccacgcttttcgaaatactacacatcttccaatgtcaaagcagcgcggcaaacctaaaaatgataggtggaccaggaaaggccggaatcctggtgatgaacaacaacatatcaaaatgcaacaaaatctccatcataaaccagagccccacaggcatattcgagaacgaaatcgacctcctaaagatatga

SEQ ID NO: 6468 - RNA, 4026 nt, synthetic construct
  misc_feature 1..4026: note = Cas9 variant
  source 1..4026: mol_type = other RNA
atgcgcttccagaacaagaagacaggcgactacttcgtcggactagacatcggcaccaactcggtgggctgggcagtaaccaatgaaaaatacgaaatactgcgagcaaagaaccaccgcatgtggggatccagactgttcgaagaaggaaaaaccgcagaagaacgaagggtgcaccgcgcaggaaggagacgcctcaaccgacgaaatgaccgcctaatgattctagaagacctattcgccgaagagatatctaaggtggacaaagcattctaccagaggcttcatgagagccaatatcgacaagaacataaaacagtctcagggccatacttcttattcaatgataaggagttcacagacgaagactaccacatcgactatccaacaatatatcacctccgcgtcgccctaatgaaagccccggccaaagacgtgcgactacttttcctcgccatacaccacatcatcaaataccggggaaacttcctacacgaaggcgagacattcaagactacaggaggcctcacggacattctgcagcgggtgctggcctgtaacgagttctccggactcaagcaacacattgacgacaccgcactcgtgaaactcttaacaaacaaaggcatcacccgatcggatatcgcaaagcaaatctccgaactcgccacggacaaactctaccggaagcaagcaaaggctttcgcgtccttagtcttagggctcaaagccaaccttgacgacctcttcaacgagcccgagtataaagaactagactccgaaatacgcaccgtggagttctccggcaaagaatactgggaagaaagagacaaatacgagccctatctcggcgaatcattattcgctctcgatggctgcaagaccctatacgacaccctcctcctctccaacatcaaacctgacggcaaatatctttccgaggccaaggtagaaacattcgaaaaacaccacgagcaccttgaatcgctcaaagacctcctgaaatccaacaaagccctctacaaccgcgtcctccgcgacgacgaaaagaatctcaacaactacatcacctacatcgggaaatccgaatttaataaacgatgcagtcgcgacgagttctacaaattcctcaaacagacaatcaaggacatttccgacaacgagaataaagcggagatcgtacagctcatggaactcgacagcttcctcccacttcttagggtgagggagaacggtgtcataccctaccagatacacgaggaagaactcgaacagattcttaacgtctccagcgagaagtaccccttcctcaataaagcagacggctccgggtttacaatagctcagaaaatccttaagctcctcactttccgcatcccctacttcgtcggacccctcaatccagcacacaaggaccgcgacaacggattcgcctgggtagttcgcaaggcacccggcaaggtctacccgtggaacttcgaagacaaagttgacatatcagcgagcgccaccgcattcatagaaaatctcacaaataagtgcacctacctgattggcgaagacgtactcccgaagtattcactcgcctatagcaaattctcgctcctgaatgaactcaacaacctccgctacgacggaaagcccctatcctacgaaacaaaacaatcgttcatcaaggactgctttgaaaaagagcatagaaaaatgaccgaaaaacgtatccgcgagtttctcaaacacctcgggggtacggacggcaaaggcgcgctcacgggactagacgtcgatataaaaagcgacctgaagtcgtaccgcgacatggtacgcatcctcggagacggattcgacgagaccatggccgaacgcatcatccggtacgtcacgctctttggggaggccaagaaagtcctcctatccacactcgagatagagttcggcgacgacctgtccgacacccaaaagaaacaaatactcaaactacaatatcgcgactggggtcggctcagtgctacactactaaaaggaatcaaaggggttgcgggcgacaaccccgagtgctccatcctagaatgcatggaacagcaacctctaaacctcatggaagtgctctcatcccacaatacgtacctcgcagctatcgaggaatttaacaaagaaagaaccgaaccaacagacatcgtggactacaaactggtggacgacctatacatctccccagcagtcaaacgatcagtttggcaaacactaaggattctggacgaaatcacaaaactacgagggagcgtacctaagaaagtcttcgtagaggtcgcccgcaccaaccgagccgagaaaaagaaaactgacagtagaaaagaacgcctcctacagttgtataaaactataaaagatgaaggacggaactggacagaggagatcaaacaacgcgacgccggggactttaactccaagaaactcttcctctattacacccagcagggccgatgtatgtattcgggagagaaaatcaccagcatcggagacctatttacatcaaaatatgatatcgatcacatatacccacgcagtgtcaccaaagacaactcctgggacaacctagtcctagtcaaagcagaattaaacagagagaaaaaggacatatacccgatcgaaaaggatacccaggaccgctgcatctccctctggaagcaactccttgaacaaggcctcatcagcgaacgcaaatacgagaggctagtgagaaccactcccctcaccgccgacgaactcgcggacttcgtcaaccgacaactcgtagagacgaatcagagcgtcaaagccgtcacgaacctgctcaagcgactctaccccgacacgacgatctgctacgtcaaagcagaaaacgtgagtgactttcggcaggagcgagagttcgtaaaactccgttctctgaacgcccatcaccacgcgaaggacgcctacctgaacattgtcgtaggcaacgtctaccacgagaagtttacgaataacccccgcaacttcatcaaaaacgcaagaagcgacaagaaacggccatacagcctaaaccacatgttcgactaccttctacaggtaggcaacaaagagatatggaatccaaaaaccgacaacaacctcgtaaagaaaatgatgcgcaacaatgatgtacaagtaacacgaatgctcgtagaacagaccggagcattatacgacgcaaccatctacaaagcgagcgtgaccaagagcgagtcatatgtcccgctcaagtcctctgacgcaattctcagcgacgtcaagaaatacggaggcttcacaagcataaagatcgcctactactcaatcttccgattttacaagaaaaattcagaggagttcgaaacccacatcatatccatccccgttttgaaagcgggaaccctcaatagtaaggaggattacgtagcatacggggaagaaatcatgaacaaacaaaaattcgaccgggtggaactcgtctataagaagctatgcatgaactcgctagttcgcataaacggcgtcatgtactacctcggaggcaaaaccaacaactctttgtacatcgactctgcaatttccctcgttctccctgacaacatcgccaagaaaatcaaagccgtcgaaaaatacatagcgcgagttgcggaaaacggcaactacaaaccgcagccagaccaggtcagtccggagttcaacatgattatatacaaagcgctaaccgagaaaatgaaacaaccagcattcgtcggcctaaaaactaacagagaaaacgaactagaaaaagaaaccaccatcaccgccttcatcgccatgaccctcatcgaacaatgcaaaatgctaatggaaatactaaacctcctaacacagcagaagacaacatacgccctgaagcccataggagtcagcgcctcacgcagcactctcggcatgaacatcacaggcctgtctgagttcacaatcattactcagtcggtcacgggcctacaggaaaaagaaatccgtatcatatga

SEQ ID NO: 6469 - RNA, 4026 nt, synthetic construct
  misc_feature 1..4026: note = Cas9 variant
  source 1..4026: mol_type = other RNA
atgtggggctctcgcctgttcgaggaagcatccacagcccaggaccgtcgggagcaccgcagcaaccgaaggcgtctcgaaagacgaaaatacaggttggacctgctagaagaactgttcgtcgaggaaattaataaaatagacccagagttcttcatccggctaagagaaagcaagttccactttgaagatcggtcccttaaaaacacattcatcctgttcaacgacaagatggagggaggatacaacgataaggtcttcttctctaaataccctaccatctaccacctacgttcagccctaatcaacggcaacaaagaagacgtccgcgccgtcttcttagctatacacaacattctcaaaaaccgggggcatttcctcctcgcaggcaacgatatcaacatctccctgtccctcaacgacacactgacagatctgttcgaatacctaaagatccacctaggcatcgaagtcgagttcgaaaacaaactgaaagacatcgagaaaatagccctcgacaaaaacctatctaaatccgacaaacagaagaaaatagtgcaactcctcgaaaccgactacaaaaagcagctcgccgacgtgtttaaattatcgctcggccttaccgccaacatggaaaacatcttcggcaaagaaaatgaacaaggcctcgagttcattaacgcagaaaacaagataaagaaaatacaattcgactcaagctacgaagaaaacatcgcggagttcgaccaattttacggagagtacttcgagataatcgacatctgcaaaaagatatatgatgccatatcactcagccagatcctcgtcgacggtaaaggactaagcgaaagcaaagtcctctcttacgaaaaacataaagaagacctcaagctcctcaagaaagtactcaagaacatcgataaggcttatgataacaaaggcgaagaccgcctcgtctacaaggtcctaaaggaggacaaggacaaagggaccaactatgtgaactacagcaaactttctaacaatgggacagctaccaccaaggaggagttctacaaattcttatccaagaatcttgacctcaagaagttcgggaaactcaacaaggaagacatcgaaacattagattacattaactcggagatcctgttaggtcgcttcctaccactccaaaaagagaagatcaacggagtcattccttaccaactgcaaatgaaagagctgacgcagatactcaacaacgcgtccaaatacctccccttcctaaacaaaatagaagatggcatgacagttaaggataaaataatatcactgatcaaattcaggatcccatactatgtcggaccgctcaacgaatacaaccgcatcgaaaacggaaacggcttcgcatggatcgaaaagaagaaaaacgagaaaatattcccctggaatttcaacgacgtggtagacatagagaaaagcgcagaaaagtttataaacaacctaaccaacaaatgcacgtatataaaagaagaaactgtcctacccaaaaactctattatatactcaaagttcatggtgcttaacgagctaaacaaccttcagtacggaaacaaaaagctcgacatcgagttaaaaatgaaaatgtatacggacctattcctagagaagaaagacaacagaaaagtgaccgaaaaacggatattggagtatttccgaataaacggcatcaacgacggtaaagaaaaactcaccgggctcaacaacgaaatccacgcggacatgaagtcctatcgcgacatgtgtgagatcatgggagaaaacttcaacataaacgtggccgaaaacatcatcaactggataacggtcttccacggcgaaaagaaaatcctcatcaacaaaatcaaaaatgtgtacggaaagatgttcaacgacgagcagataagcaagctatccaaactaaactacagcgactggggccgcctatccaaaaagctattaaccgacataaagtgctacatcgacgccgacggcatcaatttccctgtcagcatcctagaggccatggaagtcagcaacaagaacctcatggaactcctgagtaacaaatacgagttcatctcctgcatagacgacatcaataacaaatacttcggcgaccgcgacatatctgcgagtgaattgatagacgagctctacgtcagccctgccgtcaaacgaggcatttggcagtcagtgcgaatcctcgaggaaattgtatcaatcataggacacaacccgaagaagatcttcatcgagatgacaagacataacgaagaaaaagtccaaaaatcatcgcgtcggcataacctcgaggaactctacaaagctatccgcaaagacccggaatacgtggagctgattaaggaatttgacagcaccaccgacacagactcgtttaagatcaaaaagctctatctttacttcatgcaactcggaaagtgcgcgtattccaaagaaaagatcgacttcgacaaactcttcaccgactcctacgacatcgatcacatctacccacgttcgaagaccaaggacgacagcatacacaacaacctagtactcgttaaagctaaatacaaccgagagaagaccgacgtatatccaatcgacataaacatacagaagaacatgaactcattctggaacttcctctacaccaagaaattcatcaccgaggaaaaatataaacggctgatccgcacatcagacctaaccgacgaagaactagcaaaattcatatcacgccaactcgtagagacaagccagtcaaccaaagcaaccgcggaggttctcaaacagatttacggagacagcgacatctgctacgtcaaagcggaaaacgtaagcgatttccgctatgggtcgagccgccagaaggacaagaacgacatccaaaaactgttcgtcaagtgccgagaagtcaaccacttccaccatgcaaaagacgcgtacctcaatatcgtggtaggcaacgtgtacgacgtcaaattcacgaagaacccagtcaatttcattaagaaaaacaaaatgggtaacaaatccaactattcactgaaccacatgttttgcttcgacgtagagaggaacggctacaaagcctgggactcatcagaaacaataaaaactgtcggaagaatgatgaaaagtaacgacgtgcgaatcaccaaacacgtccaccccacgcgaggcgaactttacgacgccacgatatacaaagccaaaatcgccaagacgggatcatatatgccactaaaaagcagcaagaacaccccactgagcgacgttacaaagtacggaggatacactaaaattaaaatcgcctactatagcgtctacaaatacaagttctcggacaaaaaccttataaagactgaaattcgactcatcccaatcccgatatacctctccaagaatgatgacgacatcaaggaatacgtcaaaaactaccttaacgatagagtaaactccaaactcatcgactttacaaagatatacgacaaactttacgttaacagcttaataaagatcaacggatacctttactacctagggggaaaaaccaacgatcgagtctggatcgacaacgcggtctcaatagtcttagatgacaaaatcgagtacctcattaagcgtatttcaaacgatatcaaatacgggtatgagatcaacgtttccgacgacgaactaatggacatatacgagagcctggccgagaaagccaacaagaagatattctataaccgcctcagcgacttcgaaaagatcttctctaatatggacgtcaagaaaaagttcgtcaaactcgagaaaaacgataaatgccgcgttctcctccaactcctcaacgtcttgaccgactcgcaaaccacatacaaactggaaatggtcgggctgaaacacagccgctcaaacatagggatgaaaatttccaatcttgaggaatttaaagtcatcaactcgtctatcaccggcctctactccaacgagatcgacatcctaaacatatga

SEQ ID NO: 6470 - RNA, 4026 nt, synthetic construct
  misc_feature 1..4026: note = Cas9 variant
  source 1..4026: mol_type = other RNA
atggaaaaagactattacctcggcctcgatatgggctccggtagcgcgggctgggccgtgacggacgaccaataccacgtcttaagggcacacggaaaggcgatgtgggggactcgcctgttcgaaagcgcaaacacggccgaagaacggcgaatcaatcgaaccgcacgacgacgcctcaaacgcagaaaccaacgaatcgaatggcttcaagagatattcgccgaagaaatcaacaccaaagactctggcttcttcagacgaatgaaagagagccgctactgggcagaagataaacgcgatgagaacggcagctgccccgagatgccctactccctctttatagacgaagacttcaccgacaaggagtatcacgaaaagttcccaacgatataccatctgcgcaaatacctcatgaccacagaggaaacaccgggcatccggttggtatacctcgcgttccaccacatgatgaaacaccggggtcacttccttctcaacgggaacatagaggagatacgcaaattccggaagaccttcgatcaattcctcgaagtcgtcagaaacgaggaaatgggatttgctggagaaatcgaagaagaaacgtacaaaaagatagaaatgaccctcaaagacgtaaacctaacccgcagcgcgaaaaagactaccctgattaaaagcctcaaagtaaccagggtagaagagaaggagctgctggcactcatcagcggctgcaccgtgaagctatcaaacatctttaacgacaaatccctggacgaaaccgaaagaccgaaaatctcatttgcggacgccggattcgatgactacgaggcagagatccaaagcaacctcaacgagaaatactacatcatcgagagtgccaaggcagtatatgactgggccgcgctggccgacatactcggcgagtacagctgcatttcggaagcaaaagtcgccttatacgaaaagcaccacaaggatctcaagcgcctcaaggatctcgtgcgcaataacatcagctctgaagtctataaagaaatcttcgtcgacgtttccggcaagtacaagaattactgcgcctacatcgggaccaccaacataaacggcaagaagaaggacttcgaagggaagaaatgcaccaaagaggacttctacgcatacttaaagaaatccgtcatagagtgcataaatgactcggagaaaacagactggctcaagctcgaattggagaagggcaactttctaccaaagcaactaacgggggaaaactcggtcataccctaccaagtgcacctatacgaactcaacgccatcatcactaacctacaggaacgaataccgcttttgaagcgcgacggcgagaaaatccgccaaatcttcaccttccgagtaccttactatgtcggcccactgaacggcatcagcatcgatggcaaaaagacgaattgggtaaagcgaaaggaaggggtgatctatccttggaacttcagcgacatcgtagacgaagaaagctccgcggaatcatttatccggcggatgacgaataagtgcacgtaccttatccacgaagacgtgctacccaagtactcgctgctctactcacggttcgaggtactaaacgaactaaacaacgtgcgcctcaacggagaactactgtccgtcgaactaaaacaaaagatctacgaagacgtcttccaaagatatagaaaggtcacgcaaaagcgcctcaagagatacctactaacagaggggataatcgacgaaaacacagtaatcaccggtctagacggcgacttcaaagggtcactcaccgcctaccacgacttcaaagaaaaactaacaggcctaaacctaacagaacgggaaaaggaagaaatcatcctgaacataaccctattcggcgacgcgcgaagtctgctccgaaaacggataggaaagatatgctcacaactctcggacaaacaaaaggagaatctatcgaagctgtcctaccaggggtgggggcgcctgagtaagaaatttctcaacggcattgccatatccgtgcaaggcgaggaagaatggacaatcattaaagccctgtgggagactcaggacaacctttcacaattaatgggcgccaagtacacatttaggaacgcggtcgagaaggaaaacggagaactggaaaatcgtgaaatctcatacgaaactgtaaaggacctgtccatctcacccagcgtaaaacgccaagtctggcagagcctactaatcgtaaaggagatatgcaaaatacagaaaaagccccctaggaaggttttcgtcgaagtagcaaaggagaagacaaactcaggacgcaccgaatcacgcaagaaacgccttcaagacttctacaaatactgctcgaaatacgagaaggagctgtacgacgaatctatccagaacaaactggagaaatgctcagagtcggacctacggtctgacaaactattcctctactacatgcaaatgggtaggtgcatgtacacaggacagccgattgacttcgacgagctctggaacaatcaaaaatacgacatagaccacatatacccccagtcaaaaacaatggacgactcaatcgacaatcgcgtcctagtcaaacggatatccaaccaagagaaaacggacgtctaccccattcgggcagacatacgagaaaaacgacggggcttctggaaagaactcaagaacgtcggactcatatccgaggaaaaatacaagagactcaccagagccacagaatttgagccagccgagctggccggctttatctcccgacagctagtggaaaaccgacaaaccacaaaagtggtagccagcatcctaaagcaggctatgccggacacagaaatcgtctacgtgaaagcgcgcaccgtcagcgaatttcgccacaagttcaacttcatcaaggtccgcgaaatgaatgacttccaccacgcaaaggacgcttacctgaacgtagtggtaggcaatacctacctcgtcaagttcacaaagtccccggtcaacttcatcgaaaaccactccaatagatcctacaatctcaagaaaatgttcacggacggaagagtcgaacgtaacggagagatagcctggattagcggcgagaacggcacgatcggcaccgtgcgcaacataatgaagaagaataatatcttggtgacacgccgagcccacgaagctacgggcggctttttcgaccagcaactcatgaagaaaggaaaaggacaagtccccgtcaaaggatcggacgaaagactgctggacatcgagaaatacggaggatacaacaaagaaaccggcgcatacttcgtcctagtggaatcagacgaaaagaaaggaaagaagaaacgcaccatcgaatacgtccccattagactcaagaaacaactcgaaaataacagaaaagccctcgaaaattacctctgcgagcagcgtggcctgaccaacccagtagtgctaatcgacaaaattaaaatggatagtctatttagagttgacggcttcttcatgtggctcagcgggcgcacgggtaatcaactactattcaaatgcgccaaccaactcgtcctatcaacggaagacgaggccacactcaagaaaatagtaaaattcgtaaaccgacgcaaagaaaacaaagaaatcaaaatatacgaaagcgacaaactcaatgaggaaatgctcaacaggctatacaacacattcctctacaaattgcagaactcaatctatgggaaccggctaggcgaacaggccaaaaccctgagctcaaagaaagaaaatttcgacaaactgcagatcgaagagaaatgtctagtgctgtacgagatcctccacatgttccagtgccaaagcgccacaagcgacctccagctaatcgaaggacccggcaaagcgggaaccctccgactaaactcaaatatcaccaaatataaaaacatcaacatcatcaaccaaagcccaacgggtatctacgaacaggttatagacctccagaaaatatga

SEQ ID NO: 6471 - RNA, 4026 nt, synthetic construct
  misc_feature 1..4026: note = Cas9 variant
  source 1..4026: mol_type = other RNA
atggggaagggctactacgtcgggctggacatgggaaccggaagcgtagggtgggcagtcaccgacgaatcataccagatcctgagacggcacggaaaagccatgtggggcgtccgactcttcgagtccgccaagacagccgaagaacggaggatgttcagaaccggaagacgccgcctcgaccgccgcggctggcgcatagaaatcctacaagagatcttcgccgaagaaatatccagggtggacccggggttctttctccgcatgaaagaatccaaatactacccggaggataagagagacatccaaggaaactgcccagaacttccctacaccctatttgtggacaagacgttcactgacaaggactttcacaagaaatacccaacgatctaccacctccgcaaaatgctcatggagacagaagacaccccggacatgagactcgtctacctcgcgctacaccacatgatgaaacaccgtggacacttcctactgtccggggatatcagccaggtcaccgagttcaaaaataccttcaatcaattcatagaaaatatcaggaacgaagaaatggacttcgaaatagaactggacgaatccgcagtacaaatgatcgaggaaacgctaaaagataaaaacctaacaaggagcgcgaaaaagagcaagctcgtaaaggggctcaacgccaaaaacgtgcgcgacaaagccttcctaacccttctctccggcggaaccgtaaaactctccgacctcttcggcatggaagaactaaatgagggggaaagacccaaaatatccttcgcagacaacggatacgaagagtacgcagcggtcgtcgaaatggagttgggcgagttatattacatagtggagagcgcgaaagccgtctacgactgggcaatcctatccgacatactaggaggcagcacgagtgttagcgacgcaaaagtaagggcctacgagaagcacaaggcagatctcaaatacttaaaagctgtagtgaaagagtacttccccaaggaagtctataacgccgtgttcgtagaatcaagcgacaagttaaacaattacccggcctatataggcatgaccaaaaagaatggcaagaaagtgtcgctcgaaggaaaaaggtgctcccgagaggaatttatggacttcctaaagaaaaacatcgtcgtcaaactcccggacgaggaagcaaaaatgtacttgcaaagcgaactcgaaaaagacagcttcctcccaaaacaggtcaacaaagacaacggcgtgattccctaccaggtgcacaaatacgaactcaaaaagatcctcgacaacctgggcgacaagataccgttcctgaaggaaaacgcagaaaagatcgagaaactgtttagcttccgcattccatactacgtaggccctctccgtacaggtaatggggaaaactcgaaatttgcatgggcggaacgaaaatctacagagaaaatctacccctggaacttcgaaaacgttatagatgtcgaacaatccgccgagaacttcatccgccgaatgacaaacaaatgtacctaccttatcggcgaagacgtcctaccgaaagactcactactctacagcaaattcatggtactgaacgaattaaacaacttacgcctggacggccagaaaatttccgtcgaactaaaacagaaaatctaccgtgacgtgttctgcagaagtcgcaaagtaacgcaaaagaagctcaagtcctacctaatacgcgaaggaatcgccggcaaaaatgtagagctaacgggaatagacggcgacttcaaaggctcactcacagcctatcacgacttcaaggaaaagttaatcgacgtggagctcacgcaaaaagagaaagaggagataatcctgaacatagtcctcttcggcgatgacaagaagctgctcaaacagcgcctcaaaaagaagttcccacaactaacagaaaaacaaatcaacacagtgacggcactgagttataagggctggggaaggctcagcaagaaactcctcgaagaggtgacggtacctgcaccagaaaccggcgaggtgtggaacataattacagccctatgggagacgaacgacaacttcatgcaactcctaagcaaagaataccagtttagcgaccgcatcgaagagttcaacgaagaaaaggccgaccccgaagtgtcctaccagaccatagaggacctatacgtaagccccgcagtcaaaaggcagatatggcaaacactacagatcatacaagaaattgagaaagtgatgggcgagaagcctaagcgcgtattcgtcgaaatggcacgagaaaaacaggagaacaaacggactgaatcaagaaagaaaacactaagcgacctctacaccaaatgcaagaaagaggaacccgaatggatcgaagccctctgcacaagcctcgagaaacacgaggagcaccaactcagatccgacaaactatacctatactacacgcaaaaaggccgatgtatgtactcgggcgaacccatagatctggaagacctatgggacaacactaaatacgacatcgaccacatctacccgcagtcaaaaaccatggacgactcactgaaaaaccgcgtcctagtcaagaaagaatacaacgccaaaaagtcagacacttatcccatcgcagcggacattcagaagaaaatgatgccattctggaaaagccttctaaccggaggcttcatacccaaagaaaaatacgatagactcgtacgcaacaaccccctcgacgcgaacgagctagcaggattcatagaacgccagatcgtagaaacccgccaaagtaccaaggcagtggctgagatactaaagaaaatcctaccagacacagaaatagtatacgtcaaagcaaaaacagtatcgaagttccgccaggacttcgacttcatcaaagtccgagacatgaacgacctacaccacgccaaggacgcctatctgaacatagtggtaggcaacgtgtacttcgtgaagtttaccaagaacgccgcgtggttcgtaaaagaaaacccggggcgaacctataacctcgaaaagatgtttatatgggacgtcgcacgagatggtgaaatagcctggaaggcaggcaaaagcgggtccatagtacaagtccgagcaatgatggagaaaaaccacatactcgtcacccggcgcagctacgaagtcaaagggggcctattcgaccagcagatcctcaagaaaggtaaaggacaagtacccgtcaaagaaagcgatgaacgactacgcgacatcggtaaatacggaggctacaacaaagcggccggcgtgtactttatgctagtaagcagcaaagacaagaaagggaaagagcaacggaccatcgagttcgtgcccatatacctcaaagatcgggtggaaaaagacatggaatccgcgagaaactacctaatggaagaacgaggcctcagagaacccaaaatcctgataaagaaaatcaaaatcgatacactgttcaaagtggacggattctacatgtggttgagtggccgtacgtcgaaccagctaatattcaaaggagcaaaccaactcatactatcgaaagaggacatgaaaaccctcaagaaagtcgtcaaatacatacagcgccaaaaagaagacaaaaacgtaaaaatcagcatgcgggacggaatcaccgaggaggaactcctaaaactttatgagaccttcctcgacaaaattcggcactcgatctacggagcgcgactgtcctcgcaggagaaaaccctcgtgaacggaaaagaaaaattcatcgatttaagcgtagaagcaaaatgccaggtcttatacgaaattctccacctgttccaatgccaaagcggagctgccaatctgaaaatgatcggaggccccgcaagcgccggaatcctagtcatgaacaacaacatatccaagtgcaagaacataagcatagtcaaccaatcgccaaccggaatatatgaaaaagagatcgacctgctgcgagtatga

SEQ ID NO: 6472 - RNA, 4026 nt, synthetic construct
  misc_feature 1..4026: note = Cas9 variant
  source 1..4026: mol_type = other RNA
atgacccaaaaagttatcccatacaacataggcctagatatcggcacgaacagtgtcggatgggcggtaaccgacaacgagaacaaactcttgcacatcaaaggacacaacggcataggtgtccgattattcaaagagggacaaagcgccgccgaacgctgcggattccgaaccaccagaagacgactgtctcgacggaaatggcgtcttagactgctcaacgagatcttcgcagacaaaatagcaaaagttgacccctcctttttcgcgcgcctaaaacaaagcaacgtaagccccaaggaccccaacaaaaccatgttcggaaacatcctcttcgacaacggcaacctaaacgacaagtcatttcacgacgaatacaaaacgatataccacctcagacaatcgataatcgaccatccggaaaagaaattcgacatccgcctcatatacctcgcaatgcaccacataatcaagtataggggccacttcctaaaccaagcgaacgtacaagacttcaaagggggaaaaatcgacctagaagagagctttaaagacctcaactcaatattcgaaaaccaaggacgcgaccttcgtctcgtaaccgaagacgccaacaaatatgtgaaggaactgtcggacaactccaagaccaggaacgatcgccagaaggagctatctaaagtcctctacataccaatcgacaagaactccgataaaaacaacaagaaagtgaccacagaaatcatcaaggcaatcctaggtatgaaagccaagttcgatgtaatatttggaatcgacgccgaaaacgccaaagagtggagcctaactttcaacagcgatgacttcgacgataaaatagaaggtctctcggcccagatgacagacgaagccggtgaaatcctactaatcttaaaagaactctactttgcactcaaccttagtgacatactcaacaacagcgtaacagacaaaaacgcgaaaaccctatcagaggccatgataaatcgctacgacgaccacaaagaacaactcaccatgctaaaacaagtcatcgataactccgacaagaaacacgccaaggcactcaaagcggcctacagcgcctacatcgacggcgaaaacaacaagaaaatcagcttcgaggacctcagaaaaagaatccaaaagaatctcgacaacagcgaaacgtccaagaaaatcaacgacctcctcgaacacgactatttcttgcctaagcaacgcagtaaagagaacggcgcgatcccccaccaactgcagcaacaggaactcgacaaaataatcgaatcccaaaaacactactaccccttcctcgcagaactcaacccaaacgaaaagcggtcacgtcaggcgaaatacaagctcgacgagctagtcgccttcagggtgccctactacgtcgggcccatggtcaaagcaaccgaaaacaatcagtccaacaacggtaaattcgcctggatgattaaaaacgacaacatatcggacaaactcaagaaagaagaaatcaccccctggaacttcgacaagaaagtcgaccgcacggaaaccgccaccaaattcatcacccgcatgacaacgacagatacatacctaataggcgaaccggtgttacccaaaaactcgctgctctaccaaaaattcgtagtgctaaacgaactaaacaacctaaaaatcaacaaacaacccataacaccagagcagaaacagtatgtctacgaacacgtaatgaaacagacaaaacgagtctcactgaaaaagatcgcggatgctctagtgatcaaaggggactatccatacgcccccgaaatcacaggcaccactgaccaaaagaacatgaacaacggcctgagcacctatattgacctcgcaaaaatcttcggtgacgagctcgacgacatcgaccggaaagaggactttgagaaaatcatcgaatggtcaacaatattcgaagaccaacacatcttcgccctcaaacttaaggaaattaaatggctaacggaggaccagaggaaacaagtcgtcaaactcagataccaaggctggggaaaactctccaagaaactgctagcagacctcgtagacgacaacggccagaggataatcgacctgctatgggactcaaaacaagatttcatgcaaatcgtgaaccaaaattccttcaaacaggccatagccgaacacaacggagctcaccttgaagagaaggacctaaaagatatcatcaacaacctctacacatcgccacaaaacaagaaagccatccgacaagtaatcctagttgtagacgacataatacgcgcagtgggctacgaaccggtcaatatcatgatggagttcgcaagggaagattccaaagaccaccggctcaccaactctcgatcgcgccaactggagaaggtctacaaagacatcaccaattcctggttcgacgacgacaacgtcaaggacgagctgaaggataaaatcaaggacaaagcgaaattcacggaccggctgtacctctactttacccaaggaggcaaggacctatatacgggcgagccattggacatcgacaacttgagcaactaccagatcgaccatattctgccacagagcttcatactagataattctctcgacaaccgcgtgctaacctcgaagataaacaaccaaatcaaaaaggacaacctccccggcgagttcttcggaagcaagatgcacaacttttggaaacacctaaaggaactccacctaatcagcaataagaaatactacaacctcaccctgacccccaacagcatatcaaaattcaacaaccaaggtcgcttcataaaccgccagctagtggaaacacgacaagttatcaaacttgcagccgaaatcctacacaaccgctacagtgaagaaaatggaactaacatcgtcaccgtaaaagccaatctcacccaccacatgcgcgagaaattcaacttctacaaaaaccgtaacgtcaacgattaccaccacgccttcgatgcctacctagccgcattcgtcgggaactggctcctccaacagtaccctaaactaaaaccttatttcgtgtacggcgactttgccaagacggaaatagataacctaaaatcattcaacctgatatacaagttcgagcaggcccaccaactaaatgaagaggacggcaaaattgcaaaggataccgacgcactgctgggctacatgaaaaacgtgtaccacttcaagaaaatgctggtcaccaaagagttagaaaccaaccacggaaacctcttcaaacagactctgtacccaagccatggcaaaatgaagaacctaatcaatccaaaggagaaccggtcctccgatatttatggagggtacagcagcgaaactggcgcttacgtgtcactgatcaaagtcttcaaaaagaacaagatagaaaacaagatcataaaaataccgcttctatacattgataaactgaaccggcaagcgaacgcaaaacagtttatccggaacttcatcatcaaagacgactcaaacaaattcgacatactatccgaaaagatattcctgaaccagctcgtcattgacggcgacgagctattcaccatatctggctccggtgaccggcagaacgcccaacaactaattctcagcgacaaatcactcaagatcctctccaagaacatcaacgtcatcagtaagaacgatctcatcataatattcaacgaaatcatcgacgacatctgcaagtatatgaagatgtacgaagtcgaaaactcagacgaaacaaaagccaaattcgaggaaatcaatgacaaagacagaatgctcaaaatcatcaacgaccttctcttgggcctccacgccaacgccagccgcagcaacctcagctccatcgggctctcccccagtttcgggcgcttcttctcgggaaacgccggcatcaaactcagcgagaacgccaagttcatctatcaatcccccacagggttattcagccgtaaagtaaagatatccgacctgtga

SEQ ID NO: 6473 - RNA, 4032 nt, synthetic construct
  misc_feature 1..4032: note = Cas9 variant
  source 1..4032: mol_type = other RNA
atgacatattacctagggctcgacatgggtacctcaagcgtcggatgggcagtgacagacgagaactacaatctgatacaccgccatcgcaaagatctatggggaatacgtgagttcgaagaagccaaaacggccgtggaacggcgcacccaacgcatcagccgcaggcgcagacagagggaagtagccaggatcggactactgaaggactactttcacgacgaaatacaaaaagtagaccccaacttctatcagcggctcgacaactcaaaatactttccggaggacaaggaggaggtcgtcaaaggtaaaaacgggatcttcgccgacgagaattacaccgatcgagactacttcgcggagtacccaaccatattccacctccgacgagaactacttaatagcaaggaaccgcacgatgtgcgactgctctatctggccctactcaatatgtacaaacacagaggacacttcttaaacaccacgctcggaaccgatggcgagaaccgcaaactaagtgacgtgtacagagacttcgtagtaaaaacagaggaagtactaggcctgaccttcccacaggagaccgataacggaaaaatgcaagaaatcatgtgcagccgggagttctcccgcaagcggaaagctgaactactatgcgccctcctggaaatagacaagaagcagaagcaacaagtagcactcatcgaatgcgtattaggactagacaagagcgtcaagcaaatgtacggaacggcggtaccggatgacttcgacaagtccgtcaaggtaaacttctcggactcgagcttcgaagaaaaagtaagcgaagtagaagaactgctcgacgaagaaaagtacgagctaatcctatgcatgaaggagttgtacgacaccgccgtattaaaccagataatgggagactgcaactacctatcagaagcacgagtccaggaatacgaaaaacataaggaggacctaaagctactgaagcgaaccgtcaagaaatacgggacggccgaggaataccagttcctgttccgctcaagtgagaaagcgtcatacaacgcctacgtccactccgtgaacagtggcgagaaaatcagaagaaacatggacggccggagccgggacgacttatacacagtactcaagaagatgctcaaaaattacccgcaagaagacgcagattgcaaatatatccttgaagaaatagagaaagagcaattcctgcccaagcaactcgtcagcgacaacggggtgatacccaaccagattcactacaaagagatgaaaaagatactggagaacgcagaacagtaccttcacttccttcgcgaaaaagacgagtcgggttacacggtagccgaacgcatactcaaactcttcgccttccaaatcccgtactacataggaccgacaagcgaaaagtctggcaaaaacggcgggaacggatgggtggtcaggaaagaacagggccaggtgctaccctggaacatcgaagaaaagatcgacatgaaggccacctccgaaacgttcatatcgcgaatggtgcgccgctgcacctacctcagcgacgaaatggtgctccctaaagcaagcctcgagtacgaatcgttttgcgtactgaacgaactgaacaacctaagaattagaggggtcaagctcccgatcaccgtcaaacaagacatctacaaagacctgttcgagaggggaaagcgggtgactcggaagcagatcgtgaactacctcaaaggcgtaggaatactgcaagagggagaagaagacgagctgaccggtatgatggacacgttcaactcgagcctagcctcgtacgggaaatttaaatcaatcctaggagagaagatacaagaggactcgtgcaagcggatggtcgagcaaataattttctggtgtaccatctatggggacgccaagaagttcctaaaagagcagctcgaagaaaagtatggcgatgtcttaacccgggaacaaatcaaacgaatactagggttcaaactgaaggactggggcaacctgagcaagaaattcctcgaactaaacgggtgcgatagaaataccggagaagtgatgtcactcatacgaatgctgtgggaaagcgatgacaatctaatggagctactcaaagacagttcatacacataccgggcggagctcgaggaacagcaggagaaactaacaaaaaccctcacggagatctgtccggaagaccttgagggatactatttctcggcacccgtcaagaggatgatatggcagacgctcctaatcctcaaggaagtggaaaaagtaatgggcgagccgcccaaaagagtattcgtcgagatgacacgggagcacgacgagcgcagagagatgaaagacagccggggaaagaaattccaggaactatacaaaaacatcaaagacgaggaacataactggaaggccgaaatcgaggacgcggagaaagatggccgcataaggagcaagaaaatgtacctatatctaacacagcgcggccggtgcatgtacacgggaaacccaatcgacctggaggaactcttcacaactaaatacgacatagaccatatctacccacgtcacttcgtgaaagacgacaacctagacaacaatctcgtactcgtagaaaaagagaagaacgcccacaaaagcgaccaataccccttgggagacgacatatacaccggtcgactctcgtggtggaaggaactgcaccgagagaaactaatcaacgacgaaaaatacaagcgactgacagggagagccccattcagcgacgaacaaaaggccgggttcatagctcggcagttggtggagacgagtcaaggaacaaaaggagtagccagtatattgaaagaggtactaccggaaacaaccacaatcgtgtatgcaaaagcccgcaacgtaagcgacttccgaaacaccaacgaactgctcaaagcacggagcgtcaacgacttccatcacgcccaagacgcgtacctgaacatcgtagtaggaaacgtctattacgtcaaattcacgaacaacccactcaactttgttaggtcaggcgagggatacaatctggacggagtcttcaggaagaacgtgatccgaggccaggagaatgcgtggatcgtgaagccggagaagggagagaaaatgacgctcgaaacagtaaaacgagtaatggctaaaaacacaccactgctgacccgacttagcttcgagggcagaggagggctggccaaccaaacactatattcagccaaggaagcggcgggagaagggtacgtccccctcaaatcctcggactcacgactacaagatgtaaccaaatacggcggcttcactagcgttacaaccgcttacttcatcctagtggagcacgacatgaaaaagaaacgcgtacgcacaatcgagtcagtgcccatattatggaaagagcggatcgaaaaagagtcaggacagctagaaatatactgcagagaagcattaggcctcgtcaatcccgacatcagagtacgaaagatactgatacaaagccttgtaaagaaggacgggttttacatgcacctatcaggtaagaccggcaacagattcataatgcgaaacgcggtagaactctgcctaaagcaggaatggatcaactacagcaagaaactcgagaaagaggggtgcgacgaaagtataacgaaagagaaaaatgaagaactctatgaaatactcaaggaaaagcatatcaacgggatatacagaaaaagacccaaccccatgggagaaaaactacacataagacaggaaacgttccgaatgctgacactggaagaacagaagaaagtcctgctgagcctcctcaacctcacaaagatcggccccgtcgaagctaatctcgaacttataggggaaagcgcgcacaccggcaaaatgctgatctccaaaaacatcaccgaggtcaaagagttctacttaatccaccagtctgtgactggaatctacgaaaaacaagtaaacttactgacagtctga

SEQ ID NO: 6474 - RNA, 4032 nt, synthetic construct
  misc_feature 1..4032: note = Cas9 variant
  source 1..4032: mol_type = other RNA
atggccaccaagaaagaatacaacataggcctcgacatcggaaccacttcggtgggttggagcgtcgtagaaaccgacaatcaaaaagtgatgagaaaaggcaataaggcactatggggagtccgactctttgaagaagccacaaccgccgaatcaaggcgaatgcagcgatcaacacgccgccgttacgaccgacgccgggagcgcataaaactcctacaggaggaattttcggaagagatcaacaaggtagacaaaaacttcttccaaaaactcaaggaatccaaatacgtagaaaatgataagatcaacaaaaagatcgtcctgacaaaggaagaaaagcaagaactcaaggactaccagaacaagtacaagactatctatcacctccgagatgaactgataaacaatccagagaaaaaggacatacggctggtctacctggctatacaccacatcataaaatacagagggaacttcctctaccaaaacgccaacttcaatatagacaacctagacatcaaggacaaactcaacgaactcttctcgatcctgtcaaacaacattcaagaactcgaaatacccgaggactacattaacatcatagacttcgacgaactagaagcggatctgctcaaggacaccaaaaatgatgtgaaggctctccttatcgacaacttgacagaactaacaaacaagagcagtgcgaccgagttcgggaagctgatggtaggaaacaaaggcaacatcaataaactcctaatgctagaaacagacaacaaaatcgagatttcgttcagcggcacagactacgacgataaatacgaggagtaccaggaagcactgggggagaacatcgaaatcctagatatactcaaacaaatatacgactgcatcttcctcaagaaaatcttcaaaggcaacaaaaacacatccatatccagcctaatggtcaagtcgttcgaacagcacaaaaaggacctgaacttcctgaaggaactcttcaaagataaccgcgaactctacaacgaaatctttcgtacaaagaaagatctttgcctctacgagaagtacataacaaacaagatagactgtgatgagttccggaaggaaataaacaaactactagagagtctattctcggacgaaaacataaaacagaacctcctagacgaatacaatctagaggttaaggagcgaatagagaatggcacttttctgccccgaataacgaccacagacaacggcaagtacccttaccaattgaacaaaagtgagctaataaagatcatcgagaatcagggcaaatactatccgttcctcctcaacaaactcaacgataacaagacctacaaaatcgtaaagctattagagttccgtataccatactacgtcggccccctcgtttccgaaaagcggagcgaaaactcatggttggaacgaaaaataaacaacgtcaaaataacaccatacaacttcgacgacgtcgttgataaggaaaagaccgcggaaaagttcatcaaacggatgatatcccattgcacttatctcctggacgaatacgcactagcaaacaacagcatcctctacagcgagttcaaggtcatgaacgaactcaagcaaatccgggtgaacgaccgaaagttggaactcaaattccagcaacaaatccttgaagacttcttcaaaaagactagcggaaccatcaccgaacggaaattcaagaactacctcatatcaaccggagaatatagcatggaaggcggcaactttagaataactggctactccgccgacggaaagttcgcgaataacatgcagagctacgtcgacttcttcggcgaaaacggtatttttgccgacaccgactacaacctagagaatgccgaagagatcatcgaatggataaccatctttgaagacaaagacatcctcgaaaagaaagtcagggacaactacagcaaactaaacgagaatcagatcaagaaagtactagccaaaaagtacagcggctgggggtcactctcgaaaaagctgctcaaaacaaaatactacaaggacaaggcaaccgaactctacaagtccatcctcgacctcatgtacgaaaccgacaaaaactttatgcagatcataaacgacgacaaatacaactttcaagaaatgatcaaaaagttcaacaataaagaagaaaacaagaaactcaattacagcatagtcgaggaactagcaacatcgccggcaaccaaacgaggcatctatcaggcactcaaagttgtcgaggagctagttgactacataggctacgaacccaaaaacatctcaatcgaaatggcgcgctccgaagaggagaaagtccggaaagacagtcgaaaagactacattaacaacctatacaaaggttgcaaagactcgatcgaaaactataaaaagctcaaacatgagcttgacagtcacgaaataactagccagcgcctcttcctctacttcatccaagaaggcaaatgtctgtacaccgggacaccacttaacatcgaagacatcgaaaaccagtcactgtacgaaatcgaccacatcattccccgcagcctcatcaaagacgacagcatagacaacaaagccttagtactgaaagaatgcaaccaggacaagaaagccagttacgtgctcccctccaaatttcgaaacagcaaacagaagacctggtggaaacacctcaaagacaacggactcatgagcgcaaagaagtttcacaatctaatcagggaaaaatacaatgaagaggatatcaatggcttcataaacagacaactcgttgagacaaggcaaatcaccaagcacgtggccaacattctaaacaacctatacaaggacacaaacgtaatctacctcaaagcagacctctcgcacaactacagagaaaagtacgacctatttaaattcagagacatcaatgactaccaccacgcacacgatgcatacctcgcagccgtcctaggcgaatataaagagcgcttcatgaaaagaaagatcaatttcgacatggtcaaggagctcaactccaaaattgtagaaatggacgagggcaaacgcagaaacctccggttcggctacgtgatcaattcactagacgagaatctcaacgacatagtcctgaaaattagcgaaaacctcgtcgacaatgaaaccggcgaagtactgttcgatgcgcacgaatttaacaaacgcgtcgaggacaccctataccgaaatgacatcctaatctccagaaaaacggagatacgcaccggacaattctacaaggaaaccatatacaagaaaggaaaagggactattcccatcaaattcggtatgccaaccgatatatacggaggctactcaaacaccaacgcccgaaaactcatgctgatagagtacaacgaatcgaaaatgaaaatcatagggctcccaatggccctcgcagtcagaaacaacgacgcggaaatcaacgactatatcaaaacccagataaacttgaagaaaaactccaccttcaaaatcaaaaagtgctccatcccgttcgagacagagatcatatacaacaaccagaacgtcttcataaaagggtacagcataggccataagaactgcgaaatctcaaatgccatccagctcaaaatcgccaaagacaagatgaaacactggaaatacgccctacaatacctcctcaacgacaagaaacaatacatcgacttcgcagagaaatacgtgaatgaaatttacgatttcctgataaacctcgacctattcccccttttcaataaagaactcgacaagatcaagaacaaggtgaacttcgaagacctggccctggatcagcaaaagaagatcaccaaggaactgttcaaaatgctccactgcaactccgttaacgccaacctcagtgaatttggactcggtgaccggatgggcaggctctcagggtacaatataacagacggcatcatcatctcaaaaagcgtaactggtatccgcgaaagccgctacgagttctga

SEQ ID NO: 6475 - RNA, 4035 nt, synthetic construct
  misc_feature 1..4035: note = Cas9 variant
  source 1..4035: mol_type = other RNA
atgagccaaaataacaacaagatctacaacatcggcttggacataggggacgcctcagtcggctgggccgtcgttgacgaacactacaacctgttaaagagacacggcaagcacatgtgggggtcaagactgttcacgcaggcaaacacagccgtcgagcgacgttctagccgaagcacccgtcggcgctacaacaagaggcgcgagcgaatccgtttgctacgagaaataatggaagacatggttctcgatgtggaccccaccttcttcataaggctagcgaacgtatcattcttggaccaagaggacaaaaaagactatttaaaggaaaactaccacagcaactacaacctctttatcgacaaagatttcaacgacaagacatactacgacaaataccccactatctaccatctgcgcaaacacctgtgcgaatcgaaagaaaaagaagatccacgactgatctacctagcactacatcacatagtcaagtaccggggcaacttcctctatgaaggccaaaagttctccatggacgtctcgaacatcgaagacaaaatgatcgacgtgctccgccaatttaacgaaattaacctgttcgaatatgtagaggaccgcaagaaaatcgatgaagtgctcaacgtcttaaaagaacccctttccaagaagcacaaagccgaaaaggcgttcgccctatttgacaccacgaaagacaacaaagccgcatataaggagctttgcgccgccctcgccggcaacaagttcaacgtcacaaaaatgcttaaggaggccgagctccacgacgaagacgaaaaggacatctcctttaaattctccgacgctacatttgatgacgccttcgtcgaaaagcaacccctcttaggcgactgcgtggagttcatcgacctactccacgacatctactcgtgggtagagctccaaaacatcctcggctccgcgcacaccagcgagcccagcatcagcgcagccatgatccaacgctacgaagaccacaagaacgatctcaaactattaaaagacgtcatacgcaaatacctccctaaaaagtacttcgaagtgtttcgcgacgaaaagtccaaaaagaacaactactgtaactacatcaaccacccatcaaaaaccccggtcgacgaattttacaaatacataaaaaaactaatcgagaaaatcgacgacccggacgtaaagactatactcaacaaaatcgaactggaatcattcatgctaaagcaaaactcccgcacaaacggggcagttccataccagatgcaactagacgaactcaacaagatcctagagaaccaatccgtctattactccgacctaaaagacaacgaagacaaaatccgctcaatacttacattcaggataccctactacttcggtccccttaacatcacaaaagaccggcagttcgactggatcatcaaaaaggaaggcaaagaaaacgagaggattctcccatggaacgcaaacgaaatagtcgacgtcgacaagacagccgatgagttcataaaacgaatgagaaacttctgcacgtacttccctgatgagcccgtaatggcaaagaactcacttaccgtctcgaaatacgaggtcctcaacgaaataaacaagctccgcataaacgaccatcttataaaaagggacatgaaagacaagatgctacacaccctcttcatggaccacaaaagcatctcagcaaacgccatgaaaaaatggctagtcaagaaccaatatttctcaaacacggacgacatcaaaatagaaggcttccagaaagaaaacgcctgttcaacgagcctaaccccctggatcgacttcacaaaaatcttcggcaagatcaatgagtccaactacgacttcatagaaaagatcatctacgatgtgacagtcttcgaggacaagaagatcctgcgccggagactgaaaaaagaatacgacctcgatgaggaaaaaataaaaaagattctaaaactcaaatactccggctggagccgactttcgaagaaactgctctccggaataaagacgaagtacaaagactccacccggacgcccgaaacggtgttagaggtgatggagcgcaccaacatgaacttgatgcaagtaataaacgacgaaaaattaggattcaagaaaacgatcgacgacgccaatagtacctccgtcagcgggaaattcagctacgcagaagtccaagagctagcaggatccccggccataaaacgcggcatctggcaagccctactaatcgtggatgaaatcaagaagatcatgaaacacgagcccgcccacgtatacatagaattcgccaggaacgaggatgagaaagaacgcaaagactcattcgtaaaccagatgctaaaactctataaagactacgactttgaagacgagacagagaaagaagcgaacaaacaccttaagggagaagacgccaaatccaagatacgaagcgaaaggctaaagctatactacacacaaatggggaagtgcatgtacacaggcaaatccctcgatatcgaccgactcgatacctatcaggtcgaccacatagtcccccagagcctcttgaaagacgacagcatcgacaacaaagtactcgtgctgtcctcggagaaccaacgaaaacttgacgacctagtgataccctcaagtatccggaacaaaatgtatgggttctgggaaaagttgttcaacaacaaaatcatatcgccaaagaaattttactccctaataaagacagagttcaacgaaaaagaccaggaacgcttcataaataggcaaatcgtagagacaagacaaatcaccaagcacgtggcccaaatcatcgacaaccactacgaaaatacgaaagtggtgacggtgcgggcggatttatcacatcagttcagggagcgctaccacatatacaaaaaccgggacatcaacgacttccaccacgcacatgacgcctatatcgccaccatactcggcacgtacatcggccaccggtttgagagcctggacgccaaatacatctacggagagtacaaaagaatcttccgaaaccaaaaaaacaaaggaaaagagatgaaaaaaaacaacgacggatttattctcaacagcatgagaaacatatatgccgacaaagatacgggcgagatagtttgggacccaaactacatagaccgcatcaaaaaatgcttctactataaagattgcttcgtcacaaagaaactcgaagaaaacaacggcacattcttcaacgtgactgtcctcccaaacgacaccaacagcgacaaggacaacaccctggctaccgtcccggtcaacaaataccgaagcaacgttaacaagtatggcggattttcgggcgtcaactcgttcatagtggcaataaagggtaaaaaaaagaaaggaaaaaaagttatagaggtcaacaagcttacgggcatcccccttatgtacaaaaacgccgacgaagaaatcaagatcaactacctcaaacaagccgaagatcttgaagaagtgcaaatcgggaaggaaattctaaagaaccagctaatagagaaagacggcgggttatactacatcgtagctccgaccgaaataatcaacgccaaacaactcatactcaacgagtcacaaaccaaactagtttgcgaaatttacaaagcaatgaagtacaaaaactacgacaatctagatagcgagaaaatcatagatctctaccgactactcataaataaaatggagctgtattaccccgagtacaggaaacaactggtaaagaagttcgaagaccgctacgaacaactcaaagtcatcagcatagaagaaaaatgcaacatcatcaaacaaatcctggcaaccctacactgcaactcgtccatcggaaaaattatgtactccgactttaaaataagcacaaccataggccgactcaacgggcgcaccataagcctcgacgacatcagcttcatcgcagaatccccaaccggcatgtactccaaaaaatacaagttatga

SEQ ID NO: 6476 - RNA, 4035 nt, synthetic construct
  misc_feature 1..4035: note = Cas9 variant
  source 1..4035: mol_type = other RNA
atgaaaaagacaaacccgtacatactttcactcgacataggaaccgcgagcatcggctacgcctgcatggacctagacttcaacatcctgaaataccacgataaggacgcaataggggtactcacattcgaaggcgcggacacagccgcagaaagacgtggattccgaacatctcgaagacggaaaaaccgacgtatcaaaaggcttggtctgctccaagaggtcctcgcacccctagtgaagaacccaaactactaccaactgcttaatctacacaaatggaaaaatagcaacgaagacttcaaacatcgcagtctatcagaagtcttgaaaatcctcggtaaaaacccaaaaacataccccacaatataccacctccagcaggacatccagaaccacccggagaagaaatttgagccagagctcatctttctcgcgctctaccacctagtcaagtaccgcggacacttcctattcaacaacctgtcatttgacaaaggcaagacagtcgacaacgaagcacaactcagcgaactcctggaacagtaccaatcaataaacccctacgaagactcaatatctaacaaggacataaacgtcatcgtcgacacgctaaaagacgaccaactcacacgaaacgacaaatcgaaggagctcaagcgcaacgtatcgaaaacacacgcggagctgttcaaaatgctcgtcgggctaaagtttaaacaaagcatcctattcgagaacatggaaaatgcagaagacataaaagagagcgccaccggatccgacgccatcagcctaagcgacgactattacgaaaatctaagcgagttcctcacagacgaacagctgaacttcatagaaagcgcaaacaccttctttatgggcatcatgctcgaccgcatccttaaaggcgcaacatccatcagtgcggccaaggtgcgcgactacaaaatcttcaaaaaccaactcaaaatcatcaaagacatagtctaccaaaacaagtacgacaagtaccacgagttcttcgtcacatccaaagaagacatgcgagcctaccaagaaaaccccgacgcaaaaacgttcggcaaactgagcaaattcgaccaatatctcatccatcccaaagaccaatatgctaaactaatgaaggacctcaaaggcatcgtgcccaagaaatacaccgaagtacttaacctaatagacgaacaaaaattcctcgtggtccaaaacacgactgacaatgccagcataccatatcaaaacaacgtcttcgaagccgaaaacatactccgcaaccaacaaaaatactaccccgagatcaccgaagaaatgattggcaaagtaatcaacctcatctccttccgcataccctactacgtaggccccctgaccaacaaaaacggccagtccgactttgcatggatgatacgcaagtccgacgaacaaacccttccctggaacttcgacaaagtcatagacaagtcgaaatccgccgagaaattcatccggaggatgacgagcaaatgcacatacctgctagaagaggatgtacttcctaaacattccctcctctaccaagagatggaagtgctcaacgagctcaacaacgtccagctccggggcgaaaacgaaccaaaacatcgcatacacagattggatcccaaagttaagcaattcatttaccacaacctgttccagaagaagaaaaacgtaacccacaaagacctcatcacactcctacagaacagcgaacaccgcaacaccctcaacaagacaagcggccaaaaactaaaagtattcggcacccaaaacgacagcaagttcgcgtccaaactatccacatacaatgacatgaaggccatattcggcagtgtcgaaaacaagcgacaaatgatcgaggagctagtactctggattacgatattcgaagacaaagcaatactcaagcagaaaatcggagagaaatacccgaacatcaccgaaaagcaactcaaccagatagtaaagctaaactacagcggctgggggcgcctcagcgaaaaattactaaccaaagaagttaacggcagaagcctaatcgacctcatgtacagcaccgaaaacaacttcatggagataattacggacaaaacactcggattcgactgtttcattaaaaacagcaacaaggtaaagaacgcaaaaatctcctacaaagacgtcgctgaattacgcaccagcccggcactaaagaagggcatctggaacgccatcaagatggtgcgggaaatctcagacctcttcggcgcgcccgaaaagatcataatagagttcgccacagaagaccaggtcaaagggaagcgacaaaaatcccggtcagaattatgggacgacctagtcaaaaagaacaacctaaagcgcaacaagaaattcaaaggacttttcgaagaacttaaggcatatcccgatttagatttcagcaaccccaaattgtggttatacatccatcagaacggcaaatgcatgtacaccaagaaaccaatcgacctcgaacgactcatgtccgacaccaacaatcaactctatgaaatcgaccatatcctaccgcgcacgttcgtcaaagacgattctattaacaacaaagtactggtcattcagtccgcgaatcagaaaaagtcaggcgataaaatgcctctcgaaattttcgacaaccacgtgctcgtccccttctggaagatgctgtacgagaacgacctcataagcagctccaaactctccaagctgatgaagaaagagttcaatgacctcgacaaagaaggattcatccaaagacaactggtcgaaacccggcagataatatcccacgtgagcgacttcctgactgaagaatacccctccaccacagtagtgcccatgaaagcgaacgtcgtctcggaactcaggcggaaattcgacatcccaaaaatccgccagctcaacgattggcaccacgcagtggatgcctacctgaacggcttcgtctaccaggcagcgcgtgtattctatcccaaggtcaacttgttcgagttcaacttcaaatgggagaaagtgcgggaaaaatggcgccagctcggcgagttcaccgagaataacaagaaaagggagttctttctatttaaacgcatggaaaactacgtaaacgaacacggggagggtatgataagcaaactaatcttcgacctcgacaatttcaaattcaactattcccgcaaagtggaatctacagagtccgctttctacaagcagagcgcgttctcccccaaaaacaccacagcccaatatgacagcgacaaaaacaaaaccgcaatctacaaagaaatgaagaacaaacgaggcatagtagtctcgtacacctacgttaagaaggatcaggagcttatcggctacggggtcttcaatgaaacggttttcgagtatgtcaataacgcggacgtcgacatgaacacgcgcgccctaaaaatcgtccgcaaagccttcccaaaactcgatataaagaaagctcaatacctcttcagcataaacaaaggtgacgccctcctggtaaacgggcacccattcctattcgtcagcgccaaagaacgcatcaacggcaaacaactagagttcgacataaatatgcaacggcgcctcaaaaaggcactacgcccatataacaaaatgaccgaacaggaaaaagtaggggtctacaaccaatttgcagaaaaagttgtccaagaatacgaaaactcactaggggccaaaacacggaacgagaaactagagctcatacggaaccaattcaacgagtccgataagtcaaacgaagcactcatccaatgcatcctagaagtgcttaaaatgacaaaggtatcggcggagcgctcagtaaaactgaagatccggtggggctcccagaccccaaacacgctgatcgacatcaacaacaaggcgaaaataatgtacaactccatcaccggtctaaaacaaactcgcctaaaaagcatatacaaattagctgagtccaaaaacgaactttga

SEQ ID NO: 6477 - RNA, 4035 nt, synthetic construct
  misc_feature 1..4035: note = Cas9 variant
  source 1..4035: mol_type = other RNA
atgaacaagaactactacatcggcctagacatgggcacaaacagtgttggatgggccgtcacagaccaagaatacaacctcatcaaactcaagggaacacatgcatggggagcccgtatcttccaagaagctaaagataagaaaggcaccagagccataagatcaagtcgacgacgaatggacagacgcaagtaccgcatccacctcctcaaccagctatttgcccaagagatccaagccatcgattctacgttctttataagactagcttacagtgcttattgggaagtcgacaagaaagacaaaggcataggacgcaacatcctttttaagacaaaacaggaagaatcccagttctacaaaaagtacccaacgatatggcatctgcgcaagagcctcctcgaaaaccagcctgatgctttctcggacttgcggtacgtctacttagccttccaccacatcatgaagtaccgaggaaacttcctccacgaaggcgaaataaagaccaacgagctccaagtacagcagatcgaacaactgaatcagttcctgatcaacaaatacaaggaaatctacgacaacgacgtcgaggagcgcaccttcatagccaaccaccaaatcgacgcactaaaagagatcctcctcaacaagaacacaaacaaaactacaaaggaaaaggaaatcaagaaactcttcgattatgccgactgcgaatccctcgagccctatatctcctgcttcagcaaattggcagtcggcggtaaattcgacttgtcaaagctcggatacgaaggcaacatacagttcagcgacccatccttcgaagaaaaagcaagcatcctccaagacgacttccgcttaatcgcaatagcaaaagaaatgtacgacttcgtcattctaaacgacctcctaaaagaccaacccaacctctccactgcgatggtccacgtctacgagacgcaccgccaagacctcaaaaagctcaaagacatcatcatagacatagacgcaaacaaaggactgcaaaataatgaccgttggtacttcaaacttttcaaggacaaaaacgccccgaagaactattccgcctttattcacaaaaactcgaaccagaaacgaccctcaatcgacgaatttaacgacgagataaagaagatcctcatagaacaccgtaacgacgtatcactagaaaaacaagacgatcttaagatgctattcgaaaaggtcgaaaacaaaaccctcctcaaaacgattgccattcaaagcacttccgtcataccccaccaactacacctggacgagctcgagaaaattatcgataacgccagtaccaaataccccttcctatccaacatcagggataaacttgtcctcctctttacctttcgagtgccttactattacgggcccctgaacgacaaatctccatacagcaacgtcgaacggaagcaattcgccacggttacgccctggaatttcgatgaaatctttgacgaaaacaaaaccagggaaaagtttatgaagaaactcaccaacaactgcacctacctgagtggagaaactgtaatgcctaagaaggctctcgcctacgaagactaccttatatacgaccgactcaacgtactcctcgtaaacggagaatacctcagcctacaggaaaaggaaaagatctaccactacctcatcagccgccccaaaactacgctagaccaacttaagaaagaactagccaaatggcacaaccaaagccccatcgacattatattcagcaacatacacgaagaaataccattcgaagcgtccagccacgcccacctgatgaaaagtttcgacctcgaaaaacagaaagaagaactggaacgctatatcaccttagcaacaatatacgcggacgacaaaaagagcctaaaagagctactcaagaatgaaagcctcctcgacgaaaaccaaaagaacgtgatcctcaccctacctacaaagaaatgggcgcccctatcatacaaactactccagaacatcgtatataccgacgactacggtgtcgtccattcaatactagacatcatgaaagaaaccaaccaaaacttccagatggtattacataacgagcagtaccattttaaagagctaattgaacaagaaaaccaaaagttcacccaagagaaaaccatcgaggacctcatagaagaaaaactcgagtctatccctagccttacacaaagatcaatccgccagacactgctgatcatagacgacataatcaaagccagccaccagaaggtccccgagaaaatcttcattgaggtaacaagaaacaacgacgacaaacgaaaaggccaagacggtaaccaactcgctcgtgataaggaactaaacagatttctcaccaacctgctgaaagacgaaaaagcaaatcaattctgcgatgtatcacaactactgaaggacctcgaagaagtcgacaaggtcaagctaaaaggcaagcacatctacctctacttcaagcaacttggcatcgacctgtacacaggcaagaaaatagtactaaaccagctcctaacgagcaccaaatacgacacggatcatatcatcccacagtccctcatcaaagacgactctctcgacaaccttgtcctagtagaaagggaagtcaatcttaaagtgaagggcaaccactaccccgtccctagtcggatacaagacgagcagaaaaagctctggcactttctcctgcagaaaaaggctatatcagaaaagaaatatggcaacttgacccggacctcaaaaatcaagctcgaggaagtagaagacttcgtcgcccgccaaatcaacgtcatcaactactcgaacgtcatcattcgcgatattctaaaactcaagtacccgcacacagatataatcttctctaagtcacaatacccgtccttcatacgcaagcacctaaaaatcgtaaagaatcgagacgtcaacgacgcacatcacgcggtcgacgcatatctaaacgttgtgtcaggcaacttactgagtaccaccttctccaaagcatacatacgcaagaaatacatccaaatacaagacggggagaaagaaaccttcaacatggaaaccatactcgagaactacttcaaaaacaacgagaaccaactcaagataaaaactaactgcctgcgacgggacgccctaatcaccttcaaagtcgactacttcagtggagagttctatggtcagacccgcctcccaaagggcaatgagaacctcattcccatcacattaaacgaggataaccccatgtccgacacctccaagtacggcggttacactaacctcgctcaagcctatctcttcgctgtctcttaccaagaagacggggaaatgaagaaagccatactccgggtcccttacctctacgacacgctttacaaaaatgactctgacaaactactctcaaaagtactcgacaaccctaaagcgaccaatatccaaatcctgcgcaaaatacatctgaaccagaagatccgcttcaacgacggcatctacctcctctacacgaatgagaaagaccgcaacaaatataaaatggcataccagaactacatagacaatgactacctttactacctacactgggccaacaagcacctggaggaactcctcgataaccaagaaaaacagacctttatttacaactccaagaacgaccaattcgaggtatcgaaagccaagaataaagagatcttccaatacctactccagaaaacaaaagcaaaggtctacgacacatgcaattacatagtaaaagcccgtgagaccaacatagagatcttcgaacaactcacactcaaagaacagatcaccatgatcaatcaatggatcaaaatgatgtcacgagactgtgaaaaagtaaaattcgacgcacgttttacgaatttctccaactgcctcctccgcctatcaaataacatcaaccccaaggacagcatcacaatcatctatgaatccccaaccggactcttcaaacatgaagtcaaaatctga

SEQ ID NO: 6478 - RNA, 4035 nt, synthetic construct
  misc_feature 1..4035: note = Cas9 variant
  source 1..4035: mol_type = other RNA
atgaaaaagacaaacccgtacatcctcagcctggacatcggcaccgcttccatcggctacgcatgcatggacctagatttcaacatactgaaataccacgataaagatgccataggcgtattaacattcgaaggtgccgacaccgcggcagagcggcggggattccgcacttcccgccggcggaaaaaccggcgcataaaacgcctcgggttgctccaagaagtcctcgcacccctagtgaaaaaccccaactactaccagcttctcaacctccacaagtggaaaaacagcaatgaggacttcaaacaccgctcgctctctgaggtgctcaaaaccctggggaaaaaccccaaaacttacccgacaatctaccacctccaacaggacatccaaaaccacccagagaagaaattcgaaccagaactcatcttcctggccctataccacctagtcaaataccggggccacttcctcttcaacaatttgtccttcgataagggaaaaaccgtggacaacgaggcacaactctcagagcttctcgaacagtatcaatcaatcaacccgtatgaaggctccatcttcaacaaagacatcaaagtgatagtggacacactgaaggacgatcagctgacacgcaacgacaaaagcaaagaactcaaacgcaacgtgagcaaaacacacgccgaactcttcaagatgctagtcggcctcaaattcaagcaaagcatcctcttcgaaaatatggaaaacgtcgaagacataaaagaaagcgcgacaggctcggacgcgatcagcctgtccgacgactactatgaaaacctcagcgagtttctcaccgacgaacaactaaacttcattgaatccgccaacaccttctttatgggaataatgctcgacagaatcctaaagggagccacctcgatcagcgcagccaaagtaagagactacaagatctttaaaaaccaattgaagctgatcaaggacatagtgtaccaaaacaaatacgacaaataccacgagttcttcgtcaccagcaaggaagacatgcgagcttaccaagaaaaccccgacgccaaaacctttggaaaactctccaaattcgatcagtacctgatccaccccaaagaccagtacgctaagctaatgaaagacctcaaaggcatcgtacccaagaaatatacagaagttcttaacctcatcgacgaacagaaattcctcgttgttcaaaacaccaccgacaatgcatcaatcccttaccaaaataacgtcttcgaagctgaaaacatcctacgcaaccagcaaaaatactacccagagatcaccgaagagatgatcggcaaagtcatcaacctcattagctttcgcatcccttactatgtaggccccttaactaacaagaacgggcagagcgatttcgcatggatgatccgtaagtcagatgaacaagccctgccatggaacttcgacaaagtcatagacaaatccaagagcgcagaaaagttcatacggagaatgacgtccaaatgcacttacctccttgaggaagacgtactgcccaaacactccctattatatcaagagatggaggtcctaaacgagctcaacaacgtccagctacgaggcgaaaatgagcccaaacaccgtatacaccgccttgacccgaaagtcaaacaattcatataccacaatctattccagaaaaagaaaaacgtcacacacaaagatctcatcacactcctccaaaactcagagcaccgcaacacgctaaacaaaacaagtgggcaaaaattaaaggtgtttggcacacaaaacgactctaagttcgcctccaagctgtcaacatacaacgacatgaaagccatcttcggctccgtggaaaataaacgccaaatgatcgaagaactcgtgctgtgggtcacaatattcgaagacaaagcaatcctcaagcaaaagataggcgagaaataccccaacatcacagaaaaacaactcaaccagatcgtcaagttaaactactcgggctggggccgcctttccgagaagctcctcacaaaagaagtaaacggtcgctcactgatagaccttatgtactcaacagagaacaacttcatggaaataataactgacaaaaccctcggattcgattgcttcatcaaaaactcaaacaaagtgaaaaacgccaaaatctcctacaaggacgtggccgagctacgcacctcccccgctctgaagaaaggaatatggaacgcaataaaaatggtccgcgaaatctccaacctattcggagcgcccgagaaaatcataatagagttcgccaccgaagaccaagtcaaaggcaaacgccagaaaagccgctccgaactctgggacgacctcgttaagaaaaacaatctcaaacgaaacaaggagttcaaaggcttatttgaagaaatcaaagcataccctgacctcgatttcagcaacccgaaactgtggctctacatccaccaaaacggcaaatgcatgtacaccaaaaagccgattgacctagaaagactcctttcagacacaaacaaccaactttatgaaatcgaccacattctacctcgcacgttcgtgaaagacgactcaataaataacaaagtactggtaatccaatccgccaaccagaagaaatcaggcgacaaaatgccgcttgagatcttcgacaatcacgtcctagtcccgttctggaagatgctatacgaaaacgaccttatctcatcctccaaactctctaaactaatgaaaaaggaatttaacgacctcgacaaagaaggcttcatccagcgccagctagtcgaaacccgccaaatcatatcacacgtcagcgacttcctcacagaggagtaccccagcacaacggtcgtgccaatgaaagccaacgtcgtgagcgaactacggcgcaaatttgacatccccaaaatccgccagcttaacgactggcaccatgcagtcgatgcataccttaacggctttgtctatcaagcagcccgagtcttctaccccaaagtcaacctgttcgagttcaacttcaagtgggaaaaagtccgcgaaaaatggcggcaactcggggagttcacggaaaacaacaagaaacgcgagttcttcctgttcaagaggatggaaaactacgtaaacgaacacggcgaaggaatgatctccaagttaatcttcgacctagacaattttaagttcaactattcccggaaagtggaaagcacggaatcggccttttacaagcaatcggccttttcgcccaaaaacacgacagcccaatacgactcagacaaaaacaaaacagctatttacaaggagatgaaaaataaacggggcatcgtcgtaagctacacctatgttaagaaagaccaagagctaatcggttacggcgtcttcaacgaaaccgtctttgagtacgtcaacaacgcagatgtagacatgaacacgcgtgccctaaagatcgtacgcaaagcattcccaaagctagatatcaagaaggtccaatacctattttccatcaacaagggcgacacattactcgttaacgggcacccgtttctgttcgtttccgcttacgagcgtatcaacggtaagcaactcgagttcgatatcgccatgcaacgaaaaatcaagcaggcacttagtccttacaataacatgaccgaacaagaaaaagtggagttctacaaccaattcgccgaaaaagttatcgaagagtttagaaacagtattggactccagtcccgcgaccggaaagtaaacctaatcaaaaaccttttcaacaacactgaaaaatccaacgactctatgacacagtctatcctggaagtcctcaaaatgaccaaagtcagcgcggaacgtagcaaggaactgaagatccggtggaacggccagacgccaaacacattcatcgacaccaaaaacaacgcagaaattcaatacaagtcgatcaccggcctcaaaaccacgaaacctaagagcatattcaaacttgccgagtccaagaatgaactctga

SEQ ID NO: 6479 - RNA, 4038 nt, synthetic construct
  misc_feature 1..4038: note = Cas9 variant
  source 1..4038: mol_type = other RNA
atgaagaaaccttactcgatcggcctcgacatcggaacaaacagcgtcggatgggccgttgtcacagacgactacaaagtgccagcaaagaaaatgaaagtcctcggcaacaccgacaaatcacacatcaaaaagaacctgctgggcgccctcctattcgattcaggcaacacggcagaggaccgacggctgaaacgaacagcccgacgccgatacacccgacgaaggaatagaatactgtacctgcaagagatcttctctgaagaaatgggaaaggtcgacgactccttcttccatcggctagaagactcgttcctggtgacggaggacaagcgtggcgaacgacacccaattttcggaaacttagaagaggaagtgaaataccacgaaaatttccccaccatatatcatctgcgacaatatctcgccgacaatcccgaaaagaccgacctccgactcgtatacctggcactagcgcacatcatcaaattcggcggccactttctcatcgaaggcaagttcgacacccgaaacaatgatgtgcaacgtctcttccaggagttcctcgcagtctacgacaacacattcgagaactcatccctacaagaacaaaacgttcaggtcgaagagatcctaaccgacaagatcagcaagtcagccaagaaggaccgggtactaaaactcttccctaatgagaagtccaatggccgattcgcagagttcctgaaactcatcgtaggcaaccaagccgacttcaagaaacacttcgaattagaagaaaaagcacccctccaattctctaaagacatatatgaagaagaactagaagtcctcttagcccaaatcggggacaactacgccgaactcttcctatcagccaagaaactgtacgattcaatccttttatccggaatattaacagtcactgacgtatccaccaaagcaccgctaagcgcaagcatgatacaacgatacaacgaacaccaaatggacctagctcagctcaaacaattcatacgtcagaagctaagcgacaaatacaacgaagtattctcagacgtcagcaaagacggatatgcaggctacatagacggaaagacgaaccaagaggcattctacaaatacctcaaaggactgctaaacaaaatagaaggcagcgggtacttcctagacaagatagaacgcgaagatttcctacgaaaacaacgcacgttcgacaatggaagtatcccccaccaaatacacctacaggaaatgcgggctataatccggcgacaggccgaattttaccccttcctcgccgacaaccaggaccgcatcgagaaaatcttaaccttcagaataccatactacgtgggccccttggcacggggcaaatccgacttcgcctggctatccagaaaaagcgcggataaaatcacgccgtggaacttcgacgaaatagtggacaaggagagctcagtagaagccttcatcaaccgcatgaccaactacgacctgtacctccccaaccagaaggtcctccccaaacactcacttctctacgagaaattcacggtgtacaacgaactcaccaaagtcaagtacaaaaccgaacagggcaagacagctttcttcgacgcaaacatgaaacaagaaatcttcgatggagtcttcaaagtctatcgtaaggttacaaaggataagttgatggacttcctggagaaggagttcgacgagttccggatcgtagacctaaccggactagacaaggaaaacaaagccttcaatgcctcctacggcacctaccacgatctacggaagatcctggataaggacttcctcgacaactccaagaacgagaaaattctggaagacatcgtcctgaccctcacgcttttcgaagacagagaaatgatccgcaaacgcttgaaaaactactccgacttactgacgaaggaacagctcaaaaagctagaacgccgacactacacgggctgggggcggctaagcgcagaactgatccacggcatcagaaacaaagagtcacgcaaaaccatcctcgactacctcatcgacgatggcaactcaaatcggaacttcatgcagctaatcaacgacgacgcacttagcttcaaagaagaaattgccaaggcccaagtcatcggcgagacggataacctgaatcaggtcgtatccgacatcgcgggttcccccgctatcaagaaagggatcctccaatccctcaaaatcgtagacgagctcgtgaagataatgggacaccaacccgagaacatcgtagtggaaatggcaagagagaaccagttcaccaaccaaggcagaagaaactctcaacaacgactcaagggcctaaccgactccatcaaagagttcggaagccagatcctcaaggaacaccctgtagaaaacagccaactccagaacgaccgcctattcctgtactacctccagaacggccgagacatgtatacaggcgaagaactggacatcgattatctctcccagtacgacatcgatcacatcattccccaggccttcataaaagacaactcaatcgataacagggtcctcacctcgtcaaaggaaaacaggggcaagtcggacgatgtcccctcgaagaacgtagtaagaaaaatgaaaagctattggagcaaactcctctcagcgaaactcatcacgcaacgaaaattcgataacctcacaaaagctgaacgtggcgggctcaccgacgacgacaaagccgggttcataaagcgccaactcgtggagacccgccaaatcacgaagcacgttgccagaatacttgacgagcgatttcacacggaaacagacgagaacaacaagaaaatccggcaagtcaaaatcgtcacgctgaagagtaacctagtcagcaatttccgcaaagaatttgagctctacaaggtacgcgagatcaacgattaccaccacgctcacgacgcatacctgaacgcagtcatcggcaaagcactcctgggggtctacccccagctggaacccgagttcgtctacggagactacccacacttccacggccacaaggaaaacaaggccaccgccaagaaattcttctatagcaacataatgaacttctttaaaaaggacgacgtccgcacagacaagaatggggaaattatatggaagaaagacgaacacatctcaaacataaagaaagtgctaagctacccacaagttaacatcgtgaaaaaggtcgaggaacaaacgggtggcttctcaaaagaaagcatactgcccaagggaaattccgacaaactcatccctcggaaaacaaagaaattttattgggacaccaagaaatatggagggtttgacagccccatcgtcgcatatagtatcctagtgatcgccgatatcgagaaagggaaaagtaagaaacttaaaaccgtcaaagcgcttgtcggcgtaacaatcatggagaagatgacattcgagcgagaccctgtcgcgttcctagaacgcaagggataccgaaacgtacaggaagagaacatcatcaagctacccaaatactcactgttcaagctcgaaaacgggcgcaaacgcctgctagccagcgcccgcgagcttcagaaaggcaatgagatagttctcccaaaccacctagggacactcctctaccacgccaaaaacatacataaagtcgacgagcccaagcacctcgactacgtagacaagcataaagacgaatttaaagaactactagacgtggtctccaatttctccaagaaatacaccctcgcagaaggaaacttagagaaaattaaagaactgtacgcacaaaacaatggcgaagacctgaaagaacttgcgtcctcgttcatcaatctcctcaccttcactgcaattggggcacccgcaaccttcaaattcttcgacaagaacatagaccggaaacgatacacatctaccacagaaatcctgaacgccaccctcatacaccaatccataactggcctgtacgaaacccgaatcgacctctccaaactgggaggcgactga

SEQ ID NO: 6480 - RNA, 4038 nt, synthetic construct
  misc_feature 1..4038: note = Cas9 variant
  source 1..4038: mol_type = other RNA
atggagaattacaacattggcctggacatcggcacaacatcagtcggatgggcggtagtaaacgacgccaccaacaaagtgatgcgaaagggcgggaaggcgctttggggagtccgtctcttcgaccccgccgtcacagccgaagaccgacgcgctaaacgagggacgcggcgccgatacgacagacgccgagagcgaataaagctactgcaggatgagttcaaggacgagatcaataaagtcgactccaacttctttctaaaactcgaagaaagtaaatacacctccaaagacatcaaaaataaaacggtcttaatatcgatggaggaagaaaaagcaataaagaaatacaaccaagaataccccaccatttaccatttacgccagaaactaatgaactccaatgaacagatggacatccgcctcgtatatctcgccatacaccacattatcaagtaccgtggaaacttcatctacgagggtaactccttctccgtcaataacctcaacatcgataacaaactcaaagagatcttcctgtccctatccgaagacgtcgacgaactggacatcagcgaggaatgtatcaataacatcaactacaaacaattagccaacatcttcaacgagcagagcaaaaacgacctaaaagtcaagctcaccagcgaactcacctcctattctcttaacaaaaacttcatatcggagttctgcaaactcatcatagggaacaaattctcagcaaagaaactcttcaacctcgagaccgacaacgacgtctcactctccttcgacggcaccgatttcgaggataaggcaggcgacctcgaaagcctcctcaacgactacctcgaggtcctcgagcagctcaaggaactttacgacatggtattcttgaagaaaatcttcgggggatccaaagaaacaaccatctctggcctaatggtcgagcgatacaaccagcacaaaaaggacctgaaactgctaaaggacaccttctccagcgatcggaaaatatacaataaaatatttagaagcaagaaagacatcaaagacgacaaagacatgtgcctctatgatctctacatacacaacaaacttgaaactacggacttcctgaaagaaatcaagaagtacgtaaacacggacaatttcataataaccgacgaagacttcctcaagcgcctggaaaataatgaggtcctcccccgcatcacgtcaaaagagaacggcaaatacccataccaactcaacaaggacgaactggtatcaataatagagcaccaaggcaaacactacccgttccttctgaacaaaaccgacgacggcatatacaagctggtgaggttactagagttccggataccctacttcgtcggacccctagtaagcaaggacatgtccgaaaatgcctggatgctccggaacgaaggaatgcaaggagtccacatcacaccatataactttaaaaaggtaattaatctggataagaccgccgaaatattcatcaaaagaatgatcagccactgcacatacctcctcgacgaagaagctctccccaataacagcatcctatactcggagttcaaggtactcaatgaacttaaacagatcaaagttaatggagaacacctaactaaggacgaacaacacaaaatcatcgaagaactcttcatgaaaacgtccggcacaatcacggaaaacaaattccgggagttcctgctcaacaccctggactataacttctatgaaaacgagttaaagataaccggatacagtgccgactgcaaattcgccaacaacatgcagtcatacatagacttcttcggcgaaaacggcatattcgagggcaccagctacaacacgaatgacgccgagaaaatcatcgaatggattacgatattcgacgacaaagacatcctaaaacgaaaagtcgagaacgagtaccctgaactaaagagcaaccaagtcaaaaacatcctcaataagaaatactccggctggggacgactcagcaggaaacttctgctagacctgcgcgtgttggataaggaaaccgacatcccaaaaagtataatggatctcatgtacgagacagacgaaaacttcatgcagatcatcaacaacgataagtacaacttccagaagctaattgcgaaggaaaataaaatagagaacacatccaacgacctctcctacgacgtcgtcgaaaacctggccacaagcccggccacaaagcgaggcatatatcaggccttaaaagtcgtcaaggaaataaccacatacatgggctacgagccaaagaacatcatggtagaaatggctcgcggcgacgaaaagaaaatccgaaaagacgacaggaagaaatatctgcaaaaactctacgacaacatcaaagacgaggtagactcaaactacaaaaacctcaagaaagagctagccaaagaagagaaaatagataccgacaagttgtacctatactacctgcaagagggcaaatgcttatattgtggaaagccaatcaacgtagacgatctcaacaccaaaaacagtctgtacgagatcgaccatatactcccacgcacattaatcaaagataactcatgggacaaccgcgtactggtatgccgcggctgcaaccagaagaaggctgcctcactcgtacttcccaaagagttccgaaatgactacaccaaaagtatttggatacgcctgaagaataacaagctcatgtcgaataagaaattctacaatctaacccgcaagagctattccgaagaggatatcaaaggcttcatcaaccgacagctagtggaaacgagacagatcacaaaacatgttgcaaacatcctaaactgcttttaccccaaaacaaaaattgtatacctcaaggccaacatctcccacagttacagggacaaatatgacctattcaagttccgagatatcaacgactaccaccatgcccacgacgcctacttagccgcaacactaggatcctatcaagaaaagtacctgcattacgacctcgactacaacaagatcaatgaatttaacgaaaaactcattaagaatgaagactacaaacgcctccactacggcatagtcgtcaactctctcgacgaagagttccaaagcgctttcgcagaaatcgcaccccgccttataaacgaagaaacaggggagctcctcttcaacgccaagaaattcaatgatctggtagaagataccctataccgaaacgatatcctaatctcacgaaaaaccgagatccgcaccgggaagttatacaaggaaacgatctacaagcgagggaaagggaacatcaaaattaaggaaaacatgcccacggaaacgtacggtgggtactccaatatggaaacgtcatacctgaccctcgtcaagtatgggaacaaaacgaagctaatagggatccccatgagcatcgcaaacaacaaagacgtcaaagtcaaactagacttcatcaaagaacacctagacctgaaaagcctcgataacatcgttatactgaaagacaacatcccatacgacgtctccataaactacaaaaaccaggatgtctacgtcaaaggatacagcaccgccaataaaaactgtgaactctcgaacgctcaccaattaaaaataaagaaagacatgatgaaaaagtgcaagtacgtactcaacaaggtatataagaacaaatacgacgacatcaccaacatggatatagaaaacgccataacattcatcaactacctattcgaaataaagatagagttccccctatttagcaaggagataacaaaaattcaagacaacatcaaccttaccgagtgttcattcgaacaactcgccaacatcatcaagcaactattgataatataccactgcaacagcaagaacggcaacctaaaagagttcgggctctccgatcgcatcggacgcctatctggcgcgaacgtgacgggcggagacttcatatttacgtccgtaacgggactgaaagagaaaacagctagctacgacggcgaatga

SEQ ID NO: 6481 - RNA, 4038 nt, synthetic construct
  misc_feature 1..4038: note = Cas9 variant
  source 1..4038: mol_type = other RNA
atggtcgaaaagtacggaattggcctcgacataggtacaagcacactcggctggacatctgtcgacgaaaacggaaagatccaacggttaaaaggccaaacagccctaggcacccggctattcaacgaaggacagactgccgaggagcgccggggattccggaccacacgccgaagaatacaacgccgccgctggcgactgcgcctcctcagggaaatcttcgacgaaccaatcggatccgtcgacgcaggattcttcgcccgccagaaaatgtcctcactatcaccccaagacgacaggttcgaagacacctatcgcttattcaacaaccaaaccgacaaagcgttccacgacgagtaccccacaacataccaccttcggcaagcactaatgaactccgaccgccaattcgacataagagaaatctacctcgcgatacaccatatcgtcaagtatcgaggaaacttccttcgatcgggaaaaccagcagacttcaaaaccggcaagctcgacctcaaggaaaaatttgaagaaataaacgcagactggcaaacacttatctcagaagatgcgccccaactcccagtagacgacttaacgacaataaaggccgtactggttgacggaagccgctcacgatccgaccgacaacgcgggctggttaaactgtggatggcaaacgagaccgtcgagaaaaactggaagcctgttatgacagaactcgccaaggccattctcggacttaaaaccaagctctacctcttgacagggctagacttaccaaaagaagaccagaaagcatggacattctccctcgacaccctcgaagaccaccagggcgacatcgactcgttcttcgacgatcacgcccaacaactaatcgacagacttgcagaactgcgtgcaatgatacaactcaccgagattatccctagcggactaaacttctcccaaagcatggtccaacgttacgaggcacaccgctcacacctcgaaatgtacaaacagtacgcactcgaccaaactgatcccaagcgtaccaaggcactccgcgccgcctacaacgcttatattgatcaacacgaaattgccgacgacttctacacagccgtaaaacgtgtaaccaaagacgaccaatccgagacggcagaagaaatcaacaggctgatcggtttagaacagttcatgccaaaacaacgaacaaaagaaaacggagtcatcccataccaagtccatcagcaagaactcgatcaaataatagcacatcaaaagaaatactatcccttcttgggcacggaaaaccccgtgatagaccaccgcgagtcacaaccctacatgctcgacgaactcgtcagctttcgagtaccctactacgtggggccaatggtcgccgcaaaccctgaactaaaaactaccgaaaaccccttcgcctggatgatacgcaaagcacaaggcgagataacgccatggaattttgacgaaaaagtagaccggaaagggtcagccacagctttcatcgagcgcatgaaaactacggacacctatctactaggggaggacgtacttccccagcaatcactgctctaccaacggttcatggttctgaacgagctcaacaatatacgtatcgacgacgaactcctgacgaccaaccaaaaacaatgggtcttcgaccgagtcttcaaaggcaaaggcacaatttcggcaaaacaccttcaagacgcactcaaacaccatggcgagactgacggactaccgaaaatctccggcctggccgatccaacgaaattcaattccgccctaacgtcctaccgtgacttccagaagtggctacccaatgacatcgaccgaaaagaccgcacagcagacatcgagacgataataaactggtcaacagtctttgaagacacccatatattcgtggagaaactaaaagaaatagagtggctcacagcagatcagcgcagacgaatagcgagcaaccgctaccgcggctggggacgcctcagcaaacatctcctaacggaaatcaaagacgaacagggtctctcaataatggatcagctctggagaacccagcacaacttcatgcaaatagtccatgaacccgactatgcaaagcagatagaagcagccaacacggtgggcatggccaaacaagacatcgggaccgtcatcaacgacctatacaccagtcctcaaaataagaaagccatacgccaggtgctcgcagtcgtcaaagacatccaaaacgcacaccacggcgtcgctccctcttggatcttcatggaagccgcacggggcgccgaccagaacccccaaagatcccgccagcgccaacgacagctccaagacctttacgctaagaccgcggccgaccttgtagacactgaggttcaacaagaattgacagacaaaataaaggacaaagcaaacttcaccgaccgactcatgctgtacttccttcaaaacggccaagacatgtactctaaggagaagctgaacatcgacagacttagcgaatacgacatagaccacatcctcccgcaagccctaatcaaagatgactccctcgacaaccgcgtactcgtgcaccaatcgatcaaccgtaacaaatccgacacctttgcaagcgaaaaatacggcgcaaaaatgcagggcgcttggcaccagtggagagccgcagggctcatctcagcgagaaaactaagaaatctagaaatgcgaccggacgaaatatcaaaatatgccacgggcttcattcgtagacagctagtagaaactcgccaagtcatcaagctcgtcaccgaaatcctatcccaccagtacaaccctgaagagacgaagctggtttcagtaaaggccggcctctcccacgaactccgacgcgaagcaggactgcccaagctgcgagacttgaacgactaccaccacgcgatcgacgcctacctcgcagcccgaatcgggacatatctcctaaagcgctacccgcgcctcgaaagattcttcgtttatgggcaattccagacctcaagactcgaccttagaaggtttaactttatccacgaccttgtcaaatcaaagcaaggagtaatagtcgattctgacaccggagaaatcctgtgggaccgccaaaaggatatcgattacataaagcacttaatgggtcttaagcaccttcttgtaacacacgaagtgtacgactctgccgccgaaatgtacgcacagacaatattcaaggccagcgacaacgactccaaagttctgatacccaccaagaacgatcggcccacagcaatttacggcggatacacaaaacgccgaaacggctacctcgcaatactaaaaatcacggagaaaaaggccgaaacataccgggtagttggagtacccaccctctacatgagccaactggctacagcacgcagccacagcgtggaggccgagaaagccctactaaaatccctcatggccccagaaattctctctgaatcgaaagttgtctccttcgaagtagtcgtaagtcacgtacatctcaatcagctggtccgcgacaccgtctttggaccagcacactacttcggactcggccccttccgctacgttagaaatttccaccaactcgtcctccctttcaaggatcaagaaattctggtaaaacgcacacccaccgacgaggaactaaacaccgtcttcgaagacatctgctggcaggtcgaaaactacttcgccgtcttcgacataaacgggttccgcaatgcacttaagaaatcaatcgacaaattcgaacaactccccatcgaaaatgttttcaaagataaaaagctagtcacgcaaggcaagaaagaagttttagcctttgtaatgcaaggactgcacgccaatgcaagttaccgaaacctaaaagtcagccttggaatcaaaacacctctggggcaattacaactcactaaattcatgctatcacgagatgctgaacttattgacgagagtccaaccggcctcttcagacgaatccgccgcttgaaagacctttga

SEQ ID NO: 6482 - RNA, 4038 nt, synthetic construct
  misc_feature 1..4038: note = Cas9 variant
  source 1..4038: mol_type = other RNA
atgggcaacaagctccgcaacgtggacgactactatctggggcttgacataggaaccgaaagcgtcggctgggccgtcacagataaatactacgtcataccgaagtttaaaggcaacgccatgtggggagtacatctattcgacgaaggagaaacaagcgtgaaacgacgaggtttccgcagcgcccgcagacggacgcaacgcaaacgcgaacgcctcgcactcctcgaagccctcttcgacgaagagatctgcaagaaagactgcacattcttcaggagactacatgaatcggacctgtggcccgaagacaaaagtggcgacgataaatacgcagtattcgccgacgaaaactacaccgacaaagactttcacaaggagtatcctacgatataccacctccgttatgagctaatcaagaataaggagccgcacgacgtaaaattggtgttcctcgcactacaccacataatcaagaaccgcggccacttccttttcgactccctcagcagcgcagaagacttcaacagtgcttacgagacaatgtgcagctacctgtcagacaacgagatccagctcaactgctccgacatcgagcaattcaaggcaatcttaaaagacagacgccaagggaaaatagagaaaacgaaaaacctcgcatcactgttcggaataaccaagaaaagcgatccagtgagctacgcagtaatggcagtcctctcaggcagcaccgtgaaaatgtgtgacctcttcggtgacgacgaactaaaaacggttgagaaaaacaatatcagcttcgccagcggctacgaagagaatgaagaaatctacgcctcagtattgggcgaccgcttcgaactcgtcaagatactcaaggcagtctacgactgggcagtcttagcagatatactcgacggcaaaaagtacatatccgaagcaaaggtagcggtatatgaaaaacacaaaaacgacctcaaaaccctgaagaaatatgtcaaaacataccttccagagaaatataacgaaatctttaagatatcagacggcaagaaggacaattacgtcgcgtacagcgggcacatcaaagagagcgggaagaccggggaactaaagaagacctgcaacagcgagaacttctgtgcatacctaaagaagaccttggggaagaacgccgacctgtcctacaaggaaatgttcgacgagatcgagaacaaaacattcatgcccaaacaagtcaccaagagcaacggcgtagttccaatgcaggtaaacgaagaagaacttaaagccatattagacaacgcaaaagactacctctcctttttaaactcctgcgacgagaacggagtctcggtgtacgacaagataatcaaaatcttcgaatatcggatcccctactatgttggacccctcaatacgcacacggaaaactcctggctcaaacgcaaggacggcgtcaaaatctacccgtggaacttcgacgacgtcgtcgacatagactcatccgcagaaaaattcatcaacaacctcacctccaagtgcacatacctgccggaatgcgatgtaatcccaaaatgcagtctactctactcgaaattcacagtgctgaacgagataaacaacctaaaactcaacggcgaggatatccccgtggaactgaagcaggggatctataaagacctttttatgactcgccgcaaggtaaccgtcaaacagataaaggactacctcaaggcacgcggctgctacgacaacaacgacgtactcagcgggatcgacacgaccgtgaaatcgtctctcaagtcctactttgactttaaaggctttgaaagccttacctttgacgacaaagaatccataatcgcaagttccgttatcttcggcgacgacaaaaagctcctgaagaaacgcctcaagaaactattcccagagaaactgaccgacgaagacatcaagaaaatttgcaaacttaaatacaccgggtggtccagactctccaaagagttcctctgcgacgtcgagttcacctacaagaagaccggcgaagtcatgaacgtaatcacagccctttgggagaccaactacaacctcatgcaaatcctctactccgaagatttctgctgcgatggggacgagaaaaagaacctcaacgacaaactcgacgaactatcctacaccggagaccagcactcactccgcaaggcggttgacgccctatatgtgagccccaaagtaaaacgccccatcctacgagcacttcttatcgccaaagagatcgagaagatccaagaaagaccgcccaaaaagatcttcgttgaagtggcacgcggtatcgacaaccgagaagaacgtcaccgtgattccagaaagaaccgcctaatggaactgtataagaactgcaagaaagaagcggaaaaattctgtccctacttcgacgcactctccaagaaactatccgacgaagatgagtcaaaactccgacgcgacaaactctacttctactacatacagttgggcaaatgcatgtacacaggcgaagaaataagcctcggagagctgatgaacggcaacggccgcttcgacatcgatcacatctacccccgcagcaaaataaaagacgacagcctgaccaacaaagtactggtaaacaaaactgtcaacaacaacaagacgaatgtctaccccatcgacgccgcaattcagagcaaaatgagtccctactggcaaatgctgcgctcctcagggttaatctctgaagaaacatacaaacggctcacacgaaaaacacccctcaccgacgacgaactatccgcattcgtctcacggcagctcaccgaaacccaacaatccacaaaagccgtcgcccacatactagaacagctataccccaagcccaagaccgaaatcgtctacgtaaaagcagcgctagtacacgcattccgccagagtaacgacatgctcaaatgccgcgaagtcaacgacctacatcatgcaaaagacgcatacctcaacatcgtggtaggtaacgcctataacgtaaaagtcacccacaacaaagtcaacttcatcaagggcctccaaaacaacgacaagggctacacggtaaatcccgagaaattcttcagccacgacatacccggggcgtggtcagtcaaggactccatgaatacagtccgaagatttatgaataagaacaacatccgctacacccgattcccgaggaaaaagcaagggggcctcttcaaaataaatccgttaaagaaagggaatggccaggtccccctgaaagccagcggagccagatcatgcatagagaaatacggcggctacgacaaagcaaccagtgcctattttagctacgtagaatacacggacaaaaaggggaaagcagtccgccaaatgttccccgtaaacctatatgaagtaaaagagtacgaagcagatatgcaaggattcgtaacatcacgaatcgcggaagcctcaaacgtgaaaatcctcataccatgcgtaaagtacgacgcatgcatcagcttcgatgggtgccgcatgttcataactaagaaaactggaaatagaataggctacaaacctgggatgcagctcgtcctagggtacaagtacgaaaaatacatccgcaacatagaaaactacctaaccaaacataaagacagagaaataatcccgcgagacaacatctccgctgaagagaacatagaactctacgacatcctcactgggaaaatgctaaacaccgtactaagcgtcaaattctccgggatagggaagaaactcgaaaaacggcgagaaaagttcgtactatgcagccctgaagaacaatgctgcgtcctgaacgaaatcctcaaaatcctccacgcgaacgtcctatccggagacctctcgttaatcggagagtcgcccaacacaggcacaatgaaaacgaatgcaaagttctctgaaataaaagatgtgcacagcatcaagctcatcaaccagtccgtaacgggcctcttcgagcaagaaatcgacctcctcaaatga

SEQ ID NO: 6483 - RNA, 4038 nt, synthetic construct
  misc_feature 1..4038: note = Cas9 variant
  source 1..4038: mol_type = other RNA
atgggcaaaccctactccattgggctcgacataggcacaaactcagtaggctgggccgtcgttacagacgactacaaagttccagccaagaaaatgaaagtactcggcaacacggacaaacaatccattaagaaaaacctcttaggcgccctactgttcgacagtggagaaacagccgaggccacacgattaaaacggacggctcgcagacggtacaccaggcgaaagaacagactcagatacctccaagaaatctttacaggcgaaatgaacaaagtagacgagaacttctttcaacgattagatgactccttcctggtagacgaagacaagcgcggcgagcaccacccgatattcggcaatatagcggccgaagtcaaataccacgacgacttcccaaccatctaccacctccgccgacacctggccgacacctccaagaaggcggaccttcgcctcgtataccttgcgctcgcgcacatgatcaaattcaggggacacttcctatacgaaggagacctgaaagccgagaacaccgacgtgcaggctctttttaaagatttcgtcgaagaatacgacaagaccatcgaagaatctcatctcagcgaaatcaccgtcgatgccctatcaatccttaccgaaaaggtctctaaatcctcccgcctagagaacttgatcgcccactacccgacggaaaagaaaaataccctattcggaaacctaatagcgctcagcctcgatctccacccaaactttaaaaccaactttcaactaagtgaagacgcgaaacttcaattctccaaagacacctacgaggaagacctagaagggttcctcggcgaggtaggagatgaatacgcggatctattcgcttccgccaaaaacctctacgacgccatactgctcagcggcatcctaaccgtggacgacaatagcacaaaagcacccctttcggcctccatggtcaagcgctacgaggagcaccaaaaagacctaaagaaactcaaagatttcatcaaagtgaacgcccccgaccagtacaacgccatcttcaaagacaaaaacaagaaaggatatgcctcctacatagagtccggcgtaaaacaagacgagttctacaaatacctcaaaggcatactccttaaaatcaatggcagcggcgacttcctagataaaattgacagagaagacttcctccgaaaacaacgtacgttcgacaatgggtccataccccaccaaatccacctccaagaaatgcacgccatcctacgccgccaaggcgagcattaccccttcctcaaagagaaccaggataaaatcgagaaaatcctgacgttcagaatcccatactacgtgggacccctagcacgaaagggatcacgattcgcatgggcagaatacaaggcggacgagaaaataacgccgtggaacttcgacgacatcctcgacaaagaaaaatccgcagaaaaatttatcacccgaatgactctaaacgacctctacctacctgaagaaaaagtgctccccaaacactccccattatacgaagcgttcaccgtatacaacgagctgaccaaggtcaaatacgtaaacgagcagggcgaggccaaattcttcgataccaacatgaaacaggagatcttcgaccatgttttcaaagaaaaccggaaagtcacaaaagataagctactaaactacctgaacaaagaatttgaagagttcaggatcgtaaacctcacaggcctcgacaaagaaaataaggcgttcaactcaagtcttggaacgtatcacgaccttcgcaaaatcctcgacaaatcattcctcgatgacaaagccaacgagaaaaccatcgaagacataatacaaacactaactctcttcgaagaccgcgaaatgatacgccagcgactacaaaaatactcagatatctttacgaaggcccaactcaagaaactcgagcgccggcactacaccggatggggccgactcagctacaaactgataaacggcatccgcaacaaagaaaacaagaaaaccatcctcgactacctcatcgacgacggctacgccaaccgaaactttatgcagctaataaatgacgacgcactcagcttcaaagaagaaatcgctcgcgcccagatcatagatgacgttgacgacattgcgaacgtcgttcacgacctaccaggaagccccgccataaagaaaggcattctccaatctgtaaaaatcgtagacgagctagtgaaggtcatgggccacaacccggcaaacataataatagaaatggcccgcgaaaaccagacaaccgacaaagggcgacgaaactcccagcaacgtctgaaattgttacaagactcacttaagaacctcgacaaccccgttaacatcaagaacgtcgagaaccaacaattgcaaaacgatcgcctcttcctttactacatccaaaacggaaaggacatgtacacaggtgagaccctagatattaacaatctatcccaatacgacatagaccacattattccccaggctttcattaaggacaacagtttagacaaccgagtactcactcgatccgacaaaaatcgaggaaaaagtgacgatgtaccctccattgaggtagtacacgaaatgaaatcgttctggtcaaaactgctctctgtaaagctcatcacccaaagaaagttcgacaacttgaccaaagccgaaagaggaggtttaacagaagaagacaaagctggcttcatcaagaggcaacttgtagaaaccaggcaaataaccaagcatgtcgcacaaatcctagatgagcgattcaacaccgagttcgacggcaacaagcgccgtatccgaaacgtgaagatcatcacactaaagtccaaccttgtctccaactttcggaaggagttcgaactatacaaggtccgagaaatcaacgattaccatcacgctcacgacgcatacctcaacgccgttgtaggcaacgccctactgctcaagtatccacaactagaacccgagttcgtctacggcgagtatccgaaatataattcttaccgttcccgcaagtcagccaccgaaaagttcctcttctacagcaacatcctgcgattcttcaagaaagaggacatacaaaccaacgaggacggagagatcgcatggaacaaagaaaagcacatcaagattctgcgaaaagtactcagctacccccaagttaacatagttaagaaaaccgaagaacaaaccggaggcttctcgaaagagagcatcctccccaagggcgagtcggacaaactcatcccccgaaaaaccaaaaacagctactgggaccctaagaaatacggcggattcgattccccagtcgtcgcctatagtatcctcgtgttcgccgacgtcgagaaaggcaaatcgaagaaactccgcaaagtacaagacatggtcggaatcaccataatggagaagaaacggttcgagaaaaaccccgtagacttcctcgaacaacgtggataccgcaacgtacgcctggagaaaatcatcaaactcccaaaatacagcctcttcgaactagaaaacaaaaggagaagactcctcgccagcgcgaaagaactgcaaaaaggcaacgagctagtcatcccgcaacgtttcacaacactcctataccactcgtacaggatcgaaaaagactacgaaccagaacaccgggaatacgtcgaaaagcataaggacgagttcaaagaactactagaatacatatcggtgttctccagaaaatacgtattggccgacaacaacctaacgaaaatagagatgctgttcagcaaaaacaaggacgccgaggtaagctcactcgcgaaatcattcatcagcctcctcaccttcacggctttcggcgcaccggccgcattcaactttttcggcgagaatatcgaccggaagagatacacatcggttacagaatgccttaacgcgacgctaattcaccaatctatcaccggcctgtacgaaactcgcatcgacctttccaaactaggcgaggactga

SEQ ID NO: 6484 - RNA, 4038 nt, synthetic construct
  misc_feature 1..4038: note = Cas9 variant
  source 1..4038: mol_type = other RNA
atggaccaaaaatacagcatcggcctcgatatcggcactaactccgtcggctgggcagtcgtaaccgacgactataaagtcccagccaagaaaatgaaagtcttaggcaatacagacaaacaaagcataaagaaaaatctcctcggagccctcctatttgacagcggagaaaccgcggaagcaacccgactcaaacgcacagcccgacgccgctacacacggcgtcgcaatcgcttacgataccttcaagaaatattcgctgaggagatgaataaagtcgacgagaacttcttccaaaggctggacgattccttcctcgtcgacgaagataaaagaggggaacgacacccaattttcggcaatatcgcggccgaagtaaaataccacgacgactttcccaccatttaccatctgcgtaaacacctggctgacatctcccaaaaggccgacctccgactcgtatacctcgccctcgcccacatgattaaatttagaggccacttcctcatcgaaggacagctcaaagccgagaacaccaacgtccaagcgctatttaaggacttcgttgaagtatacgacaaaaccgtcgaagaaagccacctctccgagatgaccgtcgatgccctctcaatcctcaccgagaaggtgtccaagtcacgacgcctagaaaacctgatcgcgcactacccagcggagaaaaagaacaccctgttcggcaacctcatcgcgctcagccttggactgcagccgaactttaagactaacttccaacttagcgaagacgccaagctacaattctccaaggacacctacgaagaagacctagaaggcctgctcggagagatcggagacgaatacgcagacctattcgcaagcgctaaaaatctatacgatgcaatactactctcagggatactaacggtcgacgacaatagcaccaaagcgcccctgtccgcaagcatggtgaagagatatgaagaacaccagaaagacctcaagaaactaaaagactttataaaagtcaacgcgccagaccagtacaacgctatattcaaagacaaaaataagaaaggatatgcaggctacatcgaaaacggagtgaaacaagatgagttctataagtacttaaaaggaatcctactccagataaacggatccggggacttcctagacaagatcgaccgagaagacttcctcagaaaacaaagaaccttcgacaacggctcaatcccacaccaaatacacctccaggagatgcacgcgatcctccgcaggcaagaggaacactacccctttctgaaagagaaccaagacaaaattgagaaaatattaaccttccgcatcccctattacgtaggacccctggcccgaaaaggcagtagattcgcatgggcagaatataaggccgacgaaaagataacaccatggaacttcgacgacatactagataaggaaaagtccgccgaaaaattcatcacccgtatgaccctgaacgacctgtacctgcccgaagaaaaagtactccccaagcattcgctcctatacgaaacgttcaccgtctacaacgaattaacgaaggtcaagtacgtaaatgagcaaggagaggcaaaattcttcgacgccaatatgaaacaagaaatctttgatcacgtattcaaggaaaaccggaaagtcaccaaagacaaactgcttaactacctaaacaaagagttcgaagagttccgtattgtaaacctgaccggactcgataaggaaaacaaggccttcaacagcagtctaggaacataccacgacctccgcaaaatcctagataagagcttcctagacgataaagccaacgagaaaaccatagaagacatcattcaaacccttaccctcttcgaagaccgggaaatgatccggcagcgtctccaaaagtactctgatatcttcaccaaagcacaattgaagaaactagaacggcgccactacaccgggtgggggagactatcgtataaattgatcaacgggatacgaaataaagaaaataagaaaacaatacttgactacctcatcgacgacggctacgccaaccggaacttcatgcaactcatcaacgacgacgccctatcctttaaagaagagatagcaagagcgcagattattggggacgtcgacgatatcgccaatgtcgtccacgacttaccgggctcccccgccatcaagaaagggatcctgcaaagtgtaaaaatagtagacgaactggtcaaagtcatgggacacaacccagcaaatataatcatcgaaatggcccgagaaaaccaaatgaccgacaaaggccgcagaaattctcaacaacgactcaaactcctccaagactccctcaaaaatcttgacaaccccgtcaacatcaagaatgtcgaaaaccagcaattacagaacgatcgccttttcttgtactacatccaaaacggcaaagacatgtacaccggcgaaaccctggacatcaacaacctctctcaatacgacatcgaccacataataccacaagcgttcataaaggacaatagcttggacaacagggttcttaccagatcagacaaaaacagaggcaaatccgacgatgtaccctctatagaagtcgtgcacgaaatgaaatcattctggagcaaactcttatccgtgaagctaataacacaacgaaaattcgataacctaacaaaagcggaacgcggagggctcaccgaggaagataaagccgggttcatcaaaaggcagctcgtagagacccgacaaataacaaaacacgtagcgcagatcctggacgagagattcaacaccgagttcgacggcaacaagagacgcatacgaaacgtaaaaatcattacactgaaaagcaacttggtctccaactttagaaaagagttcgaactctacaaagtccgagaaatcaacgactaccaccacgcccacgatgcctaccttaacgcagtcgtcggaaatgcgctcctcctcaaatacccccaactcgaacccgagttcgtttacggcgagtaccccaaatacaactcctaccggtcgcgcaaatcggccactgagaagttcctcttctactcaaacatcctacgcttcttcaaaaaggaggacatacaaaccaacgaggacggcgaaatcgcctggaacaaagaaaagcacataaaaatcctccgcaaggtcctctcctacccccaagtaaacatcgtcaaaaagacagaggaacagaccggagggttctcgaaagaatcgatcctacccaagggcgaatccgacaaactgataccccgcaagaccaaaaactcatactggaacccaaagaaatacggcggctttgacagtcccgtcgtcgcatacagcatcctagtcttcgcggacgtagaaaaagggaaatcaaagaaactaaggaaagtccaagacatggtaggcataacaatcatggaaaagaaacgctttgaaaaacaccctgtggacttcctcgagcaacgcggataccggaacgtacgcctcgagaagataatcaagctccccaagtactccctatttgaattagagaataagcgccgccgactactagcatccgcacgcgagctccaaaagggcaacgagctcgtcataccacaaaggttcaccacactcctctaccactcataccagatagagaaaaactacgagcccgagcaccgcgaatacgtagagaagcacaaagacgagttcaaagagctacttgaatacatcagcgtattctcccggaaatacgtgctcgctgacaacaacctcaccaaaatagaaatgctgttctccaagaacaaagacgccgaagtatcaagcctcgcgaagtcattcataagcctactcacgtttactgccttcggcgccccagcagccttcaacttctttggagagaacattgacagaaaacgctacaccagcgttaccgaatgcctcaacgcaacactaatacaccagtccatcacagggctctacgagacgcgcattgacctatctaagctcggagaagattga

SEQ ID NO: 6485 - RNA, 4038 nt, synthetic construct
  misc_feature 1..4038: note = Cas9 variant
  source 1..4038: mol_type = other RNA
atgaagaaagaatacagcataggcctggatataggcaccaactcagtaggctgggccgtaatcacagatgactacaaagtaccagctaaaaagatgaaagtcctcggcaacacagacaaacaatcaatcaagaaaaacctgctcggtgccctactcttcgacagcggtgagaccgccgaggccacacgtttaaagcggaccgcccggcgcaggtacactaggaggaagaaccgactccgatacctacaggaaatcttcactgaagaaatgaacaaggtcgacgaaaacttcttccaacgcctagatgactccttcctcgtcgaagaagataaacaaggaagcaaatacccaatatttggaacactcaaggaagagaaggagtaccacaagaaattcaagactatttaccacctaagagaggaactagccaactccaaagagaaagccgacctccggctggtctacctcgcactggcgcacatgatcaagttcagaggccacttcttgtacgagggagacctaaaggcggagaacacggacgtccaagccctattcaaagatttcgtagaagagtacgacaaaaccatagaagaatcacatctcagcgaaataaccgttgacgccctaagcattctaacggaaaaggtctccaagtccagccggctagaaaacctaatagcccactaccccacggaaaagaaaaacaccctattcggaaacttaattgccctcagcctgggactccagccaaacttcaaaaccaacttccagctctcagaagacgcaaagctgcaattttcgaaggacacctatgaagaagatctagaggagctccttggagaaatcggagacgagtacgcagacctgttcgcctccgctaaaaacctctacgacgccatactactgtcgggtatactggcagtagacgacaacaccacgaaggcgccactctccgcttccatggtcaaacgctacgaggaacaccagaaagacctaaagaaactcaaagactttataaaagtcaacgcccccgaccaatacaacgccatattcaaagacaaaaataagaaagggtacgcaggatacatagaatctggagtcgagcaggacgagttctacaaataccttaaaggcatcctcctaaagattaacgggtcaggggacttcctagacaagatcgactgcgaagacttcctccggaagcaaaggacattcgacaatgggtcgatcccccaccagatccatctgcaagaaatgcacgcaatcttgcgccgccaaggagaacactatcctttcctaaaagaaaaccaagacaaaatcgagaaaatactaacattccggatcccctattacgtcggaccccttgcacgtaaaggaagccgcttcgcatgggccgaatacaaagcagatgagaaaataaccccgtggaacttcgacgacatcctagataaggaaaaatccgccgaaaagttcatcacccgaatgaccctcaacgacctatacctcccagaagaaaaagtgcttccaaaacacagtcccctctacgaaacgttcaccgtatacaacgagctcacaaaagtgaaatacgtaaatgaacaaggagaagcaaaattctttgacacaaacatgaaacaggagatcttcgaccacgtcttcaaagagaaccgaaaagtgaccaaagataaattactaaactacctgaacaaggaatttgaagagttccgaatagtaaacctcaccggactcgacaaagagaacaaagcattcaactcctccttgggcacctaccacgacctccggaaaatcctggacaagtccttccttgacgacaaagccaacgagaaaaccatagaagacattatacagacgctgacgttattcgaagaccgcgaaatgatccggcaaaggctacagaagtactccgacatattcacaaaagcccagctaaagaaactagagcggaggcactacactggatggggccgactaagctacaaactaattaacggcatacgaaacaaagagaacaagaaaacaatcctagactacctaattgacgacggatacgccaatagaaacttcatgcaactcataaacgacgatgctctctccttcaaagaggaaatcgccagggcccaaatcatcggagacgtcgacgatatagccaacgtcgtccacgacctcccaggcagccctgccataaagaaagggatcctacaatcagtcaaaatcgtggacgagcttgtcaaagtcatgggtcacaaccccgcaaacatcataatcgaaatggcccgagaaaaccagacgacagataagggccgccgcaactcccaacaacgcctgaaacttctacaagacagcctaaagaacctagacaaccctgtcaacattaaaaacgtcgaaaaccaacagctccagaacgaccgtctcttcctatactacatccaaaacggcaaagatatgtacacaggagaaactctagatataaacaacctctcccaatacgacatcgaccacatcatcccgcaggccttcatcaaggataactccttggacaaccgtgtcttaacacgaagcgataagaaccgaggcaaaagcgacgatgtcccctcaatagaggtagtccacgaaatgaaatcattctggagcaagctcctcagcgtcaaactcattacacaacgaaaattcgacaacctcaccaaggcagaacggggagggctcaccgaggaagacaaagcaggcttcataaagcgccagctcgtcgaaacaagacaaataaccaagcacgtcgcacaaatcctcgacgagaggttcaacaccgagttcgacggagcccaacgtcgcatccgaaatgtcaagatcatcaccctaaaaagcaacctcgttagcaacttccgaaaggaatttgaactttacaaagtcagagagataaacgactaccaccacgcgcacgacgcctacctcaacgctgtggttggtaacgcgctcctgctaaagtatccgcaactcgagccagagttcgtctacggagaataccccaaatacaatagctacaggagccggaaatcagcaactgagaaattcctcttctacagcaacatcctccgcttcttcaaaaaggaagacatacagacgaacgaagacggagaaatagcctggaacaaagaaaagcatataaagatcctgcgtaaggtcctctcctacccacaagtcaacatcgtgaagaaaacggaggaacaaacaggcggcttctcaaaggaaagcatcctcccgaaaggcgaatcggacaaactaatcccccgtaagaccaagaacagctactggaacccaaagaagtacgggggcttcgattcgccggtggtagcctactcaatactcgtcttcgcagacgtcgaaaaaggcaagagcaagaaactacgtaaagtacaggacatggtcggaataacgataatggaaaagaaacgattcgagaaaaatccagtcgacttcctagaacaacgcggctaccgtaacgtgcgactggagaaaataatcaaacttccaaaatattccctgttcgaactagaaaataagcgacgacgactccttgcatctgctcgagaactacagaaaggaaacgaactcgtgatcccgcaacgattcaccacactactatatcactcctaccaaatcgagaaaaactacgaaccggaacaccgagaatacgtcgagaagcacaaagatgagttcaaagaacttctagaatacatatccgtcttctcgcgcaaatacgtcctcgctgacaacaaccttacgaaaatcgagatgctgttcagcaaaaataaggacgccgaagtaagctccctggccaagtcctttataagcctcctgacgttcacagccttcggggcccctgcagctttcaacttcttcggcgagaacatagaccgaaagcggtacacatcagtcacggaatgtctaaacgccaccctgattcaccagagcatcaccggactctatgaaacgcgaatcgacctatccaaactgggcgaggattga

SEQ ID NO: 6486 - RNA, 4041 nt, synthetic construct
  misc_feature 1..4041: note = Cas9 variant
  source 1..4041: mol_type = other RNA
atgaaccaaaccaaaaactacgacatcggcctcgacatcggcgtaggatccgtcggatggacaataaccgactcacagtcccaaaaagtcctcaaagtaaaaggaaagcaaggaatcggagtccacctatttaacgaagggcagacagcggaggaacgacggcagttccggaccaatcgcagacgacttaaacgccgcaaatggcgactacgccttctcagagagctattcgacgaacccatatcgtcaatagacccggagttcttcgcacgcctaaaatactttaacgaatcctcaaaggatcccaaaaacaagggctatcaaccccaactccacgacgacctcaaagacgtcgacttctaccgccaataccccactatataccacctgaggcacgccctcatgacccaaaaagaaaagtttgacatccgagacatctacctcgcaatccaccacatagtcaaatacagaggacacttcctgatgaacgggcacagttcatccttctcggtggcgcagacagattggaaggccgacctgaccaagctattcgaactcatacaagaaaccagaacaaatctcgatttcagcttcgaccttaccgaaatcgacactatcaagtcccttctcttcgataaaaacctcagtcgcaacgatcgacaaaaagaaatagtaggcttgatcaacaataattcgcaactcgataagaaagacaaagccctcacaaaacagctcgtcgaaagcgtcgtcaagggtatcgtaggtatgaaaacacgtacagacatccttctcggctacgaagtagataacaaggaacaaagtaaagcctggaacttttcaatcgacgaactcgacgaccagatggccacaatcgaccccgcgctctcccaaaattctcaggcgcacgacatcatcaccctgatacaaaaactttacatgacagtccaactagcgcaaatagtccccgaggggcaatccgtatccgagatgatgataaaccgatacaacctctacgccgaacagctgcagcaactgaaggactataagaaaataaacttagaaacaggactactcctacgcgaagcgtacgacgagctgatgacaaaagcccttaccgcagcaccaggcaaaaccatccatgatacattctataataaggtgaagaaaatactcaaagaccaagacaacaaacaggccctctctatcaaacaagccatcgaagactcgaactacctcatccccctacggattaaaagcaacggcgtaataccgtatcaactccaccaacgcgaattagacgccatcatcgagaaccaaaaagagttttacccattcctcgccaccccaaacccagtagatggccaccaagaagccctcccgtacaaattagacgaactcatcggttttaaggtgccctactacgtaggcccaatggtagacccggaagtggacagtgaccaaaacttcgcgtggatggtacgcaaagagaaaggcgaaataacaccctggaacttccacaacaaggtggacatcacccaatccgcagacaacttcataaaaaggatgaaaactacagacacgtacctgataggaaaagacgtactcccgcaaaattccctactgtaccagaggtacaccgtactcaacgaactaaacggcatcaaggttgccaacaagaaactaactattgaacaaaaacagcggctctacgatcaactttttaagaaaaagaaaactgtcaagaaacaagacatcttaaacaacctcgtcgccgccggtgaaatccacgaagacgataacttaacaggcctcagcaacggtaccacattcaacaacaatcttggctcgtatatagactactgcaaaataatcggacaagataaactcgaggacgcttccaagcaagcggacatcgaacgcattatcgagtggtccacaacattcgaagacgccaacatcttcctcaccaaactagctgagatcaactggcttaccgaagaccaaagacaaaaacttagtcagattaggtaccgaggctggggacagttctcaaaaaccctcctaactgacatcaaagacaacaaagacaacagcataatagacaacctcatgtctacaaagaaagtatttatgcaaataataaacgacaccactatcaaacagaagatcgacgattacaaccagtaccacctgaaccacgccgacctaaaagacacaatcgccaacttattcacctcacctcaaaataaacgtgccatcaaccaaactttgctcgtaatagaagacataataaacgcagtcgggcacaagccaaaccgaattttcatcgaaagtgccaaggataaccggaatgccaaaaaccaactaacccaatcccgcctgaaacgcatagtcaagcaatttgaagataataaacagcacgtggaccaatcggtctacgaggaactcaaacagctagacgatggaagccatgcaagcatcgacgaccggctactcctatacttcctccaaaacggcaaagatatgtacactgggcaaccgatcgacatcagccagctcagcacctcccaataccacatcgaccacatccttccacaagctaaagtcatggacaacgccctggataaccgcgtccttgtatcgagtaaggcaaacaccgaaaaatcagaccgcttcctatccgaaatcccgcaatttcaacaacgctcactatgggccgagctcgaaagaatgggcttcctcaccaaagccaagaaagaacgcctcttaatgacctccgacgagttcaaacaaaactccgtaagattcatagcaagacaactcgtcgaaaccaggcaaataataaaactcgtcaaccagctcatcatccaggaacaccccgaggtcaagctcgtaaacatcaaagccgatctcacaaacgcattccgcaaaaagttcaacttcgttaaaaacagaaatgctaacgactaccatcacgcttttgatgcctacctcacgtcactcatagggagccatctgctcaaaagccacccaaagtgggaacccctattcgtgtattctgactacgacaaaataaagttcgataacgctccacaaggcgtcaacatcatgaaagaatttgaacaatcaaaattagcagacgagaatggcgagatcatctggaacaaggatgagatgatggcatacctagagcgcctatacaactcccgccagatactaataacaaagaaagtctacgcccgacacggaaacctctttaaacagacaatcttcaaggcaggcgagtccgacaacctcatacccgtcaagaacaaccggtccgacatcgcaatatatggaggctataaatcaaaacaggtaagttactacgcactgatcagcctccacaacaagaaacgacagaagcgcctagtggccgtctacctcatagacatacaaaagctacaaaacctcaacgaatcagactatttcaaaacactccacacaatcatcaaagagaggcacaacataaaacccgagttcgacatcttggccgacaaaatataccaaaaccaactaatcatagacaacaaaaacggcagcaaccgccccttccgcatcgaaggcgacttcaagaatgacagacaactctacctccccctccaataccagcgctggttagcatccaaagagcctacggacgaaaaacttaatcggatctttgaccacatctgcgaacagctagccgactatttccccctattcgccggcaacgcttgcgacaaactcctagacaaccgcgacaaattctaccagctctccatcaagtcagagttcaacgacaaaggaaaactgatcgctgaaggcaagctctccgttatcgacaaactgctagtagcaatgcacgccgactcgcgtaactcaaacctcgcggtaataggcttaagctcctcctggggacgcttcaaacttcacgggggaaatgaagccatcgggacgagcgtgcaactaatacaccagagcccgactggactattcaaacggatccaaagattcaattga

SEQ ID NO: 6487 - RNA, 4041 nt, synthetic construct
  misc_feature 1..4041: note = Cas9 variant
  source 1..4041: mol_type = other RNA
atgctaagcgcaggcgtcatgctgggagacgtaagcgccctcaagtccagtaggaatagcctattccaaaagagcaagaaactaatagagaactcctcatccgacctcaccaaagtagactactcaaaaatgcgcgagattctcctcagtatacgaaacatcgcaatccgctttttcaacaacgaggacttcaaagaatccgactactacaaggagttcccaaccatatggcacttgcggaagaacctcatggaaagcgacaaaaaggccgacatacgtctagtctatctggccctacacaatatagtcaaatatcgaggaaacttcctgcaggaaaacaacaaggacctacgagccgcgaacgcgaatgccggagcagccgcgattgacctctcaaacgcgctcgaagaatacttctcgctacatgaagacgaatctgcgctaacctgcgtcccgaacgtcgccgatctgcagatgacccttgaacaacccggtctacgaaacggcgaacgactagacaggatcgtggcggcactaaatatgcccgaccgcgcccgcgcaaaactcttcgcaaaggcgtgcatcggccaaaaagtcgaattttccaaactcgccctcggaatggaaaaacaagaaggcaccaacgcctacatctgggacgacgacaaatacgacgagctagtcgccctatgcccagaagatttcttccccgtcctcgaaaccctgaaaaacgcatactctgcctatgtactatccgacctcctcgcagggaaacttagcatatcagcctcactcatagacagctacgaacaacaccaaaatgatttaaagatcgtgaaggagttggtccgagaatacctaggccagaaagaatacggtcgcctcttcagaggcccgaaattcgcgaacggagactacaacttcaacaaagtcgcaaaacccagctatacatcatacatactgggcgaatcactatgtaacaagcaaggaaccacgcgggaggagctagttaaagaactaaaacgagtattcgacgactgttccgcaatacaagccgataaaagataccagaaaatcaagcaacgcctcgaagacgaccctaaattcctcataaagcagaaaacacgtgccaacggagccatcccctaccaactccacctcgaagaaatgcatcaaataattgaaaagcaagggaaatactacccattcctagtcgaacaacaagaccttatcgaaaaactggtctccagccggatcccctactatgtcgggccactcaacggcgggcacgacccaaaccacccctaccccactaaccccatcgacccgaagcgcaaattcgcttggtccgtccgaaaacccggcatggaacacgaaaaagcctacccctggaacgtagacgaagtaatagactccgaagaaacagccgagcggttcatcaggcgaatgaccggaacatgcacctacctctacggggaacccgtcgtaccacggtgcagcctcctttatgaagagttctgtgtattgaacgaactcaacggcgccagatggggagaaggcaacggggacacccaccgattcgactccagcgacagaaccgaaatcctcgaacaactattcaagaaacgtaaacgggtaacacacaaggcaatagcaacatggttggaaataaaccacggggtcacaaacgtcaagatatccgggacgcaagccgaaaatgccttcgaatccaagctatcctcatacaacgacttctgcaacctgctaggcgtagacggcctagaggacgtttgcccactaacaaaagacgacatcgaacaaatcatactctgggtaacagtattcgaagacaagaaactcctcctccagaaactccagagggcgttcggcgacaaactatcggaaaaacagatcgcctcgataatgcgtaaaccatacgctggatggggccgactaagttccaaactgctaacaggaatcaaacgtgaaacacccttcggacgcatatccatcctcgacgtcatgcgagacggggacccccggcccggccaccacctcgacgcaatgaacttcatggaaatcctacgcgagaaagacttcgggttccaagaccgcatcgacgagataaacaaagaacggacaaaagaaagcggattactacttagcgtggaagaccttccaggcagccccgcgctacgccgctccgtaaatcaagcgatgcatatcctcaaagaaatcgtatcgatagccggcaaagaaccctcccgcattgtaattgaggtgacgagagacccggacgaagaaaagagaggccacagaacagacacgcggtacaaacaacttagcgaagcactggccgccataaaaacagacatcgtccaattcgactcaagcctcctggcagaattaaaggaacgcaaagactccctcgatagcgaaagactaatgctctactttcagcaatgcgggaagtccctgtactcgggtaaaccactcgacataaaccggctatccgaatatcaagtcgaccatataatcccacaatgctacataaaggacgattccttggacaacaaagccctcgtcttcgcctctgagaatcaaatcaaacttgactcgctactactagacaagagcataatcaggagccagaaaggtcgctggcaagaactacaccgggcgggactgatatccaacaagaaattccggaacctcacatgcacggaaatctcggaccgaatgatgaaaggcttcatcaaccgacaacttgtagaaacatcccaaatcgtaaaattcgtccgtcagatgtgcgaacagcgatacgaatcgagtgaagtcatcagcctacgagcctccctcagtcacaatcttcgagaccgatgcggcttcatcaaatgtcgcgaactgaacgactaccaccacgcccacgacgcgtacctggcgtgccaaatagcacgcttcattggaatccgctacccgagatggcaggacggcatctcgcgggagttcataaataaatatatcaaacagctagtaaagaaagggaaatcaagcggcaagttcttcgccggcaagtcaggcttcataatagacagcttcatgcacgacggattcgaccgggaaactggcgaaatattccgcgatggctgggacgcaacgttcgagattacaagaatgagacgcgtcctcggctacaaagactgcttcataacccgcatgcctgaggaacaaacaggggcatactgggaagaaaccatatactcgcccctagacgccaagaacgggaagaacctacaaatccccctaaaacaaagcggaaaggaaggataccttgaccccaaaaagtatggcggcacaaacacggccttcaacgcctacttcttcgctttcgtagcaaaggacgcccggggccgagacaaatactttttcgagggggtcccagtatatctagccaagcaactcaacgaacaaccacaaatcctcgttgacttcgcaaacagcatagcagctacaaagaaatgctccacggccaaaatactccgaagcaaggttcccctcaggcaaaaattccttcttgatggcacaagtttctacctagggggcaggacaggcaacaagaacgtaatcctctccggcgtagagtttgcctgcggaattgacatggccaaaatgatcgatacggcaatcaaacaccccgaggaactctcacagaaagaactcatctcgataatccaaatgctagctgatacaatagagcgcaacagtgaccgacaggcatccctaataaacttcagacgtttcgacgataaacttagaaacatcgacgcgatcgcggcatcacgcatcattaaaaacttgctgaacagcatgaacggagtaaaacagagttgcgacctcagcgacctcggcggcagcaaacaaagcgggttcatgcaaagcaacatagcaaccctatttgaacgcatcacttggtgctactccagcatcaccggcatgttcgaacaaagggtgtctttcgaagaccttaaaaacgggatctga

SEQ ID NO: 6488 - RNA, 4041 nt, synthetic construct
  misc_feature 1..4041: note = Cas9 variant
  source 1..4041: mol_type = other RNA
atgaagaagagaaatcgagaggaatattacgtcggtctagacataggcacgtcctcagtcgggtgggccgtagccacacccgactaccggatccccaaattccgcggccacaaaatgtggggtagcaggctgtttgccgaaggcaaaagggcagcagagcgccgacaattcagaacaaaccgacgcagactagcacgacgccgagaccgcttacagatcttagaggagcttttcgcagaagaaatggcaaaagtcgataacacctttttcatgcgcctgaaggaatctaagttcttcctcgaagacaaaacggtaaaggaaaagcacatcctgttcagcacggacaaattcgacgccgaccgcttctacaaggacaacccgacaatataccacgtacggaaaagactcatggaagaagaaccccaggacatacgagagctgttcctagccgtccatcacatcctgaaataccgcgggcacttcctcttcgccggcagtctagaacaaaatggtgactcaatcgaggaactcgtacgaactctattcggcaagcaaggactagccatcctcgacgacacaatcgactcaaacgaaatggtgaacatactcaaaaacaacgagaaaacaaagagcgaccggaagaaagcagtccaggaactatggaaccccctcaaagataaagtgaagaaagcccaggccgctgaaatggccggcgtggttctaggactaaactcagacatctcgaaactcttcgacaactctgattacaaagacctcaaaattaacttcagctcaggggactacgatgaaaagcgcgacgactacgccaacagcatcggcgatgacatcgtcctactagacacaatgaaagccttatatgataccctcatcctatcacagatccttcaaggcaagcaaagcatatcggaggcgaaagttgaagactataacacccacaaggagcaactccgtgcgctaaaagctatcctaaaaccgcataagcgactctataacgaaatgttccgcgaaaacaacaagaaagacctctcaaactacgtagcctacatatccagctactccgaaggcaagcgggtcaaccgcgaaggcttctacaagtacgtacaagccgtcctaaaacaagtagacgacagcgacagcaaacaagctatcctggaagcaatccgactcgaaacattcctcccactactacgcgtaaaagacaacgcagtgatcccccaccagatccaccaggcggagcttgaggctattctcgagacggcccgcaaaaagtacaagttcctcaacgacgtgagcgaaggagtaagcgttaaagacaaaataatacaactattcacattccgaataccttactacgtcggcccccttaatccccactcaggagaaaccgtggcagaccgcaagcaaggcacaggctgggtcgtccgcaaacaacggggcaaagtatacccgtggaacttcgccgacatggtagacgtcaaggccagtgcagaagccttcatcaccaacttaacaaacaagtgcacatacctcatcggggaagacgtactgcccaagcgctccctactctactcagagttcatgctcctaaacgaactcaacatgatcaaatacgatggacatgaactgcctgtcgaaataaaaagactatacatcgagcaagtattcaaacaggaacacaagaagcagaccaaaggacgcgtactagatttccttaagcgcaacggcctcatcacaggctccgctacagctgtcattacggggatggacgactcgataaagggagatctgcaatcctaccgagacatggtcagaatcttcggcaccggcttcgaccattctatggcggaacgtatcatccgatgggttacactatttggagaagcaaaggacatccttgagaacaaaatccgagaggtatacggcaatagtatttcagacagtcagatgagagccatcaaaaagctcaaatacgccgactggggacgcctgagccaagcgttcttcattaagatcatcggatgcgacaaaagcggcgtcgagcgaaatatcataacgtgcctacgcgaatcaagccagaatctgatggagatcctcagtgaccaaggtacctacattaagcaaatcaaagcctggaaccatcaacataccacaaacatgatggacaccctcgactaccagctagtggacgacctgtacgtcgcgcccagcgtgaaacgcagcatctggcagtcactatgcatagtcgaggagctcgtcaaaatcatgggccaagcaccgaagaaaattttcgtagaagtcacccggaccaaccaggcggagaaaacaaagaaagactcccgcaagaaacggctagtcgaactatacaccgccataggaaaagaaggcgccgcatggaaaaaggaaatagaaaagcatcaggccggcgacttccgacgaaagaaactatacctctactacacgcaaatgggtagatgcatgtactcgcacgaacccattgcgatggacgctctgttcacatccgaatacgacatcgaccacatctacccccagagcctgaccaaagatgacagctgggataacctcgtcctagtaaagtcgcagctaaacaaggaaaagagcgaccaatacccgctacgccccgcaatacgtgagaaaaacaaggcatactggcagtacctctgcagagcaggtttcatcagcgaaaagaaatacgaacggcttatgaggacgaccgaactcacggcagaagaactcagcgggttcatagcgaggcagctcgtagaaacgagccaagcaacaaaagcggtaataggcctcttggaaagaatctacaaacacacagacatctgcttcgtcaaagcagaaacggttagccaattcagacaccagcataactttataaaaatccgggaactaaacaactaccaccacgcaaaagatgcatacttgaacatcgtagtcgggaacgtctaccacgagaagttcaccaagaacccaagagagttcattgcccgctcaaccgaacgcaggccctataacttgaaccgtatgtacgactttgacttactcaaacagggacgagtaatatggcaagtgccaaaatcactcgaaacggtccaggcgatgatgaaatcaaacgacgtccggatcaccaaaaagctcctcgtgcaaaagggagaactctacgatgccacaatcacaaaggcccacaaaacaaaagagggaatgtacttcccactcaaaggcgccgacgcaagactccgcgacgtccaccgctatgggggatacgagaaaataaagatcgcctactacagcgtattcagctgctgcgaaaaagcaagcgacaccatccacacgctcataatcccgatcccagtctacgcagcgggactgctacagacagaagcggatctaaccgcctacgcttggcagacaaagcaaaagactaaaccaataaaagacatatacagcatgataacgcccatttacaagaaactatgcatcaacacagtcgtcaaaatcgacggattcaagtacttcctgggaggccgcacagaagactacatctgcttgtaccccgcgataccggtggtcctcgacgaacaggcagcagcgtacctcaaggcagtaagtaaagtaggacgcgcagacgatgtggaaaacacggcacaagccatcgacctaatcaccgccgaggcgaacgaagccttctacgatgtcctactaaagaaaatggaagccaaaatcttcgttaaggcctaccaagaacgggtagaaaaactggcctcagagacagcacgcgaacgtttcaggaaactcagcatcggggcccaatgctcgtgcctactagaaatcctaaatctactcgccaacaacaaaacgacaagcaacctgaaaaagtggctaggagtcaccatgagcagacgaaaacaaccaatggacctgacgaagctggaagaatgtatcgtctacgagacatcgatcaccggactctacgaaaaagccgtatcgctcctatga

SEQ ID NO: 6489 - RNA, 4041 nt, synthetic construct
  misc_feature 1..4041: note = Cas9 variant
  source 1..4041: mol_type = other RNA
atggtggagcactacgccattgggttcgacataggcaccggatcaacgggctttgcgggggtggaccccaatgggaagctagtacgaatgcgcgggaaaaatgtctacggagtgtatcgttttaaaggcggcgaagctgcagccgaccgccggggatttcgcacaacacgtcggagaataaaacgaagaaaatggcgcctacgtttccttaaatcatttttcgagccctacatagcccctatagaccccgagttcttcctacgacaaaaatactcggccgactccccgctagatcccaaaggcattagagcagacaaaggacttctgtcagacatgagcgaccaagagttccacgccaaatacccgaccatctaccatctacgctaccagctaatgcacgaaaaacggcagttcgacgtccgtgaaatctacctagccatgcaccacataattaaatatcgcgggcacttcttgatagaagacggcgccgataactttgacgcaaagcaaatagacttcttcgaccagttccaacgcatggctgccgtcacagccggcctcccagaactcgaaaccctagtcgtacctgacgaaacacaatcagacgcattcaagcgtgtgctattcgatgaaagccagaccaagtcagaccgacaaaaagtcctcgcttctcaactactagacatccaggataatcaatctaaagcgatcaaagacttcatcgcagcactgactaaagcagtggtcggtatgaaagccaatcttgcgaccctcacctcaaccgcaatcgaatccactgacaaaaacgattggaccaaaccgctaggccaactcgacgacttcctactaaaacacgaagaagacctagacgaagacggctacgccctcatagatgcagcgaatcaaatgtactcagcagccgtactcgcggcactcgtcccggaaggtatggggttctccgaagccatgatggctcgctacgcacaacacaagaaacagctcgcactatacaaacaagtgatcgcgtcactacccgataaaacccaaaggcacgaactgaaagacgcctatgccgactacatcgagcacgccgcccaaaacccccgagacgctttctacaaacgagtcaccaaggtcctcgaaggggtcgactcggccgacgcgcgaacggtcatgaccgcaatatcgcacgacgagttcctgctcaaacaacgaacgctgtcaaacggaaaaataccatatcaaatgcagcaacacgagttcgacgccataatagaaaaccaaaaagcctactatccctggcttgcaacgcccaaccccgtcgaagcagatgcaaaacgtctcccctactatttagacgaactcatcggctttagagtcccgtactacgtaggcccgatggtgaccgaaaaacagagccaattcgcctggatgatacgcaaagccgacggcgaactgaccccctggaacttcttcgatgtagtggaccgagaaaagacagccaaccggttcattcaacgaatgcaaacaaccgacaaatatatcctcggcgaagacgtactaccgaagcatagcatcctctaccaacaattcgaggtcctcaacgaactgaacaacatccgagtggaaaaacacccccttaccacagaacaaaagcaattcatataccaacgccttttcgtcgaccaacaacgaaaaaccatcacaaagaaaaatctgcaggacaccctcgtcgccatgggcgagttcgacaaagcgcccgacataggcggcctcgccaaagaagacgtcatgatgagctcattggccacatttgcggactattcaaaaatcctcccggaagcaatatccgacccaacgcgtcaaaacgatatagaagacataatcgcctggagcaccatcttcgaagacactcagatattctttgacaaactcaaaacagtagactggcttacgacacagcagcgaaaacgactcgcaagcatcagatataccggctggggcaaactgagcaagcgcctcctgcagcaaatcccaacatccaaacacacaaatgtaatggcggccctctgggcaacctctgataacttcatgcaaatactacaagatgaacaattccaagaaggcctctacgatgcaaatcgcctaccagaggaaacactcacgcctgacgaacaggtagaaaagatcctggacgaggcttacttatctccggccgacaagaaaggggcacgcaaagttataaaagtaatgaacgacatagtccgcgctaatcacggagtcctgcccgaacaagtattcctggaatcagctgatgacccacagaaaaacaaaagacgaagtgtatctcgaagtaaacaactcgaagaaaaataccggcaagccgcccagtcgttcatagacgaagccgtaaaagaagaactaaacgcgcagatagtcaactcagcggagttcaacgaccgactggtactatactttacccagaacggaagagacatgtatacaggtaaaagactagacatcgaaaaccttggaagctaccaaatcgaccacatcctaccccaaagtctagtcaaagacgacagtctcgacaaccgcgcactcaccgccagggacatcaatgccgaaatgtccaaccagttcgtatccgaacggttcggattagggccacgcgcattctggcaacaactcaaaaacaacggcctaatcagcggtcgcaagttcagaaacctcgtaatgcagcgagacgaaatagacaaatacgcgcccggattcatcaacagacaactcgtagaaacacgccagataatcaaaacagtggaacaaatcatccacagactatggcccgacatacaaatagtaacaatcaaagccaacctaactcaccaagtccgcagcgaactggggttccccaaagtccgggaactaaatgactaccaccacgcctttgacgcccttctagccgcccggataggccagtacctactggaacactacgccggcctgaaaccatttttcacctacggcgagttcaaacgcggtgacacaaagaaatacggaaccaccaacttccttcgacgactaaccaaggacaacaaagacaagaaaggagagctcctgcccgaagtctcagactggatagactccattgacagcatatacaactacaagaaaatcccggtcgtctgggagaacacaaccaacatgtcagccctattcgaccaaaccatatatccccggccagaccgcgataccacaaaacggaaactgatccccacgaaactagataaacccaccgatatatacggcggctactcgtcagccaaaaccgcctacatggccgtcatgcgtgtccagacgaagaaaggcacagagtacccagtcttcaacatccccgtctccatagcaagccagctcaaccgaataaccgaccaaaccatgttaaaacaacaagttaaacaattcatcatcaatgcggaacagtcagcctcaaagaagaaactctacgaaagcggggacgtgatactcagccgagtagccctgggacaacgattcacagataaaaactacggcgaggtatttctcatctccaacatggaagtccaaaatccccaatcgctttggctcggacgtgcgagccaacaacgcttaactcgcgaacccgagggaaacgaaaaacccgaaacctcgttggccgacatttaccaacaaatactcaaacaagtcgaccggtacttcctagccttcaacatccgacaacaacgacaaaaactactcggtacacttgaccagttcacgtcactccccgttggacgcgtcaacgaacagacccgcaccgaccagaatcaaagatcaatcatcgcccgggtcatgatcgtcttgggaaaaggctccagagaagaaaaattccccgagttcggcctgagcgccctcggccggctggtccgaaccggaggaatcacattatcagaagacgcacaaataatctaccaaagcccaaccggcctgttcgaaagacgcgtcgcactcaaagacttgtga

SEQ ID NO: 6490 - RNA, 4041 nt, synthetic construct
  misc_feature 1..4041: note = Cas9 variant
  source 1..4041: mol_type = other RNA
atggcgaaaatcctcggacttgacctaggaacaaactccatcggctgggccgtcgtagacatagagaacaacaacgagttcacactgatcgagaaaggggtgcgaatattccaagaaggtgtaaagatcgagaaaggcatcgaggggtcgaaggccgctgaacgcaccacttaccgatccgcccgcagaatcaagtacaggagaaagctgaggaagatacaactgctcggagtgctcagcgagaacggatactgtcccttcctcagcaaagacgagctcgatagctggcgctacaagaaagtgtatcccacgaacaaatccttcctgaattggcagaaaacgaacgagatccaactagagaacccttacttctaccgagcgctgctagtagagaagaaacttaacctcaacatcgaagaggacaggttcaaaatcggaagggctttctaccatctcgcacagagacgcggcttcctgtcgaacaggatggaggggaccaaagaaaacgacggaaccgtgattaaatccataacggaaatcagcaccgccaaaggagacaaaaccctgggccaatacttctacgaacgctacaagaaaggcgagaaaatacgcgacacctacacccaccgcgaagaacactacctcgaggagttcgtccggatctgtgagtttcaacaactggacaacaaattcgccgaaaaagtaagaaaagctatattctaccaaagacccctcaagagccagaaaggcctcataggcaaatgcgtattcgagccgaagaaaagccgatgcagcgtgagccgaccagagttcgaggagtatagaatgctgtgcttcctaaacaacatcaaaatcaagaccccaagtgacgagaatctccgattcctcacggacaacgaaaaagagaaactcaaaccacagttcttccggaaatcgaaggaccactttgactttgaggaccttgtcaaacaactggctcccaaaaatcagttcaaattctacaagagtcgcgacatcctaccaggaaattggctatttaactactccatgaacaccactgtctccggctgcccaatatcagcaagactcaaggacctcttcggcgagaacttcatggacatcaaattcgactacatccgagaaaaagatgggaaaaagtctgtgatcgacatccacgacatctggcacgtactgttcacctacgacagcgaagagaaactcaaggagttcgcccggaaccgattaaacctagacgacatcaaaataaaagagttccaacgaatacagctgaagaaagaatacgccgcccttagcttaaaagccatcagaaaaatcctgcccttcctcagggaaggattaatctactctcatgcggttttcatagcaaacatggaaacagccatacccagcgaaatatggaacaactacaccaaccgaaacataatcaaaaatgagatatacaacataatctcgaaccagaccgaggacaaacaggtggtcgacatcgtaaacggcataatcaaaagttcccggatcgaaaattccgtttggtccaacgaagcagtggagttctttaagaaagacctcaacagcaaaatcaaaaactattacggcataaaaacgtacaacgacttccccgaagagaagaaaatcagaatagagacctatgcattcaacctgttcaaacagcagatgatgaaaaacttcggaagaggagagttcgctgcagtacaaagaatagacgaacgcctcaaactctttcttaccgataactttaacatagacccgattctgctcaagaagatctaccacccgtcagccatagaagtctaccagccgccggtacggaaaaacgatggcaaactctaccttggctcacccatggtctcaagtatccgcaacccaatggccatgcgcgccctccatcagttacggaaactaatcaacgaactcatacggaaagaactaatcgatagcaacacaaaggtaaacatagaaatggcgagggagcttatgaacgcaaacgaacggaaagcataccagaactggcaaaacgatcgagaaaagatccgcaaagaatacgcgctcaagatcaaacaacacctagacgtagacaaagaaccatcggacgtagacatcctaaagtaccaactgtgggaggaacagaaccacaaatgcatttacacgggcaaagaaattaacatctctgactttttaggtagcaaccccaaattcgacatcgagcacacaatcccacgcagcatctccttcgacaactctcaatccaacaaaaccctctgtgaaaactacttcaaccgtagcgtcaaaaagaatcgcatacccgccgcactccctaaccatggcgagataatagaacgactcgagaactggaaactgaaatacgaggaactcgaaaaacaaatccaatacgccgtacgccaagcgaaaggcgccggagacaaagactcaaaggaccgagccatacagaaaagacacaaactaaagttcgaatacgactactggaaaaacaagtacgacaggttcgtaatggaggatgtccccgaaggattcaaaaacagccaactcgtcgacactgggatcatcaccaaatactcaagaatgtatctgaacaccttattcgacaaagtgtacacagtaaaaggcaacacggtcgccgacttccgcaaactatgggggatacaagatgaatacgaaaagaaagcacgagtgaaccacagtcaccactgcgtcgacgcgatcaccatcgcctgcataaccaaaagcaactacgaaaacctcgcgaaattttaccacgactgggaggaactacacgtcaaaggcatcgaccaactcccgcccatgaataaaccctggaaaacattcaccgaagacataaaggccatacaatacgagatcttagtgtcacactacaccccagacaacctacccaaacagagcaagaaaatactccgcaagaaaggacgcatccagaaaaacgaaaacggcaaccccatctatctgaaaggagacacagtccgaggctcccttcatcaacagactttctacggtgccatcgagaaaacagaagtgaacaaaaagggagaacccgaaaaagtaatcaaatacgtcgtccgaaagagcctagatgttctcgacgacagttcggtcaaaaacatcgtagacgacatcgtcaaagaaattgtccagaacgcccgcatcaaagaaaaggatttcatcaaagagctagaaatacaaaagagaaaactcgccaaggccgaggaaaacaaggtcgtccaaatccaagcagaaatcgacaaattgaacaagcaggtagccgacctctacacaatgcccaacaaaaacggtaatcccatcccgatcaagaaagtgcgcattttccaaacatcagtgacgaacccaatccatctaaaacaacagagagacaaaagccagaaaacctcaaagccacacaaggagttctactacgcggctaacgactcaaactacatgatggcgatctacgagggcaaagacgaaaagggcaaagtaaagagagacttcaagctccttaacaacctagaagccggagagttctttaaatacagtgtgcacaaagacctcaaagaaaagaacctagaaaacatccgcaacgtcataccagataaagtctcggccggtaaaatcgaaatcccactcaaggccatcattaagacgggaaccatggtcatcctttgggaaaacagcccggacgaggtctgggacctgacaatctcggaagtcgacaaacgtctttacaaagtcgtcggcatgtcggtgaaccgcatcaaatccgacgtaaaaacgttcgagttcgggaatatcgtcctccgacacaacaaagaagcgtccccggcaacgctcctgaaaatacaagacggcgagttcaagagcgacgaaaactacatagcccaacgcaagctctcgcataaccaattcaacgccttagtcgaaggagtcgatttctcgctcagcgtgcttggcgagatcaaacggctcaagtga

SEQ ID NO: 6491 - RNA, 4044 nt, synthetic construct
  misc_feature 1..4044: note = Cas9 variant
  source 1..4044: mol_type = other RNA
atgggggaagacgggaaaccagtacgcgtaaagggcaaaaccgcaataggcgcacgtctcttccaggaaggtcacgtcgccgccgaccggcgcatgttccgcaccacccgtcgtagactgaaccggcgaaaatggcgactaaaactactcgacgagatattcgacccctacatcaccccggtcgacagcacctttttcgcacggctcaaacaaagcaaccttagtcccaaagactcccggaaggagttcaaaggctcaatgctattcccggatctgaccgacaagcagtaccacgaagactacccgacaatataccacctccgacgcgccctcatgacggaagacaaaaagttcgacatacgaatggtatacctcgccatacatcacatcgtgaaataccgaggcaacttcctgaactccgccacagttgataccttcaaagcatccaaagtcgactttaagaaatctttcaaccaactaaacgaactatacagcgcaatcaacccggaagatgccttccaagtcgacatgaacaaaagcgacgagacaggacgcttattcctcgacagctcgatacgcaaattcgacaagcaaaaacaaatttccaaattgatcccagtggtggtcgaagacaaggaagcgaagaaactaaacgggaagatagccctcgaaattacaaaagccatactcggatacaagtcaaaactcaacgtggtaacacaaacagaaccagaggacccaaagaaatgggcagtcaagtttgacgacgaagacatcgactcgaaacttaacgacatactgcctgagatggacgaaaaccagcagagcatcgtcgaaataatacaagacctatattcccaagtcacccttaaccaaatcgtgccgaatggcatgagtctttccgactcaatgatcaagaaatacaacgaccaccacgaacatctcaagttgtataagaaactcatcgacaacataagcgacacaaagaaacgctctgccctaaaaacagcatacgacaaatacgtcggcgacgacggcaaaactatagaacaggacgagttctactctaacgtcaagaaaaacctcgacgacagcgacctatcaaaacagattgcagaccttatcgaagcagaaaaattcatgccgaaacaacgcacttcacagaatggagtcatcccccaccagctgcaccaacgcgaactagacgaaataatagagcaccagtcaaagtactatccatggtttgcggaggcaaacccaaacaaacacgaccttcatctagccaaatacaaaatcgaggagctagtagctttccgaatcccctactatgtaggcccgatgatcaccccggaagaccaggaaaagtcatcccaaaccatctttgcgtggatgaaacgcaaagaacccggacaaatcacaccatggaacttcgacgaaaaggtcgaccgaatggaatccgccaaccgtttcatcaaaagaatgaccaccaaggacacctacctcatcggcgaggacgtcctccccgaccaatcactcctatacgaaaaattcaaagtgctcaacgaattaaacatggtacgcgtcaacgaccacccactaaaggtgagcgaaaagcaagcgatctacagggatctcttcgaaaatcaaaagcggataagcgtcaagaacttacaaaattacgtgaagtccaagagtggcctccctaccggacctaaaatatccgggctcagcgacccagaccacttcaacagcagccttggcacctacaacgacttcaagaagatgttcggcgataaagtggacgaccctgacctccaagatgacttcgagaaaatgatcgaatggtccacaatattcgaagacaaaaagattctccgagcaaaactggacgaagtcgcgtggttgtctgacacccagaaaaacgaatttaaagaaatccgctaccaaggctggggccgcctaagcaagaaactgctcaccggcatcgtcgatggcaacggccaaagaataatagatgaactctggaatacgaacaagaacttcatgcaaattcaatcagacgacagcttcgccaaacgaatccacgaagcaaacgctaaccaaatgaaagcaaccgacgtcgaagacgttctggcagacgcctacacatcaccccagaacaaaaaggcgatacgccaagtggtcaaagtggtagacgatattcagaaagctatgggcggagttgccccgaagttcatatccatcgaatttacaaggtctgaagatcgaaacccgcgtcggacgatatccaggcaacgccaactcgaaaacaccctaaaagacaccgcacaagcccttgtcaaaagcataaacccggacatcctctccgaactggacaacgcatccaaatcgaagaagggcctgacagacaggctctacttgtacttcacgcagctcggaaaagacatgtacacgggaaaaccaataaacatcgatgaaatcagcaactacgacatcgaccatatcttcccccaagccttcatcaaagacgattccctcaacaacagggtgctagtatcgaaggccggaaacaacggcaagagcgcgaatgtacccctaaagctattcggagcaaaaatgggaggctactggaaacaactcgcagacgcaggactcatagggcagcgcaagctcaagaatctacaaacaaacccagacacgatctccaaattcgccatgcacggattcatacgacgccagctagtcgaaaccagccaagtaataaagctcgttgcgaacattctaggtgacaaatatcgcaacgacgacacaaagataatcgaaattacggcacgcatgaaccaccaaatgagggacgagttcggcttcataaagaacagggaaatcaacgactaccaccacgcattcgacgcctacctaacagccttcttgggccactacctctaccaccgatacattaaacttcgcccatatttcgtatacggcgacttcaaaaagttcagagaagacaaagtaactatgcgcaactttaacttcctccacgacctgacagatgacaagcaagaaaggatagcagacaccgaaacgggggaggtaatatgggaccgcaaacgatcgatccaacaactcagagacgtctaccactacaagtttatgctgatcagccaagaagtctttagtctaaataaggagatgttcaaacagaaactcttccccgccaccctggccaaaaagagcaaactcatccaaataaagaaagacaaaccagtcgacatatacggtggttactccaacaacaccgacgcatatctcaccgtcgtaaaactaaaaggcagtaaggaggacaaatataaaatcgttggcgtccccatgagggcgctagacaacctaaaacacgccgagaaagagagcccccaatcctacacagccgagcttcgcaaggcgctcgaaccacaattcaccaagatcaaaaagaaccggaagacaggcgaggtctccaaagtggtaacgaacttcgacatcgtcctaggccggctcttttacaggcaaatggttatcgacggttccgaaaagtcgctcatcgcgagctccgtctaccagtacaacgcgaaacaacttgtcctatcagaccaggcaatcaggacaataagtgatcaagaggggatcgacgagttcgaactcagctcgcaatacgataaggtatacgacgaaatcgtccaaaaggtagaaaaattactcccgatattccaacaccgacacttccaagagcgtctaaacaatggcaaatccctcttcgtcaaccttccagtacacgacgtttacgagggaaacaaactcgagcaggtcggcaagaaacacatcatcaactccatactcggtggcattcacgcaaacgcggaccgccccgatatagacctctttgggattaagaacttaggccaattctccagcaccagcggcatcaacctcagctccgacgcgatcatctgctaccagtccccaaccggcctattcgaacgccgagtcgtcctcaaggacctatga

SEQ ID NO: 6492 - RNA, 4044 nt, synthetic construct
  misc_feature 1..4044: note = Cas9 variant
  source 1..4044: mol_type = other RNA
atgactaaacgcgaagaaccctacaacgtcggactcgacatcggatcgtcatcagtcggctgggccgtggtcgataacaactaccacctattaaacataaagaaaaacaacctctggggcgcacgcctcttcaaagaagcagagacagcacaagtcacccgcggacacaggtcaatgcgccggagataccggcgcaggcgcaatagactcaactggctcgacgagctctttgccgatgaactagcgaaaatcgacccctctttcctactccgtatgaagaactcctgggtctcaaagaaagaatcaactcgcaaacgagacccgtacaatctctttatcgatgagaaatacaacgacgtagactacttcaaccagtaccccaccatattccacctacggaaagaactaattacagaggacaagaaagttgacatccgactaatctatctggccatccacaacatcataaaataccgaggcaactttaccctcgaaaatcaaaatttcgatatctcgcagctaagcagtaacttcagccaacagatctccgacttcttcgcactgttctccgacttcggcgtcatcatgcccgaagacttcgaccccgacaaaatcagcgacatcctcctcaaccccaacttatccccgtccggcaaagtctccgaggccatagccacgatctcacccaaaacaaacgtcaaagccaaaatcaaaattatcctactcctcctggtaggcaacaacggggacctcaagaaacttttcgacctagagacaaccgagaaaattgctgtaaaactcagcagcagacacatagactccgaacttcctatcatcctgtccgaactaaacgaacagcaggaaaacataatcaccatagccaactccatcttcgggtccatcatactgaaagacttcctaggagacgaaacgtcaataagcgcagccaaagtaatctcgttcgaggaccacaaacaggacttgcaaaaactcaagacgatgtggagagaaactagcaacaaggaagctgtaaaagcagggaagaaagcatatgaagactacatcggccacgaagactccgaaactttttacaagaaaatcaagaaattcctcgagaaagcccaacctgtggacctcgccaacaaagcactggccgaaatcgaactggaaaattacctccccaaacagcgaaacaggaataacactgtcatcccgtaccaacttaacgaaaacgaactcatcgcaatcctagatcaccaagagaagtactacccctttctcaaagaaaaccgcgataaaatactatccctcctaactttcagaataccctactacgtcggaccactccaagactccaacaataacagattttcctggatgaccaggaaagcctccggcgccataaggccctggaacttcagcgagaaggtgaacgttgaacaatcctcgaacgacttcataaaaagaatgcgttccacagacacttaccttataggcgaacctgtgctaccgaaaaagtccctaatataccaatgctacgaagtcttatcagaactaaacaacacccgggtaaaagacggctcctcaaaccccaagaggttagacgtcaccatcaagcaaagaatctacaacgagatcttcaaaaaccagaagtcagtttcagtaaaagtcctccagaactggctcatcaaagagtcatacttcaagtcccccgagatctccgggctcgccgacaaaaagaaatacctctcatcactctccacctacatagacttcaaaaagatcttcggccaacgcttcgtagatgaccccgtaaacagcccccagctagaggaactcgctgaatggctgacactcttcgaagataagaaaatcctccttatcaaactccaaaactccaaatacagctatgaccaagccacaatcaacaaactctccacaatgcgctaccaaggcacaggcaaactttcgaagaaactccttgttgacctgaaaaccaccaaaaagtcgatcggcaaatcaggagccgagtcactaagcatcctagatctcatgtggtcgacaaaggacaacttcatgcaaataatccacgacgctgactacacattcgaacaacagattaaagagttcaactacgacaccgaagatgaattaacgcccctcgaaaaagttgccaacctacacggctccccagccttaaaacgcggcctaaaccaatcaataaaggttgtggccgacatcgtcaagttcatgggccacgacccagagaaaatatttatcgagttcacccgcagtgacgacttctccaaattaaccatctcacgataccgacgcataaagaagcagtacctagagatcgccaaagcaatcaagaagatcccagccgagttcaaagacatcaaggaataccaaactcaacttgaagaaaacaaggggaaacttgcatcggaaagactaatgctctacttcctccagtgcggacactcactctactctaacaagcccattgacctcaacatgatcaactcctcgaagtaccacgtggaccatatcctcccgcaaagctacatcaaggacgactcactcgaaaataaagcgctcgtattggcctccgagaacgaaaataaaatagacaacatgctcatatcacacgacatcatagccacaaacctcccccgctggcaagcactaaaggaccaaaacctaatgggaagcaagaagttcgccgatctgacgcggacaactgtcacagaaaaccaaaagaagggattcatccaacgccaactcgtgcaaaccagtcaaatcgtcaaaaacataaccctaatcctgaatgacctatacaaaaacacctcctgcattgaaacccgcgcgaccctgagcagtgagttccgcaaagccttttccaacttcgacgagacaacgtatcactatcagttccccgagttcgttaaaaatcgtgacgtaaacgacttccaccatgcccaagacgcatttctagcttgcgtgatcggcgaatatcaactcaaaaagtaccccaaagacaacctacgtctggtgtatgaccaatactcaaagttcttggactccctcaaaaaggacacccgcaagaaaaacggacggatgccacgatacacacaaaatggattcataatcggctccatgttcaatggcaaaacatatgtcgacgacaacggcgaaataatctgggatcaaaagataaaggaaagcatccgcaaaacattcaactaccaccaattcaacgtagtccggcaaacgatcgaacagcacggcaaactcttcaacgacacgatacagccccacagcgacagatacaaactcattccccttaaaacgaaccgagaccccgccatctacggtggatataacaacgacaacaacgcctacagcgtcgtcctcgacgtcgacggcaagaagaaaatcaacggcataccaatacgaatagcgaaccaactcaaatccgacgagctagacctatcctcctggctagaaaacaatatcaaacacaagaagccgatgaccattctcatcgacaaagtccccaaataccaacgcatcatcaacgaagaaaccggagacttactcataacgagcgccaacgaggtaattaacaatgtccaactcttcctcccgtccatgtataccgcccttatcagcctcctagacagcaccaaaactgaaatgtactccaagctcctctccaactacgaagccaacattctcatagacatctacgattacctcctgaccaaactcaaaaacaactatcccctgtacagaaaagaatgggcaaaattagccgaacaccgtgacgatttcatcgaatccgacctagtcactcaggcgtccactctacaacaactcatcaagtttatgcacgcagacccgagcaacgtgaacctgaaattcggcaactttaagggaaaccgattcggtcgcaaaaatggcaatatcaagctctccaagaccgacttcatctatgaatctcccaccggcctcttcaagtcaataaaacatatcgactga

SEQ ID NO: 6493 - RNA, 4044 nt, synthetic construct
  misc_feature 1..4044: note = Cas9 variant
  source 1..4044: mol_type = other RNA
atgaaaagcgaaaagaaatattatataggactagacgtcggcacgaacagcgtcggctgggccgtcactgacgagttctataatatcctacgagcaaaaggcaaagacctctggggagtgaggctattcgagaaagccaaaaccgcggcagacacacgaacattcagaagcggccgccgccggaacgaccggaaaggcatgcgactccaaatcctacgggaaatattcgaagacgagatcaagaaagtcgacaaagacttctacgaccggctcgacgaaagcaaattctgggccgaagacaaaaaggtgtcaggaaaatactcactttttaacgacaaaaacttcagtgacaagcaatatttcgagaaattcccgaccatctttcacctccgcaaatacctcatggaagaacacgggaaagtcgacatccgatactacttcctagccatcaaccagatgatgaagcgccgcgggcatttcctaatagacgggcagattagccacgtaacggacgacaaacccctaaaggaacaactgatactcctcataaacgacctcctaaaaatagaactcgaggaggaactgatggactctatattcgaaatactcgccgacgtgaacgaaaaacgcaccgacaagaagaacaacctcaaagagctcatcaaaggacaggacttcaataaacaggaggggaacatcctaaactcaatatttgaatccatcgtcaccgggaaagcaaaaatcaagaacataatatcagacgaagatatcctagagaaaatcaaggaagacaacaaagaggactttgtgctcacgggagactcctacgaagagaacctgcaatactttgaagaggtgctgcaagagaatatcaccctatttaacaccctaaagagtacctacgacttcgtcatactacaaagcatcttaaaaggcaagtcaacgctgtccgacgcccaagtggagaggtacgacgagcacaagaaagacctcgaaatactgaagaaagtaataaagaaatacgacgaggacggcaaactgttcaagcaagtcttcaaggaggacaacgggaatggctatgtatcatacatcggatactacctaaacaaaaataaaaagataaccgccaagaagaaaatcagcaacattgagttcacaaaatatgtaaaagggatcctggaaaaacaatgcgactgcgaagacgaagcggttaagtacctactcggaaaaatagaacaagagaacttccttcttaagcaaatatcatcaatcaactccgtaataccgcaccaaatccatctgttcgagctcgacaaaatactagagaacctagcgaagaactaccccagcttcaacaacaagaaagaggaatttacaaaaatagagaaaatccggaaaacattcaccttcagaataccatactacgtcggcccgctcaacgactaccacaaaaacaacggcggcaacgcctggatttttagaaataagggagagaaaatcagaccttggaacttcgaaaagatagtcgaccttcacaagagcgaagaagaatttataaaacgtatgctcaaccagtgcacatacctccccgaagaaaccgtcctccccaaaagtagcatcttatactcagagtatatggtactgaatgaactgaacaacctacgaataaaggggaagcccctcgacaccgacgtcaaactcaaactgatagaggaactattcaaaaagaaaacaaaagtgaccctaaaatcaatccgcgactacatgatacgaaacaatttcgcggacaaggaggacttcgacaactctgagaaaaacctagaaatcgtctcaaacatgaagtcctacatcgacttcaataacatactgggcgacaagttcgaactagaaatggtagaagacctaatcgaaaagataaccatccataccggaaacaagactctgctcaaaaagtacatcgaagaaacatacccagacctaagcagctcgcagatccagaaaatcatcaacctcaaatacaaagactggggccgactcagccgcaaactcctcgatggaattaagggacgcaacaagactgacgatgtgaacactgtcataaacttcatgcggaacagcagcgacaacctcatgcaaattatagaggggaagaattattcctttaatgagtacattgacaacttacgcaagaaatacatcccgcaagaaataagctacgaagtcgttgaaaacctctacgtatcaccatcggtaaagaaaatgatctggcaggtcatacgcgtgaccgaagaaatcacgaaggtcatgggatacgatccagacaaaatattcattgaaatggcgaagtccgaggaggaaaagaaaacgaccatcagccgcaaaaacaagctcctggacctatacaaggcaatcaagaaagacgaacgagactcccaatacgagaaactgctcactggactcaacaagctggacgagtcggaactacggtccaaaaagctctacttatattacacacagatgggaagggacatgtacacgggcgagaaaatcgacctagacaagctattcgactcgacacattacgacaaggaccacataatcccgcaaagcatgaagaaagatgacagcatcataaacaatctcgttctagtaaacaagaacgcaaatcagaccacaaagggaaacatataccccgtaccgagcagcatccggaataaccctgacatctacaactattggaaatacctgatggaaaaggaatttatcagtaaagaaaagtacaaccgcctcatcagaaacacgccattaaccaatgaagaactcggagtgttcatcaaccgccagctcgtagaaacgcggcaatctacaaaggcaatcaaggaactgtttgaaaaattctaccaaaagtccaaaataatcccggtcaaagcgtctctagcgtcagaccttagaaaggacatgaacaccctgaaaagccgggaggtcaacgaccttcatcacgcccatgacgcattcctcaacatcgtagcaggagacgtttggaacagagaatttacttcaaacccaatcaactatgtcaatgaaaatcgcgagggggacaaagtgaaatactcgctgagcaaatatttcacacgaccgcgcaagagcaagggcaaagtaatctggacaccggagaagggacgaaaacttatcgtggacaccttgaacaagcccagcgtgctcatctcgaacgaatcgcacgtcaagaaaggcgaactcttcaacgcaaccatatctggcaaaaaggattacaagaagggcaaaatctacctacccctcaaaaaggatgacagactaaaagacgtctccaaatatggcggttacaaggcaatcaacggggccttcttcttcctcgtcgagcacaccaaaagcaagaaacgaatccgcagcatcgaactctttcctctccacctcttgagcaagttctacgaagacaaaaacacagtgctagactacgcgatcaacgtgctacaactccaagatcccaaaataatcatcgacaagatcaactaccgcacggagatcataatcgacaacttcagctacctaataagtaccaagagtaacgacggatcgatcacggtcaagcccaacgaacaaatgtactggagagtcgacgaaataagcaacctaaagaaaatagaaaacaaatataagaaggacgccatactaactgaagaagacaggaaaatcatggaatcgtacatcgacaaaatttaccaacaattcaaggcaggcaagtacaagaacagaaggacaaccgacacaattattgagaaatacgaaataatcgacctcgacaccctcgacaacaaacagctctaccagctactcgtcgccttcatcagcctcagctacaaaacatcaaacaacgccgtagacttcacggtcattgggctcgggaccgagtgcgggaaaccccggatcactaacctgccggacaacacttacctcgtctacaagtccattaccgggatatacgagaaacgcataaggatcaaatga

SEQ ID NO: 6494 - RNA, 4047 nt, synthetic construct
  misc_feature 1..4047: note = Cas9 variant
  source 1..4047: mol_type = other RNA
atgaagaaaccttacacgatcgccctagacatcgggactaactccgtaggttgggtagtagtcacagacgactaccgtgtccccacaaagaaaatgaaagtcctggggaacacagaaaggaaaaccataaagaaaaacctaattggcgcactcctattcgactccggcgacacagcagaaggtacccggctcaaacgcacagcgcggcgacgatacaccagacgcaaaaaccgcctccgctacctcaaagaaatcttcactgaggagatggccaaagtcgacgacggattcttccagcgattagaagactcattctacgtcttagaggacaaggagggaaacaagcatcccatcttcgccaacctagccgacgaggtagcctaccataagaaataccccactatctaccatctacgcaaagaactcgtagacaacccacaaaaagccgacctccgtttaatatatctcgcagtagcgcatatcatcaaattccgcggccactttctcatagaagggacactgtcgagcaaaaacaacaacctccagaagtcattcgaccacctcgtcgacacctacaacttactattcgaagaacagcgactactcacggaagggattaacgcaaaagagctcctatcagccgcgttatcaaaatccaaacgcctcgaaaaccttatctcccttatcccaggacaaaagaaaaccggcatcttcggcaacattatcgcactatccctgggcctaacccccaatttcaaagccaacttcggactttcaaaggacgtcaaactacagctagcaaaggacacctatgccgacgacctcgactccctactggcccaaattggcgaccaatacgctgatctcttcctcgcggcaaagaacctgtctgacgccatactcctttccgacatactgaccgaatccgacgaaatcaccagggcacccctgtcagcgtcaatggtcaaaagatacagggagcaccacaaagatttagtcaccctgaagacccttatcaaggaccagctacccgaaaaataccaagagatattcctcgacaagacaaagaacggatacgccggctacatcgagggacaggtgagccaggaagaattttacaagtatctcaaaccaatcctcgcccggctagacggatcggagccactgctcctgaaaatcgaccgcgaagatttcctacgcaaacaaaggacgttcgacaacggttccatcccccaccagatacacctcgaggagctgcacgcaatcctacgtcgacaagaggtcttttacccattcctcaaggacaaccgcaagaaaatagagtccctcctcacctttcgaataccttactacgtgggtcccttggcacgaggccacagccgcttcgcatgggtgaaaagaaagttcgacggcgcaatacgaccctggaacttcgaagagatcgtagatgaggaggcatctgcacaaatcttcatcgagaaaatgaccaaaaatgacctgtacctccccaacgaaaaagtcctcccaaaacactccctgctatacgaaacatttaccgtctacaacgagctcactaaagttaagtacgccaccgaagggatgacccgtccacaattcctgtccgctgaccaaaaacaggccattgtagacctactcttcaaaaccaaccgcaaagttacagtaaagcagctcaaagaaaactactttaagaaaatagagtgttgggactcagtcgaaattaccggtgttgaagactcattcaacgctagcctaggtacataccacgacctcctcaaaatcatccaagacaaagacttcctcgacaacccagacaatcagaaaataatagaagatatcatcctgacgctcaccctattcgaagataaaaagatgatcagcaaacgactcgaccaatacgcccacctattcgacaaggtggtactaaacaagctagaacgacaccactacactggatggggccggctatcgggcaagctcatcaacggcatacgagataaacaaagcggcaaaaccatcctcgatttcctgaaagctgacggtttcgcaaatcgcaacttcatgcaactcatccacgactcggaacttagcttcatcgacgagatcgcaaaggcccaagtgataggaaaaacggaatactcgaaggacttggtcggcaaccttgccggatcgcccgccataaagaagggcatctcacaaaccatcaaaatcgtcgacgaattggtaaaaatcatggggtacttgccgcaacaaatcgtcatcgagatggcccgcgaaaaccaaacaaccgcacaagggatcaaaaacgcacgtcaacggatgcgaaaactggaagaaaccgcaaagaaactaggctccaatatactcaaagagcacccagtcgacaactctcagcttcaaaacgacaaacgatacttatactaccttcaaaacggaaaagacatgtacacaggggacgacctagacatcgactacctaagctcctacgacatcgaccacataattccccaatcgttcattaagaataactctatagacaataaggtgcttacttcccaaggggcaaaccgtggcaagctcgacaacgttccctcggaagccatagtccgcaaaatgaagggatactggcagtctcttctgagagcaggcgcgatcagcaaacagaaattcgacaacctaaccaaagccgaacgaggaggccttacccaagtggacaaggccgggttcatccagcgccaactggtcgaaacccgccaaatcaccaagcacgttgcccagatccttgactcccgcttcaacaccgagttcgacgatcataacaagcgaatccgcaaggttcatataataacgctaaagagcaagctagtatcagacttccggaaagagttcggtttatacaaaatcagagacattaaccactaccaccacgcccacgacgcctacctaaacgcagtagtcgcaaaggcaatactcggcaaatacccgcaactagcccccgagttcgtttacggagactacccgaaatacaacagcttcaaagaacgtcagaaggcaacccagaaaatgctattctactccaacattctgaaatttttcaaagaccaagaatcactccacgtaaactcggacggcgaagaaatttggaacgccaacaaacacctcccaataatcaaaaacgtcctatccatcccccaagtcaacatagtaaagaaaaccgaagtccaaaccgggggcttctacaaagaaagcatcctgtcaaaaggaaactcagacaaactcatcccccggaaaaataactgggacacacgaaaatacggaggtttcgacagcccaacagtcgcctattctgtgctagtaatagcgaaaatggaaaaaggcaaggccaaggtattaaaacccgtcaaggaaatggtagggattacgatcatggaacgcacagctttcgaagaaaaccccgtagtatttttagaagctcgcggctaccgcgaaatacaagaacatctgatcatcaaactacccaaatacagcctattcgaattagaaaacggccgacgccggttgctcgccagcgccagcgagctccaaaaaggcaacgaactctttctacccgttgactatatgacgttcctatacttagcggcgcattaccatgaacttaccggcagcagtgaagacgtcctacgaaagaaatactttgtcgaccgacacctacattattttgacgacattatccaaatgatcaacgacttcgccgaacgccacatactcgccagttccaacctcgagaaaattaaccacacataccacaacaactctgacctaccggtcaacgaaagagctgaaaacatcatcaatgtatttacctttgtggccctcggcgcccctgccgccttcaaatttttcgacgcaaccatagaccgcaaaagatacacgtccaccaaggaagtcctcaatgccactctaatacaccaatccgtaaccggtctctacgaaacaagaatcgacctaagccagctaggagaaaactga

SEQ ID NO: 6495 - RNA, 4047 nt, synthetic construct
  misc_feature 1..4047: note = Cas9 variant
  source 1..4047: mol_type = other RNA
atgaaatctgagaagaaatactacatcgggctcgacgtcgggaccaactcagtcggctgggcagtgacggatgaattttataatatactgcgcgctaaagggaaggatctgtggggcgtccgactcttcgagaaagccaaaacggccgcggatacacgcacgttccgctccggccgacgaagaaacgaccgaaaaggagtgcggctccaaatcctccgcgagatcttcgaagacgagatcaaaaaggtagacaaagacttctacgaccgtctcgacgaatccaagttctgggccgaggacaagaaagtatccggaaaatactctctcttcaatgacaaaaatttcagcgacaaacagtacttcgagaaattccctacgatattccacctccgtaagtacctaatggaggagcacggcaaggtcgatatccgatactacttcttagcgatcaaccagatgatgaagaggcggggacacttcctgatcgacggacaaatcagccacgtaaccgatgacaagccgctgaaacaacagctgatactactcatcaacgacctcctcaagatagaactggaagaagagttcatggactccatcttcgaaatcttagccgacgtgaacgaaaagaaaacagagaagaaaaacatcctgaaagaacttatcaacgcacaggacttcaataaacaggaaggaaaaatactttactccatattcgagtccatagtcaccggcaaggcgaagatcaaaaacataatctccgacgaagacatactggaaaagatcaaggaggacaacaaagaagacttcgtactcaccggcgattcctacgaagaaaacctccagtactttgaagaagtactacaggaaaacataaccctattcaacacactaaagagcgcgtacgacttcgtcatactacagagcatactcaagggcaaaagcaccctcagcgacgcacaagtagaacgatacgacgaacacaagaaagacctggaaatccttaagaaagtcatcaagaaatacgacgaggacggtaaactgttcaaacaagtcttcaaagaagacaatggaaacggttacgtctcgtatataggctactacctaaataaaaacaagaaaatcaccgcaaagaagaaaatatcgaatatcgagttcacaaaatacgtcaaaggaatcctagagaagcaatgcgactgcgaggacgaggacgtcaagtacctgctaggcaagatcgaacaagaaaacttcctactcaaacaaatctccagtataaactctgtcatcccccatcaaattcacctcttcgaactagacaagatcctcgaaaacctcgccaagtactatccgagcttcaacaataagaaagaagagttcacaaaaattgagaaaatccgtaaaacattcaccttccgaataccatattacgtcggcccactcaacgactaccacaagaacaacgggggaaacgcctggattttccggaacaagggcgaaaagatcagaccttggaacttcgaaaagatcgtagacttacacaagtcggaagaagagttcatcaagcgcatgctcaaccaatgtacgtatctacccgaagaaacggtactgccgaaaagctcaatactctactccgaatacatggtactaaacgaactcaacaacctacgcatcaacggcaagcctatagacacagacgtaaaattgaaactcatcgaagaactatttaaaaagaaaacaaaagtgactctaaagagcatacgcgactacatgatcagaaataactttgcagacaaagaggactttgataacagcgagaaaaacctggaaatagtaagcaacatgaaatcatatatagacttcaacaacatattaggcgacaagttcgaactcgaaatggtcgaagacctgatagagaaaattaccatccacaccggcaacaagaaactcctgaagaaatacatcgaagaaacataccccgacctgtcctcgtcgcagatacagaaaataatcaacctcaagtacaaagactgggggcgactcagtcgcaagctcctcgacgggatcaccgggaccaatatagaaaccggagaaatagacaccgtaataaacttcctccgaaacagcagtgacaacctgatgcaaatcatcggatcacaaaactattccttcaacaatgacatagacaaacttaggaaaaagtacataccgcaagaaattagctacgaagtagtcgaaaacctctacgtcagcccatccgtgaagaaaatgatttggcaagtgatccgaatcactgaagagataaccaaagtcatgggctacgaccccgacaaaatcttcatagaaatggcaaaatccgaagagggcaaaaagacaaccatcagccgcaagaataaactcctggccctgtacaaagctatcaagaaagacgaacgcgatagtcaatatgagaaactgctcaccggactaaataaattggacgattcagacctccggtcgagaaaactttacctctactacacgcaaatggggcgcgacatgtacacaggggagaaaatagaccttgacaaactatttgactcgacccactacgacaaagaccacattataccccaaagcatgaagaaagacgactccattatcaacaacctcgtgttagtcaacaagaacgccaaccaaacaacaaagggcaacatctaccccgtgccaagttcaatacgaaacaaccccaaaatctacaactactggaagtaccttatggaaaaagagttcatatcgaaagagaagtacaaccgcctcatcagaaacacgcccctaacgaacgaggaactgggcgggtttataaaccgccagctagtcgaaaccaggcaatcaaccaaggcaatcaaagaattattcgaaaaattctataagaaatccaaaatcatacccgtcaaagcgatactggcctctgacctacgcaaggacatgaacacgctaaagtcgcgggaagtaaacgacctccaccacgcccacgacgcattcctaaacatagtagccggcgacgtgtggaaccgtgagttcaccagcaatccgatcaactacgtcaaggagaaccgggaaggagacaaagtaaaatacagcttgagcaaatatttcactaggccccgcaaaagcaaagggaaagtcatctggacgccagagaagggccgaaaactcatagttgacaccttaaacaaacctagcgttctcatcagcaacgagtctcacgtcaagaaaggagaactcttcaatgcgacaatagccggcaagaaagactacaagaaaggcaaaatctacctccccctgaagaaagacgatcggctccaagacgtatcaaaatacggaggctacaaggccattaacggcgcattctttttccttgtggagcacaccaaaagcaaaaagagaatcagatcaatcgagttattccctctccatctgctctcaaagttctatgaagacaaaaacacagtgttagattatgccatcaacgtgctacagctacaggaccccaagatcatcatcgacaaaatcaactaccgcaccgaaatcatcatcgacaacttcagctatctcatcagcacgaagagtaacgacggaagcatcactgtcaaaccaaacgagcaaatgtactggagagtcgatgagatttccaacctcaaaaagatcgaaaataaatacaagaaagacgcgatcctcaccgaggaagaccgcaaaatcatggaaagctacatagacaaaatttaccaacagtttaaagccggcaaatataaaaaccgccgaacaaccgacaccataatagaaaagtacgaaatcatcgacctagacacgttagacaacaagcaactctaccaactactcgtcgcattcatatcgctgtcgtacaaaacctcgaacaacgccgtagatttcaccgtaattggcctgggcaccgaatgcggcaaaccgcgcataaccaatttgcccgacaatacatacctagtatacaagtcaatcaccggcatatatgagaaaaggatacgcataaaatga

SEQ ID NO: 6496 - RNA, 4047 nt, synthetic construct
  misc_feature 1..4047: note = Cas9 variant
  source 1..4047: mol_type = other RNA
atgaaaagcgagaaaaagtactacatagggctagacgtaggcaccaacagcgtcggatgggccgtcacagacgagttctacaacattctacgggccaaaggaaaagacctctggggagtgcgactcttcgaaaaggccgatacagccgccaacacgagaatattcagatccgggagaagacgaaacgaccgcaaaggcatgaggctgcagatattgcgagaaatattcgaagacgaaatcaagaaagtcgacaaggacttctatgacagactagacgaatcaaagttctgggcggaagacaagaaagtatccggcaaatacagcctcttcaacgacaaaaacttctccgacaaacaatacttcgaaaaattccccacaatattccatttgcgaaaatacctcatggaggaacacggaaaagtcgacatccggtactatttcctagccatcaaccaaatgatgaaacgaaggggacactttctcatcgatggacagatcagtcacgtaactgacgacaagcccctcaaggaacaactcatcctcctgatcaacgacctcttaaaaatcgagctagaagaggaactcatggactccatcttcgaaatactggccgacgtcaacgagaaaagaaccgacaaaaagaacaacctaaaagaactaataaaaggccaggactttaacaaacaagaaggcaacatcctgaacagcatcttcgaaagcatcgtgaccggcaaggcaaaaatcaagaacataataagcgacgaagacatactcgagaaaattaaggaagataacaaggaagacttcgtactgaccggagacagctacgaagaaaacctacaatacttcgaagaagtcctccaggaaaacataacactattcaacaccctaaagtccacatacgacttcctaatccttcaaagcatacttaaaggcaaaagcacacttagtgacgcacaggtggagcgatatgatgaacacaagaaggacctagaaatcctgaagaaagtaataaagaaatatgatgaagacggcaaactcttcaaacaagtattcaaagaggataatgggaatggctacgtgagctacattggctactacctcaacaaaaacaaaaagatcaccgcgaaaaagaaaataagcaacatcgagttcacgaagtacgtgaaaggcatactcgaaaagcaatgcgactgcgaagacgaggacgtcaagtaccttctgggaaaaatcgagcaggaaaactttcttctaaagcaaatatcgagcatcaactccgtgatcccccatcaaatacacctgttcgagctcgacaagatcctagaaaacctcgcgaaaaactacccttccttcaacaacaagaaagaagagttcaccaaaatagaaaagatacgaaaaacatttacattccgcataccctactacgtcggaccccttaacgactaccacaagaacaacggcggcaacgcctggatattccgaaacaaaggcgagaaaatacggccctggaacttcgaaaagatcgtagacctgcacaagtccgaggaggagttcataaagcgcatgctcaaccaatgcacatatctccccgaagagacggtacttcccaagagctcgatactgtactccgagtacatggtcctaaatgaactcaacaacctccgcataaacggcaagcccctagacactgacgtgaagctcaagctaattgaggaactatttaagaagaaaacaaaagtcacactaaaatcaatcagggactacatggtccgaaacaacttcgccgataaagaagatttcgacaactcggagaaaaacctcgagatcgctagcaacatgaaatcctacatcgacttcaataacatcctagaagacaagttcgacgtcgaaatggtcgaagacctaatcgagaaaatcacgatacacacgggcaacaagaaactactcaaaaagtacattgaggaaacgtatcccgacctaagctcaagccaaatccagaagatcatcaacctaaaatataaagactggggacgactgtcccgcaaactgctagacggcatcaaaggcacaaagaaagagactgagaaaaccgacaccgtgatcaatttcctaagaaactcgtccgataatcttatgcaaatcataggctcccagaactactctttcaacgaatacatcgacaaactccgcaaaaagtacataccacaagagataagctacgaggtcgtcgagaacttgtacgtgtccccctccgtgaagaaaatgatctggcaagtcatccgtgttacagaggagatcacaaaagtcatgggatacgaccccgacaaaatcttcattgagatggcaaaaagcgaggaagagaagaaaacaaccatcagcaggaaaaataaactactcgatctatacaaagcaatcaagaaagacgaacgggattcccagtacgaaaaactcctgaccggcctaaacaaattggacgatagcgacctccggtcccgcaaactgtacctctactacacacaaatgggccgagacatgtacacgggtgagaaaatcgacctcgacaaactcttcgattcaacacactatgacaaagaccacattatcccccaatcaatgaagaaagacgactccataatcaacaacctcgtgctagtcaataaaaacgcgaatcaaaccacaaagggcaacatttacccagtcccaagcagcatccgcaacaacccaaaaatctacaattactggaaatacctcatggaaaaagagttcatatccaaggaaaaatataacagacttatcagaaacacaccactcacgaacgaagaactagggggatttatcaatcgccaacttgtcgaaacccgccaatcgacaaaggctataaaggaactcttcgagaaattctaccagaaaagcaagataatcccagtcaaagcaagcctcgcctcggacctgcgaaaagacatgaacactctcaaaagcagggaagtaaatgatctccatcacgcacacgatgcgttcctgaatatagtcgccggagacgtgtggaacagggaatttacaagcaatccgataaactatgtaaaggaaaaccgcgagggcgacaaggtcaaatacagtctcagcaaggacttcacgcggccgcgaaaatccaaaggtaaagtcatctggacacccgaaaagggtcgcaagttaatcgtagacactctcaacaaaccgtcagtcctcatctcgaacgaaagccacgtcaagaaaggcgagctgtttaacgcgacgatagcaggcaagaaagactacaagaaaggcaaaatctacctcccactgaagaaagacgaccgcctccaagacgtgtctaaatacggaggatacaaagccatcaacggagcattcttcttccttgtagagcacaccaaatccaagaaacgcatccgcagcatcgagctattcccgctacatttactcagtaaattctatgaagacaaaaacacagtgctggactacgcaattaacgtcctccaacttcaggatcccaaaatcatcatcgacaaaatcaactaccggactgaaatcatcatcgacaacttctcataccttatatccacaaagtctaacgacggaagcatcaccgtcaagcccaacgaacagatgtactggcgcgtggacgaaatatcaaacctcaagaaaatcgagaacaaatacaagaaagacgccatactgaccgaagaggaccgcaaaattatggaaagctacatcgacaaaatctaccaacagttcaaggcaggcaaatataaaaatcgccgcacaaccgatacaattatagaaaaatacgagataatcgacctcgacactcttgacaacaaacagctatatcagctcttggtagcgttcatttcgctatcctataagaccagtaacaacgccgtagacttcactgtgattggcctgggcacagagtgcggtaagccccgcatcaccaacctgccagacaatacctacctcgtctacaaatcgattacgggtatttacgaaaaacgcatccggatcaagtga

SEQ ID NO: 6497 - RNA, 4047 nt, synthetic construct
  misc_feature 1..4047: note = Cas9 variant
  source 1..4047: mol_type = other RNA
atggaaaagaattactatctcggactggatcttggatcgaactccgtcggctgggcagcaacagatgaagattacaacttcctacgactcaagggcaagacagcatggggagcccgcatcttttccgaggcgaaagattgcaaagaaaggcgaacctaccggtctaacaaaagaagactcgcacgtcgcaaatacagactggttctcctgaaacagctgttcgcggaggaaatgactaaggtcgacaagacctttttcctacgcctcgccaactccacctactgggaggaggataaaacgaaagacagcgacggcaatgaaatcgggaaaaacctcatatttaaaacccacgaagaagagaaacaatactacaccaagtaccccacgatatggcatctccggaaagccctcattgaaaacgacgaggaagctctaagcaatctgcggtacgtataccttgcaatccaccatatcgtaaaataccgcggtaacttcctcacagagggcgaaatgggtaatgacatcccgcctatcacaaccatcgaagagatcaaccagacgttgagcttgctcgaagtcgactcgtccgaagacgccacagataaaacaacatatataaaacccgaaagctataatgaactcttcacgatccttgaaaacaacaacctgaacaaggttaagaaacaacaagagatcgacaaactgttcatcagctccaaagagcggtcagaaaatatcaaaaactacataaaccttttcaaaacaatcatcgtcggcgggtccttctccctgaagaaaataaacgaagatactgaagacatatccgtcgacttcaccaaagattttgaaaactccgaagcagacatatcaaaagcactcggggacagcttcaacctcgtcctaatcgccaagaaatactacgattacatcatcctcaaagaactactaggcaaaaacaaggaaatatcagaagccatggtacaaatctacgaagaacacaaagacgacctcaagtccctaaaaactatcctaaaggacctcgacaacaagctaggaaacgatggtaaagaccgcatctactacagcgtgttcaaacaagagcccacggagaaattcaaggaaaccaattacctatccttcgtccaaggcggcaaactggaggaactcaacaaatacatcaagaaaatactcgagaacaacgagaaagatatcgatgacaaagagacctacaacgccctctacgaaaaagcctgcaaaggcgatctattcaagaaacaagctaacgcgtgcacgagcttaattccccaccaattccacctccgcgagttaaagaaaatactcgaaaacgccggacggaaatacagtttcctaaacgacatttccgacaaaatcataaaaatcttcaaatttcgagtcccatactactacggacccctaaacaacgaaagtaacgcccactcctgggtagtaaagaaagaagggcaagaaaaagctaaaatcacaccatggaatatcaacgaaatcatcgacaccccaaaaactcgggacaacttctttaagaaactaaccaacagctgcacgtacctagtcggcgaaacagtactccccaaaacttccctatattacgaaaaatacctagtcctggatcggctaaacaagatgcaggtcaacggagactacctttccgccagcgaaaagaatgatgtactaaagtttatactgtccagaaagaccaccaccatcgagcaaatacgcacatatctaagtaaaaacaaaagcaccaaggctaacgacatctctatctccaacataaaagccaccgatccattcaacgcagtgagccacgcattctacgggaagcacccagatctcaacataaacctgtgcgaagaactcatcaaattcgccacgatctacgccgacgacaagaaagagctcaagaaatttgtatcctcaaacttcaacctgacggacgagttcatcaaagaatacttaaacacccccaccaacaaatgggggagacttagtcgcaaattcctctgcggcggagaccaactggaaatgtactacgttgacgacaacggcatactacactccatactaaacatactggaagagaccaacgaaaacttgcaagaaatcctcaacaacgagaaatacgggttcaaccagaaaatcgcagacttcaacaatacactcaccgccgacaagactaccgaagaacaaatcgaagacatcctagactccaccccagctctcatgcgacgaagtataatccaaacactggccgtcgtggacgatgtaataaaggcagccggtaaggcaccccagaaaatcatgatggaggttacccgcacagacggcaagaaagaagaaaccaaatcacgctatgtgcaactcaagaaacaaataaccaatgacaaagtcctcacgtcagatgagaagaaagaactcctaacaaacctggagaataagaaaatccaactaaaaggcaaacacatctacctatatttcatgcaaatgggcatagacttctacaccggcaagatcatggacattaacgacgtgattaacggaaagtacgacatcgaccacataatcccgcaatctatgataaaagacgacagcctcgacaacatggtactggtcagcaaagactacaaccaaaaagtcaagaaagacatctacccgatttgtgacgagatcaggaacaacatgctggacaaatggaaaggatattacgcccgcaagatcatatcagaagaaaaatacaaccggctcaaacgaaccaaggagctgaacgccgatgaaatcaacgccttcataaatcgacaaatcaacgtagtcaactacagcaacatccagatcaaacgaatattcgaaatcaaatacccggagactaagataatcttctcgaaggccagcttcccctccctcctccgcaaagaatacgagatcgcaaagatgcgagacctaaacgacgcgcaccatgctgtggacgcgtatctcaatatcgtgtgcgggaacatcctaaccacgctctacactgacatcttctacatgttcaaagagaagaaggaagaccataaaaacatcagcttcaacatggagaaaaggctcataaactatattgacaaaaacaatcttaaagacaaaataaaaacctcctgtcttaggcacgatgccctcataacctataaacctgactacgacagcggcaaattctataaggaaactatcttcaagaagtccggcgataaagaaaccggcctcattccactccacacgaaagggcccatgtccgataccaaaaagtacggcggttacagccaattatcacagtcctacataattgccgtcgaatacaagctcaagaacaagaccgtcaagaaactgtgccgagtccccacattataccttaaacagtacaaaaatgaccttaacaccatcgccaaaataatgatcgacgacgaaaaagccaccgacatcaaagtcctccgaaaaatctatttaaaccagaagatccgctacaacggatgctactacctcatatacacctccaaagaaaagcaaaacaagtataaaatggcataccagaactaccttgacaacgactatctcatatatttgaacaagtgcctgaagaaaatagacgagctcgatgacggcgagttgacatcacaagagttcatagtgaacaaggacggcgacaagttcttaatcgacaagaaccacaacctcgagatcttcaaatccatcaaagagcaatacaacaagaccatctacgactacaccccctacatcgtacagtcacgagagatgaaggaggaagatttcaacaacctcagccttaagaaacagatcgacaccctcctaaacatgatcaaaatccttagtagatcaaacgaacaagccaaattcgagacagcattcttcgagaacttcaccaaagtcttcctcaaaactatgaccatcaccaacgagaaagtctacatcgtgaacgagagcccatccggcctattcaagggcaaagaggaactcatctga

SEQ ID NO: 6498 - RNA, 4047 nt, synthetic construct
  misc_feature 1..4047: note = Cas9 variant
  source 1..4047: mol_type = other RNA
atgaaaaagttcgaagactactacctcgggctagacctcgggacctcgtcaatcgggtgggctgtcaccaacgagaaatacgacatcctacgttttaacaagaaattcatgtggggtacacacctcttcgacatgggaaacacggccagcgaacgcagaatcttcaggacctcaaggcggagactcaaacggaagaaaaacagaatcgaactcctccaaaccctcttctccgccgaaatgagcaagaaagacttcggcttcttccaacgactcaaagaatcccaatacttcatagaggacaagacattcaaaaacaagaacacactgttcatggacgagaactacacagaccaagactatcatatggaatatcccaccatatatcacttgcgcaaagcgctcatagacaacgaggaatcagccttcgaaataagaaaactgtacctcgcaatcagccatatactctcccacagaggccacttcctgttcgagggcgagctatccgacaacttagatttcgacgacatcttcaacgaatttgtgaagtacctcaacgaagaactgaacatcgactttaaaatcaaatcagatgtatctctgcaagcgataaaagagatcctaacagacaagatgctcaaccgcacaaagaagaaagagaaactttctgaattgctcgaagaggagaagaacaaaatctaccaggaaatctggaaactgcttgtcggcaatgaagccaagatgtcaacaatcttcgacgacaaggagtacgaggaggccaagatagcgttctcgaagggcaactacgacgagaaggaagaggaatacgaatcaattctcggagaaaagatcctattcgtccagaaagccaaggccatctacgactggatgctgctccaaaacatactaaaagaagacaaatacctcagttacagtaaggtgaagctctacaacgagcataagaaagatctcaagatcctcaaagacgtactaaagaacttagacaagaaaatatataaagaaatcttttctgaaaacggcctttatgaagaatacttacgaatagaaaagaagaaaatcggatcaaaagaagagaaaaccaaagacatcttatacaaccgactgaagaaaatattcgaaaaccgagacaacatggctattgaagacatactcaacaaaatcgagctggacagcttcctcccaaaacagaagatcaaagataacggagtaatcccgcgccaagtccaccagaaagaactagaaataatcctgaagaatgccgaaaaatacttcaagtggctcatcgaaaaagacgaaacgggcctctccgtcagcgagaaaatcatgaagatattcaagttcaagataccgtactacgttggccccctaaattccaaaagtccattcgcttggatagaacgaaaggaatacggaaaaattctgccgtggaacttcgaaaatatggtcgacatgagtaagacagcggaaaagttcatcaagaggatgacaaacaaatgcacgtacctccccgaaaaagacgttatccccaaaaactcactactatacaccaagtatatggtgctgaacgaactcaacaacctcaagatccgcggcgagaagataaaggtcgagctaaaacagaagatatacacggaactcttccaaaagaataagaagatcgggatgaaaacgctgatcgagttcctcaagagccaaaacatcgtggtcacaaaagtggagatcactggcatcgacgggacctttaacacaagcctcggcagctatatagacatgaaaaagatcttcggagaagagaaaatagtaaaagacagctacaaaaagatgatcgaggacatcattctgtggataaccctctacggcgaggaaaagaaactgataaaatctaagatagaggagaaatacccagaaaaagtgacaccggaagaaatgaagttaatcctgaaactaaagtaccgggactggagccgtctctccaaggagttcctgacggagatagaaactatggatgaggaaacaggcgagcttataagcataatcgagatgctatggcggaaaaacgaaaacatcatggagcttctgtcttacaaatatgatttcagtaacaggataaaggaatacaacggaatcaacgaaaaggagaaaaacataacatacgaggatctggtcaaagacctgcagataagcccctcggtaaagaaaatgatctggagggcactcgtcatcgtgaaagagatcaagaaagttaccaacaaatccccaaagaaagtattcatagaaatggctcgcgacacgcaaaccgagaagaaacgtaccgagaaaagaaaagacaaactactagaactatacaaaaacatcaaaaacgacgactcgattaaggaattagaaaagaacctcaaagacaaaacgaatgacgacctcaaatctaagaaactatacctatactacctccagctgggccgctgcatgtacagcggggaggtaatacgcctggaggacctaatgaacgacaatctgtacgacatcgaccacatatatccgcagagcaaaatcaaagatgacagcttcgacaacactgtcttagtcaagaaacagatcaacgcagacaaaaccaacgaataccctatcgacaaatccatccaaaacaaatgcaaagccttttggacgagcctcaaagaacggggactcatgtctaacacgaaatacgaacgcctcaccagaaccgaaggtttcagcgacgacgagctcgcagggttcatcagccgccaaatagtcgagacccgacaagcaacaaaagtcctcgccgacctactaaaggtcatatttggcagcgacaccaggattgtatacgtaaaagccggtctgacgtccgacttcagacagaagttcggcatctacaaattccgagaactgaacgattaccaccacgcacatgatgggtacctgaacatagtcacagggaacatctacaacacgctattcacagacaacccgtacaacttcatcaaggacaggaaaaaggacaaccgaacctacaatctaaacaaagtgtttgaacgcgaaaacgacgtctggaaccccgacgtaatgctctccaagatcgagcgctacatctacaagatcagacccctcttcacccgtgcatcctacgagcaaaaaggcggattctcggaccagaatatcagctccgaaaaggataagctcaggccgctcaagagctctggtgtgctgtccaacatcaagtacggtggatacgacaaaataaagaactcctacttctttatagtcgagtacaccgagaaaaagaaacgggtacgatcaatcgaaaccctgccgatctacatcaagaaatcaatcagcacgaaagaagacctcgaaaaatactgcaaagaagaactaaagttgcaagagcccaaagtactggtctcaaaactaaactataaatccttgatctactcaaacggccacgagtactacatcaactccaagacggccgattctatcacgatacagaatggcatccaaataatactaacgaaagaaaactacgaaacttaccgaaaaatctacaaaaacctggaatacctaaagctaatctataaagacgagaagatccgcgaggagaagatcctggaaaagatacccaaaatactgaagaataacaagaacgaccgagacctaagcgaagacgaaatatccgaaaagttctggaaactatacaaagagatctttgaaaagatcaaaatcggcattttctcaaaattcaagagcacactccccatatacatcgaggactgcaagaaactcaaagacttcaccaccctaaacaactatgcaaaatcccgtttcatccaagaaatattgaaatgcctcaacagccaacagggcgaatttgacactaagtacacacacaactacagcaagaaatacaacaccaaactgagcaaatcgaaaatactagaaaacgacttctacatcataaatcagtctccgaccggactattcgagaagaaagtgttccttgacaaatga

SEQ ID NO: 6499 - RNA, 4047 nt, synthetic construct
  misc_feature 1..4047: note = Cas9 variant
  source 1..4047: mol_type = other RNA
atgggtgaggacgggaaaccccttcgagtcaaaggaaaaaccgccataggcgcccgcctatttcaggaagggaaccccgcggctgacagacgcatgtttcgaaccacacgacgacgtctcaaccgccgtaagtggaggctaaaactactggacgaaatattcgatccctacatcacaccagtagacagcaccttcttcgcacgcctcaaacaatcgaatctatcgccaaaagacagccgaaaagagttcaaaggctcaatgctgttccccgacctaactgataaacagtaccacctcgactaccctaccatctaccacctcagacacgccctgatgacacaagacaaacaattcgatatacgaatggtatacctcgctattcaccacatcgtcaaataccgaggaaacttcttgaactctaccccagtggacagcttcaaagcatcaaaagtcaacttcgatgaccagttcaagaaacttaatgaactctacaccgccatcaacccagaggaatccttccaaattaacttagccaatagcgagaaaataggccaacaattcctcgacccctcaatcaggaaattcgacaaaaagaaacagatcccgaaaatcgtccctgtcactatggacgacaaagccgtagacaaactcaacggcaaaatcgccagcgagataatcaacgccatcctaggctacaaatcgaaactggacgttgccgtgcaatgcgaccccgaggacagcaacccctgggctgtcaaattcgatgacgaggatatcgatgccaaacttcagaaaatattacccgagatggacgaaaaccagcaatccattataggaatcattcaggacctctactcgcaagtaacattgaatcagatagtccccaacggcatgtccctgtccgaatcaatgatcaaaaagtacaatgaccaccatgaccacctaaaactctacaagaaactcattgggcaaatcagcgactctaaaaagaaaactgcattaaagaaagcatacgatcagtacgtcggcaacgatggcaaagtgatcgaacaggacgacttctactcatccgtcaaaaagaacttagacgacagtgaactcagcaaacaaatcatggacctcatagacgccgacaagttcatgcctaaacaacgtacctcccaaaatggcgtgatcccccaccaactccaccagcgcgagctagatgaaataatagagcaccaatccaaatactacccctggctcgccgagtccaaccccaacaaacacgacttacacctcgcaaaatacaaaatagaagaactcgttgcattccgcattccttactacgtcggtccaatgatcaccccagaagaccagaaaaagtcaggagccgccgtgtttagctggatgaaacgaaaagaaccgggacaaataaccccctggaacttcgacgagaaagtagaccggatggaatccgcaaacaaattcataaagcggatgacaaccaaagacacctatctcataggagaggacgtgctaccagacgaaagcctcctgtacgaaaaattcaaggtcctgaatgagctcaacatggtgcgagtcaacggcgattccttaaaagtggcagataagcaagccatataccaagacctcttcgaaaactataaacacataagcgtcaaaaagctccagaactacataaagggcaaaacgggactacctaacaacccggagataagcggcctcagcgaccccgaccaattcaacaacagcctaggcacgtacaacgacttcaagaaactattcggagataaagtagacgaccccgacctgcaaaatgacttcgagaaaatcgtggaatggtccacagtcttcgaggacaagaaaatcctcagggccaagctcaacgagatcacctggctaacggacaaacaaaaagacgacctagaatccagccgttaccagggctggggccgtctcagcaagaaactgctaaccggcatcgtaaacgaccagggcgaaagaataatagacgaactatggaacaccaacaagaacttcatgcaaatccaaagcgatgatgacttcgcgaaacgaatacacgaagctaacgcagaccaaatgaaaagcacaaacatggaagatgtcctcgccgacgcttacacatcaccccaaaacaagaaagcaatcagacaagtggtcaaagtcgtcgacgacatccaaaaagcaatgggtggggttgcacccaaattcatatccatcgagttcacacgatcagaggacagaaacccccgacgcaccataagccgacaacgacaactcgaaaacacactgaaggacacagccaagtctctcgtcaagagcatgaacccaaacatcttatcagaactcgacaacgcgagtaggtccaagaaaggcctcaccgaccgcctatacctctactttacacaactcggaaaagacatgtataccggggaaccgatcaacatagacgagataagcaactacgacatagaccacatactcccacaggccttcatcaaagacgattcactatccaaccgagtcctagtatcgaaagcggtaaataacggaaaatcagccaatgtcccactcaaactcttcggggccaaaatgggacacttctggaagcaactggccgaagcaggactaattaacaaacacaagctcaagaacctgcaaactaatccagacacaatatcaaaatttgcaatgcacgggttcattcgccgccaattagttgagacatcacaggtgatcaaactggtcgcgaacatcttgggggacaaataccgcaacgacgacacaaaaattatagagatcacagctcggatgaatcaccaaatgcgagatgaatttggattcatcaaaaaccgcgaaattaacgattaccaccacgcgttcgacgcatacttaacagccttcctcggacgatacctctaccacaggtacataaaactacgaccgtactttgtctacggagacttcaagaaattccgagaagacaaagttacaatgagaaatttcaactttctccacgacctcaccgacgacacacaggcgagaatcgccgacacggaaaccggggaagtgatctgggaccgagagacatcaataaaacaactacgggacgtataccattacaaattcatgctaatatcccaagaggtctacaccctgagaggtgccatgttcaaccaaaccatatacccagcgagccaggccggacgaaagaaactcattccgatgaaagcggacaaaccggtcgacgtctacggagggtattccggcagcacagacgcttacatggcaatagtccgcatccacgacaagaaaggagataaatacaaggtcgtcggagtccccatgagagcgctgaaccgccttaacacggcgaaaaacgtatcagacgcaaaatacgaccaggagctaaaggaagtacttacgccccagtttaccaaatccaaaaagaaccgaaaaacaggcgaaatcacccaaacggtagaagacttcgaggtagtactgggcaaagtaatgtatagacaactcgtaatcgatggagacaagaaattcatgctaggaagctccacataccagtataacgcaaaacaactcgtgctctcggacgagtccatcaagaccctggcatccgaaggcaaactaaacgaagcacaagaaagcgcagcctacgataaagtttatgatgaaatcctagacaaagtcaacaaatacttcgcactctacgatacaaacaaattccgtcaaaaactctccctcggaaaagacaaattcgtcggactacccaaccacaacgtgttcgacggctcaaagaaaatatcttctgggaaacgggagatactgaacgaaatcctgaatggactccacgcaaacgccaccctcggcaccctaagcgatatcggcttttccaccccattcggcaagatgcaacagcctaggggtattggactcagcagcaacaccagcatagaatacgagagcttcaccggcctattcaaaagaaccatattcctcaaagacctttga

SEQ ID NO: 6500 - RNA, 4047 nt, synthetic construct
  misc_feature 1..4047: note = Cas9 variant
  source 1..4047: mol_type = other RNA
atgaagaaaccctacaccatcgccctcgacataggcaccaacagcgtcggctgggtggtggtcaccgacgactaccgagtacccactaagaaaatgaaagtactcgggaacaccgaacggaaaaccatcaaaaagaacctgataggagccctactcttcgactcaggggatacagccgagggcacccgactaaagcgcaccgcgcgccctcgctacacccgcagaaagaacagacttaggtttctaaaggagatttttacagaagagatggccaaggtggacgacggcttcttccagcggctagaggacagcttctacgtactcgaagacaaagaaggcaataaacaccccatattcgccaacctggcggacgaagtcgcgtaccataaaaagtacccaacgatttaccatctgcgtaaggagctagtcgacaacccccaaaaggcagaccttcgcctcatctatctcgcggtagcgcacataataaaatttcgaggccacttccttattgagggaacactcagctcgaagaacaataatctccaaaaatcattcgaccacctagtggacacatacaacctactctttgaggaacaaagattattaacagaagggataaacgcaaaagagctcctttcagccgctttgtcgaaaagcaaacgcctagagaacctaatatccctcattcccggacagaaaaagaccggaatctttggtaacatcatcgcgctgagtctaggacttaccccaaacttcaaggcaaactttggcctcagcaaagatgtcaaactgcagctcgctaaggacacctacgctgacgatcttgactctctactagcccaaatcggcgaccaatacgcagacctatttctagcagccaaaaacctctcagacgccatcctcctcagtgacatcctcacggagtcagacgaaataacccgtgccccgctttccgctagcatggtcaagcgctatcgggaacatcacaaggacctcgtcacgctcaagacactcatcaaagaccaacttccagaaaaataccaagaaatcttcctcgacaagactaaaaacggttacgctggctacatcgaagggcaagtatcacaggaagagttctataaatacctaaagccaatcctggcgagactcgacgggagcgaaccactgctactgaaaatcgatagagaggacttcctccgaaaacagcgcaccttcgataacgggtcaatcccccaccagatccacctcgaagaactacatgcgatccttagaaggcaagaagtcttctatccatttctgaaagacaacagaaagaaaatcgaatctctgctaacattccgaatcccctactatgtaggccccctagcacggggacacagccgattcgcatgggtcaaacgcaaattcgacggagctatccgcccttggaacttcgaagaaatcgtcgacgaagaggcctcggcccaaatcttcatcgagaaaatgacaaagaacgacctttacctccccaacgaaaaggtccttccgaaacacagcctactctacgagacattcactgtctacaacgagctgaccaaggtaaaatatgcaaccgagggaatgacgagaccgcaattcctatcagccgaccagaaacaggccatcgtcgatctgctgtttaaaaccaacaggaaagtcaccgtcaaacagcttaaggaaaattacttcaagaaaatagagtgctgggactcagtcgaaattaccggagtcgaggacagtttcaacgcttccctaggcacataccatgacttactcaaaatcattcaggacaaagacttcttagacaaccctgataaccagaagatcatcgaagacatcatcctcacactcacgcttttcgaagacaagaaaatgatcagcaaaagactggaccaatacgcgcacctcttcgacaaagtagtgctaaacaaactagaacgccaccactacaccggatggggccgactatcaggcaaactgataaacggaatccgagacaaacagagcgggaaaactatcctggactttctaaaagccgacggttttgcgaatagaaacttcatgcaactaatacacgactcggaactatccttcatcgacgagatagccaaagctcaagtaataggcaagaccgagtactcaaaagacctcgttggcaacctagcggggagccctgcgatcaaaaaggggatttcgcaaaccataaaaatagtcgacgaactggtcaaaatcatgggctacctcccgcagcagatagtcatcgaaatggcccgcgagaaccagacgaccgcccagggaatcaaaaacgcccgacaacggatgcgtaagctggaagaaaccgctaagaaactaggatctaacatcctcaaagaacatcccgtagacaattcccagctacagaacgacaaaaggtacctttactaccttcaaaacggaaaagacatgtataccggcgacgacctcgacatagactacttatcatcttacgacattgaccacataatcccccagagcttcatcaaaaacaacagcatagacaataaggtcttaaccagccaaggagccaacagaggaaaactagacaacgtcccaagcgaagccatagtccgcaaaatgaaaggatactggcaatcgctgctacgcgccggagccatttccaagcaaaagttcgacaacctgaccaaagcagaaagaggcggccttacccaagtagataaggctggttttattcagcttcagctagtcgaaacccgacaaataaccaagcacgtcgcacagatcctcgattcacgcttcaacaccgagttcgacgaccacaacaagcggatcagaaaagtgcacatcattactctcaagagcaaacttgtatcagacttccgtaaagaatttgggctgtacaaaatccgcgacatcaaccactaccatcacgcacacgacgcctacctcaacgcagtcgtagcaaaagccatccttggaaaatacccccaactagcgcccgagttcgtatacggggattaccctaaatacaactctttcaaggagcggcagaaagcgacacaaaagacactcttctacagcaatatcctaaaattcttcaaagaccaggagtccctccacgtgaactcagacggcgaagaaatctggaatgccaacaagcacctccctatcatcaagaacgtcctctcgatcccccaagtaaacatcgtaaagaagacggaggtccagacgggcggcttctacaaagagtcgatcctctcgaaaggcaacagtgataagctgatcccgagaaagaacaattgggacacacgtaaatatggaggcttcgactcccccaccgtagcgtactccgtactggtaatagcaaaaatggaaaaaggaaaggcgaaggtactaaagccagttaaggaaatggtaggaatcacaattatggaacgtatagccttcgaggaaaaccccgtcgtgttcctcgaagctaaaggctaccgggagatacaagaacacctgataataaaactccccaaatacagcctattcgagctggaaaacggccgacgtcgtctcctggcgagtgcctccgaactccaaaaaggcaacgaactcttcctgcccgtcgactacatgaccttcctatacctcgcagcacactaccacgaacttacgggcagctcagaagacgtcctccgcaaaaagtacttcgtagaacgccatctccactacttcgacgacatcatacagatgatcaacgacttcgcagagcgccacatactcgcgagttcaaacctggagaagatcaaccacacctaccacaacaacagcgaccttcccgtcaacgagcgcgccgaaaacataataaatgtcttcaccttcgtcgcactcggtgcgcccgcggccttcaaattctttgacgccaccatcgatcggaaacggtacacctccacgaaggaggtcctaaacgccaccctgatccaccagagcgtcactggcctctacgaaacgcgtatcgacctcagtcagctgggcgagaattga

SEQ ID NO: 6501 - RNA, 4050 nt, synthetic construct
  misc_feature 1..4050: note = Cas9 variant
  source 1..4050: mol_type = other RNA
atgaaacaaaaattctacgtaggattggacatgggcaccgcgagtgtgggctgggccgtaacagacgacaagtacaatataatcaaacgacacggcaaagctctttggggtgtccgactcttcaagaccgccaacaccgcagaggaaaggcgtatctttagagccgcacgccgcaggacgcaaagacgcaaacagaggatggaactgctacaggagatatttggcgacgaaataagcaaaacggatatcggattctatcaacgaatgaaagaaagcaaatactggtttgaggacaaaagggacataaacggaaaacaaccggagctcccctacgcgcttttcgtcgacgacggattcacggacaaggactaccacgaacaatttccaacaatcttccacctcagaaacgtcctcgtcaacgaatggactcaaaagtatgacatcagactggtgtacctagctatccaccatataataaagcaccgaggccacttcctgtttgaggggaaaaagatgagcgaggtaacggacttcggcagcgccttcgaggctttctgtaaggtcgcatcagacaacgacatcgaaataaccgtcgacgaagaaaaactaaaagacatagaagacctactcaagtcacgacaaaagagcaaaaccgcaaagaagcaagaactgggcaaaataatcgcgggggcagacaagcagaaaaaggccctagcagccctagttacgggatgcatggtcaaactgagcgaaatattcgcggacaagagcctagacgatggcgagcgaaacaaaattagcttcgcggacagcaactacgacgagtacatagcaaacgttgaagaaaccctggccgagcgattcctcctaatagcggcaggcaaagcgctgtacgactgggcagtcctcagcgacatcctagaagggtccacatacataagcgaggccaaagtgaagatatacaaaaagcatggcgacgacctccgaaaacttaaggggctactgaagacaagacccgacgaatacaagctcatcttcggcctccccgaaaagcaagcaaactacagcgcatacatcggcatggtaaagaaaaacggaaagaaagtccccatagacaagaaatgcacaaaagctgacttctacagcttcctgaaaaagactttaaacaaaattaatttcgaagatgaaaaagagcgcgagatcgcggaatccattataaacgagatcgaaaacgagacattcctcccgaagcaggtaataagcgacaacggtgtgataccgtatcagctgcacgaagcggagctcgaccgaatactcaagaacgccgcattatactacccgttcctaagcgaaaaggacgacgaggggtacaccaacatggacaagataaaggcaatattcaagttccggataccctactacgtcggcccgcttaacacctaccactcagacaagggtgggaacagctgggcagtacgaaagcaggacggaaaaatatacccctggaacttcgagagcaaaatagacgcaggagaatccgccaggaaattcatagggcgaatgacaaacaaatgcacttatctcatcgggaaggacgtcctcccgaaagagagccttctgtactcgaagttcatggtcctcaacgaactgaataacctcaggatagatggggaaaaagtgagtgttgagattaagcaggcagtctacgagaacgtcttcaagaaatatcagcgggtcacagggaaaaaggtaaaagacttcctgattagaagcggaatcatcggccgcgagcaggaactcagcggatttgaccagaacttcaaaagcagcctcaaggcctaccacgacatcaaacagatcgctggagatatcaacctgagccagaaccagaaggaggacatcatcaaagaaataacggtatttgcagactcacagaaaatgttaaagaagcgcctaaaaataaaatacccagaactatcggacaagcaagtaacaaagttggccgccaagaaatataccggatggggacggctcagcagggagttcctagaagaagtcgagagcgtgaacaaggaaacaggggaggtgctcaacatcataagcgccctgtgggaaacaaacgagaacctgatgcaacttctttccaacaaatacgactacctctccgagatcaaacgactcaacgacgaagctgaggacaagagcgaggtcgttacatacgacgacgtccagaagctatacgtgagcccggcggtgaagaggcctgtctggcaaaccctcaagatcgtcgaagagatcagtaaaataatgggctcgaagccagaaaggatcttcgtagaaatggcccgggagccggggcaaaagggcgacgtaaaggtctcgagaaagagccgactgctggaaaaatacaagtactgcaagaaagaagcgccagaaatctacgaaaacctggtcaaagaagacgacaacaaactacgaagtgacaagttattcctctactacactcaaatgggccgctgcatgtactctaatgaagtgatcgacatcgaagacctcttcaccaaccgctacgacatagaccacatatacccccaaagtaaggtcatggacgactcactagacaaccgggtgctggtcaaacgcgagctcaatagcaacaagaccgacgtcttccccgtgcccaaggaatacatggacaaagcgaaaacactatgggacatgctaaagaagaaagacctgatctccaaagaaaaatatcacagactcacaaggagagacggatttagcgaaaatgaactaagcggcttcatagccagacaactggttgaaacccgccagagtacaaaggccgtcacgcagctcctcacgaaggcctacccggaatcagaaatcgtctatgccaaagctaacgccgtgagcgagtttagacacaagttcggcttcacgaaggtgcgctccatcaacgattaccatcacgcaaaggacgcctacttaaacatagttgtgggcaacacgtactacgtcaaattcacaaaagacgccgcatggttcatccgaaacaaccccggacgcacctacaacctaaagaagatgttcgagcaaggcacagtgagccgagggggcgagaccgcctgggtaagcggcgaagacgggacaatattcaccgtaaaaagggttatggggaaaaataacatcctcttcacaagaaaagcctacgaagtgcgagggggactcttcgaccagcagattatgaaaaagggaaagggtcagatacccgtaaagaacaacagcgaagacgaccgattatgcgcaaccgaaaaatacggagcatacaacaaggcatcgggcgcctacttcatgctggtcgaatcggaagacaaaaagggcaacaaaatacgaactctagagtttgtacccgtataccttgcgaaagaactagaaaagagcgaggacgcggcgatccgctactgcgtggaaaaattagaactcaaaaatcccgacgtgagagtgcgaaaaatcaaaatggactcactattcaacgtcgacggattcagaatgcacctaagcggacgaacgggcaagcaactcatcttcaagtgcgccgagcagctagttctcgacgaagaaagccaaaagattctgaagaaaacggcaaaagtctttgcagactacaaggaaaataaaaatataaagataagcgacaagatcgaactcaccgacgaaatgctgataaagctgtacgagctgttctacaagaagctaaaagacaccgtatataacataagactaagcacacaggtgaaaacactggagtccggcaaagaaaaattcgagaaactatcgctactagataagtgcctcgtaatcgaggagattctacacctcttccaatgtcaaagcgtggccgcaaacctgtcgtccatcggcggagccgcaaccgcgggtatactggtccttaacaacgagatcagccgatgcggcaaagtggaaatcatcaaccaatccatcacaggattctacgaacaagtcatcgacctcaagaacatctga

SEQ ID NO: 6502 - RNA, 4050 nt, synthetic construct
  misc_feature 1..4050: note = Cas9 variant
  source 1..4050: mol_type = other RNA
atgcagaagtactatctggggctcgacatcggcacaaattcagtcggatgggcagtcactgacgagaactacaacctctgtaagttcggcgggaaacgcatgtggggcataaggcttttcgacggcgctcagacagccgaggaacggagaatgaaccggagtaaccgccgccgactatccagacaaaaacagcgaatagacctgctccaagaactctttgctaaagaaatagcaaaagtggatcctacctttttcattcggctgaatgaaagccggctatacatggaggacaagtcaaccgggaccaaattcccactcttcgcagacccgggctatacggacaaagaatactacaaggagtacccgaccatctaccaccttagacaagaactaatcaaaaaccccgagtctcacgacatacggctggtctacctagcatgccaccacatcctgaaaaaccgcggccacttcctgatcaacggctccttcagcgacctcaaaaacctgtcattcgtctgccgcgaaatgctagacgcattcaacgagctttcaaaataccagctcatgatatcggacatagacgccctcgagaaaatcctcagcgaccgcaaacagcagaaaagcgccaaggtgaaagaactcgtacaaatatttgaatgcgtgccccgggaagacaaatccgacgcaaaaatctgcaaagagatcctgtcaaacctatgcaagttcctagtcggggcgaaagggaacataacgagactcttcgacaccgacttcgacgaaatggaaacgagctcattctcattcggcgacagcaagtacgaagacagccttctaccgagcctcgaggagaactatccagactacgccaacgtcatacagaaaatcaaagctatgtacgactggtccgtcctggtcgaaatcatggcaggcgaaaactacctctcattcgccaaggtgaacgcgtacaagaaacataaagaaaacctctccatcctcaaatccctcatgaagaaatattgcacgcccgatgtctaccaacgcttcttttacgaaacagacgagaaaagctcatacggaaactacatcggagccatacacaacaatggccactcgcacacgatgaagaaatgcgacgaagaaacattctataaatccctatcaaaaatcctcgacaaattagtcgtgcagaaaacagaccaagacaccctggagatactcaagaaagaagccaaaaaccaaacgctcctacccctagcaagaaccaaagcaaacggcgtcatccccaaccaaatccacattcaagaactacgcgcaatcctcgacaatgcgaaaacgtacctcagcttcctaaacgaagcagacgaatacggaacaatcgcagagaaaataattagaatcgccaaatttaaaatcccatactacgccggcccgcttagtacccgccacaaagagcaaggggccaacacctggatcgtacgaaaacaagaaggaagaatctacccatggaactttgaagaaatggtcgacctagagcggagtaataacgagttcatacgccgcatgacgaacaagtgcacatacctcataggagaagacgtactaccgaaaaacagcctcctctactccaagtttatggtgctgaacgaactgaacaacctaaaaataaggggacacaagatcagcgttgaactcaagcaagaactatacaaagagctattctgcaagaaggccaaagtaaccgggaaagccctactcgtatacctcaagaagaaagatgccgagcttacactagaagacataagtgggtttgacgcggacttcaaaagcagcctatctatctacatagactttaaaaaccacatactacgcgaacagatagatgacggcaaataccaatcaatcgtagaaaacataatcaagtggaagactatcttcgacgtcgacagcaagatgatagaaaagctcattgcgcgcgaataccccaacatgttctcatccgaacaaatcaagaaaatctgtcgcctcaaatgtcggggatggggaaacttcagctcccgtttcctaaacgggatccaaggagaaaacaccgagaccaaagagtgcttcacaattatcgaggcactctggaaaaccaactataacctcatgcagcttctctccaaacaattcacattcaaagacgccatagactgtataaacgccgacaaagtaggcaaaatcgataaagtgacctacgaaaacacggtcaaagacctagtagtatcgcccgcgaacaagcgagcgatatggcagacagtgcaaatcactgaagagatcaagaaagtcatgaaatgcgagccagagaaaatatttgtcgaaatggcaagaggcggggaaaaggagaagaaacgcactatctcacggaaagagcgtttactcaagttgtacatggactataaagacgaaaaccgggactggatcaaggaaatcgagtcccgagacgagcaagacttcacaaacagaaagctctacctatactacacacaaataggacgatgcatgtacagtggcgaggagattagcctggaagagttaatgcaaaagaacagcaaatgggacaaagaccacatatacccccaaagcaaaatcaaggacgacagtctagacaacctcgtgctagcaagaaaagacatcaacaacaataaatccaataagctcctgcctacgggcatccaggacaagatgaagaaatactggaagatgctcctcaagtatggcttcatcagcaaaaagaaatacgaccgccttatgcgaacggaagacttcagcgatgaggaactcagcggtttcatcgcaagacagattgtagaaacgcgtcaaagcagtaaagccgtcgccgaactcttagagcacctaaacgagcatacggagatcgtatacgtcaaagccgagctggtcagcgacttcagacatgacaacaacatgctcaaaagccgaagaataaatgactaccaccacgccaaagatgccttcctcaacatcgtcgttggcaacgtctacaacgcaaagttcaccgcgaacccccgcaactggatcaaaaagaaccgaaacactaactacagcatccgccgggtcttcgactatacagtcaagcgtggcagcaccatcgtctggcagggagtaaaagacggagggcacagcatcgacggcatcaaaaagaccatggcccgaaacgacatactctacaccgaacgaacctactgcgaacaaggagaactcttcaacgcgacactaataaagaaagggaaccccaacgcgataggactaaagaaagggctagacccgatgaaatacgggggatactcctcaccgaaaacatccgcgttcgcattcatcgagtttgacggaaagaaaggcagacaaaaccacctggtagaaatcccagtctacatcgccaacatagcagcacgacaacccgaatacatcaaaaaccatctcgaggagaagaaaggctatcaaaacgtaatcgtcaagaaatatccgatacagaaaaacgccctcatcaaactcgacggatatccagcccggctccgaggagcaaacgagaaatcaatcacgctcaaaaacgccgtccaactcgtcctgaaaccggaatatcacgagacgatccggaatgtagaaaaatacctcgagtacatcgataaagacgaatcagtcagcaaagcggccagattctcccacaccgagctcgacaagctctacgacgagctatgcttcaaagcggagaacagtatttacaagaaacgaccggccaaccagagcgccaccttaaagaacggccaaaagacattccttgccatcacaaacctgaaagaaaaggcacaggtcattaacaacataatcacaatgttcagatgcgacgcgacgaccacaacaaacctcaagacaatcggaggctcagcaaacgcaggcggaatgcaagtaaacaagaacaccctaacatcacagaaggtcgttctcgtccaccaaagcattactggactattcggcaccgaggaggaattactatga

SEQ ID NO: 6503 - RNA, 4053 nt, synthetic construct
  misc_feature 1..4053: note = Cas9 variant
  source 1..4053: mol_type = other RNA
atgaagaagccatactccatagggttagatataggtacaaactcggtcggatgggcagtcgtaaccgacgactacaaggttcccgcgaagaaaatgaccgttctgggcaacacagacaagtcgcatatcaagaaaaacctgctaggcgcgctcctgttcgacagtggcaacaccgcagcagaccgacgcctgaaacgcacagcccgccgccggtacacccgcagacgaaaccgtatcctctacctccaagagatcttcgcagaggagatgtccaaggtagacgacagcttctttcaccggctcgaagacagctttctcgtcaccgaggacaagcgaggcgaaagacacccgatttttggcaacctagaagaagaagtcaaataccatgagaacttccccacaatctaccacctccgccaataccttgccgacaatcccgaaaaggtcgacctccgcctcgtatacctcgcactagcccatataataaagttccgcgggcacttcctcatcgaaggcaaattcgatacacgcaacaacgacgtgcagcgactcttccaagagttcttagcagtatacgacaacaccttcgaaaattccagcctacaagagcagaacgtgcaagtagaagaaatactgacagacaaaatctccaaatccgccaagaaagatcgggtactaaaactattccccaacgaaaaatcaaacggcagattcgctgagttcctcaaactgattgtaggaaaccaggccgacttcaagaaacatttcgaacttgaagagaaaacgcccttacaatttagcaaagacacctacgaagaagaactcgaagtcctcctcgcgcaaattggggacaactacgccgaactcttcctatccgcaaagaaattatacgactcgatcctgctctcggggatcctcacggtcactgacgtctcaactaaagccccgctcagcgccagcatgatccaaagatacaacgagcaccagatggacctcgctcaactcaaacaattcatccgccaaaagctcagcgataaatacaacgaggtcttctccgacgtctcaaaagacggctatgccggctacatcgacggcaagacaaaccaagaggctttttataaatacttaaagggcttgcttaacaagatcgaagggtcaggttacttccttgacaaaatcgaaagggaagacttcctgcggaaacagcgaacttttgacaacggcagcatcccgcaccaaatacatcttcaagaaatgcgagctatcataagacgacaagccgagttctacccattcctcgccgacaaccaagaccgcatcgaaaagatcctcacgtttagaatcccctattatgtcggccccctcgcccgaggcaaaagcgattttgcttggctcagccgaaaatccgccgacaaaataacgccctggaacttcgacgaaatagtagataaagagtcaagcgccgaagccttcataaaccgaatgaccaactatgacctctatctacctaaccaaaaagtcctcccaaaacattcgctcctctacgaaaagttcaccgtgtacaacgaacttacaaaagttaaatacaaaaccgagcaagggaaaacagctttcttcgacgccaatatgaagcaagaaatattcgacggtgtctttaaagtttaccggaaagtcaccaaagacaaactcatggatttcctcgaaaaagagttcgacgagttccgaatcgtcgatctaacagggctggataaagaaaacaaggctttcaatgcgtcctatggcacctaccacgacctccgcaaaatactcgataaggactttctggataacagcaaaaacgaaaagatcctagaagatatcgtgcttacccttacgctctttgaagaccgagaaatgattcgcaaaagactcgaaaactactcagacctcttgaccaaagaacaagtcaaaaagctggaacgacgccactacaccggatggggacgacttagcgcagagctaatacacggtatacgtaacaaagagagcagaaaaaccatcctagactacctcatagacgacggcaactcgaatcgcaacttcatgcaattgattaacgacgacgctctttcgttcaaagaggaaatagccaaagcccaggtcatcggcgaaaccgacaatctcaaccaagtcgtgtccgacatcgcggggtcgcccgccatcaaaaagggcatcctccagtccctcaaaatcgtcgacgagctagtcaagatcatgggacaccagccggaaaacatcgtcgtagaaatggcccgcgaaaaccaattcacaaaccaaggtcgacgcaactcccagcagcgtctcaagggccttaccgactctataaaagagttcggcagccaaatcctaaaggaacaccccgtcgaaaactcccaactccagaatgaccggcttttcctatactatctacaaaacggcagagatatgtacaccggtgaagaattagacatagactatctctcccagtacgacatcgaccacatcatcccccaggccttcataaaagacaacagcatagacaaccgagtgctcacctcatcaaaagagaaccgcggcaaaagcgatgatgtacccagcgaggacgtagtcaacaggatgagacccttctggaacaagctcctaagctccggacttatcagccaacgaaaatacaacaacctcacaaagaaagaacttacccccgatgacaaagccggattcataaaaagacaactcgtcgaaacgcgacaaatcaccaagcacgtcgcacgaatgttagacgagcgattcaacaaagagttcgacgacaacaacaaaaggatccgcagagtaaaaatcgtaaccctgaaatcaaacctcgtgagctcattccgaaaagagttcgaactgtacaaggtccgcgaaataaacgattaccaccatgcgcacgacgcctacctcaacgcagtagtagtcaaagccctgctcgtaaagtaccccaagctagaacccgagttcgtttacggcgaatatccgaagtataactcataccgcgaacgcaagaccgccacccagaaaatgttcttctactcaaatataatgaacatgttcaaatcaaaagtcaaattagccgatgaccaaatcgtcgaacgacccatgatagaagtcaacgatgaaacaggggaaatcgcatgggacaaaaccaaacacatcacaactgtaaagaaagtgctctcatacccccaagtcaacatagtaaagaaagtagaagaacaaacgatcggccaaaacggcggcctgttcgacgataatcccaaaagcccactcgaggtcatcccgtccaaacttgtgccactaaagaaagcactgaaccccgagaaatacggtgggtaccaaaaaccgaccacagcgtacccgatactcctaatcgtagatacgaaacaacttatccccatcagcgtaatggacaagaaacgtttcgagcaaaatccagtgaaattcctaaaagataagggataccaacaaatcgagaaaaacaactttgtcaaacttccgaaatacacgctcgtcgacataggaaacggaataaaacggctgtgggcaagttcgaaagaagtacacaagggcaatcagctggttgtctctaagaaaagccaagacctactataccacgcccaccacctagacaacgactactccaacgaatacgtcaaaaatcactaccaacaattcgacatactcttcaacgaaattacgagcttcagcaagaagtgtaagctaggcaaagaacatatccagaaaattgaagaagcctactcaaaggagagagacagcgcatccatagaggaactagccgacggattcatcaaactcctcggattcacacaactcggtgcaacatcccctttcagcttcctcgggatcaaactcaaccaaaaacagtacacaggcaaaaaggattatctattgccctgcatggaggccaccttaatacaccaaagcataaccggcctatacgaaactcgaatagacttgagcaagctaggaggagactga

SEQ ID NO: 6504 - RNA, 4053 nt, synthetic construct
  misc_feature 1..4053: note = Cas9 variant
  source 1..4053: mol_type = other RNA
atgggcaagaactactatctcggactggacatgggcacctcgtctgtgggctgggccgtcacagatgagaagtaccgcatcctccgggccaagggaaaggacctctggggcgttcgacttttcagcgaagccaagactgcagcggaacgccgcacgcatcgaactagcagacggcgcctcgatagggaaaaagcaagaatcgcgtgcctcaaggaaatgttcgcagaggagataaacaagattgaccccggattctaccaacgactgaacgactccaaatacttcctggaagacaaaaaagagcaccagccctatgccattttcgccgacacgggctacaccgacaaggaatactatgacgaataccccacgatcttccacctccgaaaagcgctgctgaatatagagaatgacaaaaaaaaatacgatgtacgcctggtctacctcgccattctaaacatgttcaaacacaggggccacttcttgaacgcaaacttggacgacaaaagtggcggcaacctcaaggagtatatagagatgctccaccagtcaatggtgaacatcctgaacataaacctaaaaaacgtcgaaatcgagaaaatagagaagatcctcaaaagcacccaatactccaactcagagcggctcgaaaacctcctagaactgtacgaactatccaaaaacaaaaacaaaatcgaaacagagattttcaagttcatctgcggcctcaagggaacaatcagcaaaatatacgtcgaagacaagttcgaggacgaattcgccaagatgacgctcagtttcagggactccaacttcgacgaaaaaatcatcgaaattgaggacaacctcgacgatgacaaatacgacatgttcctgctaataaaacaaatacacgattggagtgtccttgcgaatataatgaatggggaagagtacctatccgtagcgcgcgtgaagctatacgacaaacacaaaaaagacctagaagtcctcaaaaagtactacaaacaaaacagcatggaagaatacaacaaaatgttccgccaaatgaacgacgggaattactcagcgtacgtcggatccgtcatctacaaagacaacagcgttcggcgtgggtgcaaatccaaaaaagaggacttctacaaaaacatccttaataccataaagagttgggaggactgcgaggccaaagagtacatcacaagcgaaatagacaaaggaaatttccttcccaagcagataaccgctagcaacggcgtgatccccaaccaggtccacaagaaagaactaaagaaaatcctcaaaaacgccagcgagtacctcaacttcctcaacgagaaggatgaaagtggctacacaatctccgaaaaaatcgtgaaattattcgaatttcagatcccctattatgtcgggcccatagcctacaacatcggaaacgacgaatcaaaacaccggcacaacatgtggtccgtccgcaaagagaaaggcccaatctacccatggaactttgaacagaagatcgacatcaagaaaagctcggagaaatttatcaggaacctaattaaccattgcacatacctgaacgacgaggaagtcctgcccaaaaacagcctcctgtacgaaaaattcatggtgctcaatgagctaaacaagctcaaaatcaatggagaaaagatctcagtagagctgaagcaaaacatcttcaacgacctgttcaagaaaggaaaaaaggtcacgaaaaagggcctgatcaaatacctcaaggaacagggcgaaatcgacaattgcgaagaagtggagatcagcgggatagatggcgactttacaaacaagctaagcaactataaaaaatttgcagacatctttggcgtccagtccctcacttacgaacaaaccgacatcgcagaaaacataatccgatatagcaccatctacggggactctagaaaatttcttgaggaaagaatacgagaagagtacagcaacgtgctggacgaaaaacaaataaaacgaatactcggaatgaagtttaaagactggggcagactatcaaaagagctgctagagctatccggagtggacaaagagacgggcgaaatcgcatcggtaatctcgcgcatgtggaacgataactacaatttgatggagctcattgcaaccgagcgattcagctacgcatatgagatagagcaaagatcgaaaaagttagagaaaacgatcagcacaattgagtacgaagatctagacgagttatacatgagcaccccggtaaagagaatggtatggcaaaccatcctagtgctcaaagaactggaggaggtgctcggatgccccccaaaacgcatcttcgtcgaaatggcacgagacgtcaatgcgccaaaggacagaaaagatagtagaaaaaagaaactactggagctctacaaaaactgcaaaaaggaggaaggtgactggagcaaggagttgaacgctcgagaggaatcggaattcaagtcgaagaaactctacctatactatatgcagaaaggccggtgtatgtattcggggaaaccgatcgacctcaaaaacctactaaacgacaacctgtacgacatagaccacatctaccccaggcacttcgtcaaagacgactccatagagaacaacctagtactagtcgagaagaacttcaacgctcacaagtccgacaactacccaatcgaaaacgagatccgtcaaaaaatgcacagcatgtggaaaatgctacgagacggcaacttcataacagaagagaaatactcgcgcctcataagaaaagaagagtttacggacgacgaaaaagcgaaattcatcagccggcagatcgtagaaacgcgccaggggacaaaggtaatcaccgatctcttcgaacagaccttccccgagtcagacatagtgtacgtcaaagccggcaacgtaagcgaattccgacacaaattcaaactaataaagtgccggaacgtcaatgacttccaccacgccaacgacgcttacttaaacatcgtggtcggaaacgtttactacaccaaattcacaaagagcgcactaaacttcataaaagactacaaaaagaaccctgaaaagaacaagtaccacatggaccatatgttccaatacccagtttcccggggcggggtggacgcatggataacaaaaggggccgaatcaatctctatggtccgcaaaatgatggcgaagaacacccctatggtgacaaggatgaattacgagaagcactcaggccaaaagggaggaatcagcgaccagaacatatgtagcgcgaagatcgcgaaaaagaatgtctacctccccatcaaaatgggggacgaaaaactgaaaaacgtcgaaaaatacggagggtacgggtccttaactgccaagtatttcttcctggtcgaacacacaatcaaaaaaaaaagaattcgcaccatcgaagcatacccaatgtacctggacgcactgaacaaagagaacaaactattgaactattgcgttcaagtcctcgagtatgatgaacccaaaatcataatggaaaagattaaggtaaaatcgctattcaaaatcaacggatactactactacctaaacgcaaagtccgtcaaccgcataatatggggaaacgccacccagctattcctggaaaacgacattaacgaatacgtccgcaagatatccaaaaatatcgaatgcatcgacataaactcggaaaacaacatcaaagtgtacgatatattcatcgaaaaatacagtaacaaactattcagcaaccggctgggcaacctcaaagaagccattatacaaaaccgcaacaaattcatcgaattaaagatcaacgaacagattaacgtcatcctcgaactcgtgcggtactcccaagacggcgtttactcgatcaacctctcacaactaggactgagctcaacgtacgccataaaccgaacgagtaaggaaatatcaaagatgaaagagtgcaaactgatcaaccaaagcgtcaccgggctttatgagaacgaaatagatctcctaaccgtctga

SEQ ID NO: 6505 - RNA, 4053 nt, synthetic construct
  misc_feature 1..4053: note = Cas9 variant
  source 1..4053: mol_type = other RNA
atgcaacaatactacctcggtgtagacatgggatcagcatcagttggctgggccgtcacggacgaaaaataccagctcgtgagaaagaaaggcaaagatctttggggcgtacgcaccttcgacatagcacaaaccgcggaagttcggcgagtcagccgaaccaaccgccgcagacaaaatcgccgcaagcaaagaatacaaatcctccaagagctcctcggtgaagaagtcctgaagatcgacgccggtttcttccaccgtatgaaagaatcccgctacgtcgcggaagacaaacgcactctcgatggaaaacaagtcgaacttccgtacgctcttttcgtcgaccagggctttacagataaggacttttacaagcaattcccaactataaaccacctaatcgtctacctgatgacaacctcggatacccccgacatacgactggtctacctggccctgcactattacatgaagaaccgcgggaacttcctccacagcggcgacatcaacgacgtaaaagacatccaatctatcttagagcaactggaaaacgtactcaaggaatacgttgacgactgggaattgtcactgaaggacaaagtagacgcaataaaagaaatatacaacaaggatttaggccgcggcgaacgaaagaaagcattcatcaacaccctgggcgtaaaaaccaagtccgccaaagcattctgcagcctaatctcaggaggctcaacaaacttagcagaactattcgacgactccggacttaaagaatccgagtatgcaaaaatcgagttcgccaacgcaaacttcgaagactcagttgaaggcatccaggcactcttagaggatcgtttcgccgtcatcgaagccgccaagagactctacgactggaaaatcctgacggatatactcggcgataacgcttccctagccgaagcccgagtcaagtcctacgaaacccatcacgaacagctggtcgaactcaaatcattcatcaagaaatacctcgaccgcaagatataccaggacatcttcataaacccaaacattgcgaataactacccagcctatgtcggccatacgaagataaacggaaagaaacaggagctagaagtcaaacgagccaaacgtaacgacttctacgcatacatcaagaaacaagtcattgacccaatcaaaaagaaagtgtccgacaaagccgtgttagcgcgcctggccgaaatcgagtccctaatcgaagtaaacaaatacctacccctgcaggttaactcagacaacggcgtcatcccgtaccaaatcaaactaaacgagctgcggaggatattcaataacctcgagaaccgactaccagtcctaaaagaaaaccgcgacaaaataatcaaaaccttcagctatcgaatcccatactacgtcggcccgctaaacggcgtaaaccgtaacgggaagtcgaccaactggatggtacggaaagagggcgaagagggcaagatctatccctggaactttgaagaaaaagtagatctcgaggcctcggcagaaaaattcataaggcgcatgaccaacaaatgcacctatctcgtcaacgaagacgtcctcccaaagtattcgctcctctactctaaatatctagtcctatctgagctgaacaacctccgcctggacggtcggccgctggaagtctcagtgaaacaggaaatctacgaaaacgtcttcaagcgcaaccggaaagttaccctcaaaaagatcaaaaactacctactaaaagaaggggtcatatcagaaaaagacgaactgagtggtcttgccgacgacgtcaaatcatcactcacagcttatcatgatttcaaagagaaactgggtcacctcacactcaccgaggaccaaatggaaaagatcatcctcaatgtcacactcttcggagacgacaagaaactcctgaagaaacgtctagccgcactgtacccaaacatagacgagaaaagtcttagccgtatggccacattcaactaccgtgattgggggcgcctgtcgaagaaattcctctccgaaatcacatcagtcgaccaagagaccggagaactacgcaccataatccaatgcatgtacgagacccaaaacaacctcatgcaacttctctccgaaccctaccatttcgtagaagcgatcgaaaaagagaaccccaaggtcgacctcgaatcaatctcataccgaatcgtaaacgacctgtacgtctcgcccgcggtcaagcgccagatatggcagaccctactggtaataaaggacatcaaacaagtcatgaaacacgaccccaagcgaatttttattgagatggcaagggagaaacaagagtcaaaaactaccaaatcgcgaaagcaagtactctcagaagtctacaaaaacgctgaaaagtataaaaacctgtttgaaaaactcaacagcctcaccgaagaacaacttcgcagtaagaaggtgtacctatactttacccaactaggcaagtgcatgtacaccaacgacgccatcgacttcgagaatctcgtcagcgccaactccaactacgacatcgaccacatataccctcagtccaaaacaatcgacgactcattcaacaacctagtcctagtgaagaaaggaatcaacaacgacaaatcggacagataccccatagacaaaaacattcgcgacgacgagaaagtaaaaaccctatggaacaccctcctatccaaaggcctaatcacgaaggaaaaatttgaacgtctaatacgatccacccctttctcagacgaggaactagctggcttcatcgcaagacagctagtagaaacgcgacaatccaccaaagccgtagccgaaatcctctccaactggttccccgaatccgagatagtatatagtaaagccaagcacatcaccaacttccgacaggacttcgaaatcctcaaagtccgtgaactcaacgactgtcaccacgctcacgacgcatacctcaacatcgtcgtcggcaacgcctaccacaccaaattcaccaactccccctacaggtttatacaaaataaagcaaatcaggaatacaacctacgcaaactcctacaaaaggccaagaagatcgaaagcaacggagtcatcgcctggatagggcaatcagaaaacaaccccggcacgatcgccaccgtgaaaaaggtcatctcgagaaacaccgtcctcataagccgaatggtaaaagaagtcgacggacaactcttcgaccaacagctcatgaagaaagggaaaggccaagtccccatcaaaagctccgacgacagacttatagacatcagcaagtacggcggctacaacaaagccaagggtgcatacttcgttttcattaagagcgtaagacggggcaagaccataaaatcgttcgagtacatacccgtccacttggccaagaaattcgactgcaaccttgagctgctaaaggaatacctcgaatcagaaaaggatttgaacaacgtcgaaatcctgatgccaaaagtaatgatcaactcactcttcaactacaacggcagtctaatacgcatccccggccgctacgataagaaatccctgctgatcaatgtcgacgtaccgctcttgctagaatcgcaacacatcaaacagttaaaagtgatcgaaaaatatatgtacaagaaaagggtatccaaaaattccaacattctcctaacaaaattcgcgtctgaccaactcaaagaccttgatgcgttgttcgacgtcctttcctacaagctcaatgaaaacatttacaacgtcatcaacgacaaatacgacaagctcgtcatctgcagagacaagttcatctccctcgacacggaggtaaaatgcgaaatgatcttcgaactactacacctcttccaatgcaactcccagttagccaacataaccaaaataggggccacatcgaagtttggatcaatttcaatgtccaaaaacctaaaagaaaacgacaagatgagcatcatccaccagtctcccagcggcatattcgaacacgagatcgaactcaccgccctctga

SEQ ID NO: 6506 - RNA, 4053 nt, synthetic construct
  misc_feature 1..4053: note = Cas9 variant
  source 1..4053: mol_type = other RNA
atgaaacggatactaggcctagacctgggaacagcctccattggctgggcactcgtcaacgagagcgagaacgaaaaagaaaagagtgaaatcatcaagctaggagtccgggtaaacccactcaccacggatgaacagacagacttcgaaaaaggccgtcccttatcagtaaacgccgaccggacgctaaaaagaggagcccgacgcaacctccagcggttcaaacaacgccgtaagaacctgatcgaaatcctaatcaagaaagggttcatcactaacatttccttactgacggaaataggaagcaacacaacgtaccagactctggagctccgagcaaaatcagtgaaggagaaaatagagaaagaagagttcgcccgcgtgctactaaccatcaacaagaaacgcgggtacaaatcctcacgaaaagcgaaaaacgacgaggaaggcagccttattgacgggatgtcggtcgccaaagaactatacgacaacaatctcaccgtcggacagtacgtataccaattactcgagaaaggcggtaaatacatccccgatttttaccgaagcgacctacaaaacgagttcgacgtcatatggaatttccaaaaagagttctaccctaacatcctaacaggagaactgtacaagaaactccagggtcaaggccaacaaaacagccgcaaactcttcctcgcgattcaccaaatatacaccgccgaaaacaaaggcaagcgcgacacagtcaaaaagcaacactacaagtggcgaaacgacgccatcaacacgcaacttctcatcgaagaggtagcgtacgtactcgtcgagataaacaacaacctcaacaaaagctcagggtacctcggggccatcagtgaccgctccaaagagctatacttcaacaaagaaaccgtaggcgaaaatctctacaaacaaatacaagaaaacccacagacaagcctaaagaaccaagtcttctaccgccaggattacctcgatgaatttgaacagatctgggagacacaagccaaattctacagcgaactaaccaaagaactcaaagaggaagtgcgcgacgtcgtgatcttctaccaacgcaagctgaagtcgcagaagcacctcatcagcgagtgcgaatttgaaaaacaccacaaagcaataccgaagtcgtcgccactattccaagagttcaaaatatggcaaatactcaataacatcgagttcaagcacaagaaaaccaaggaacttaagatcctgtcagaagaactcaaagaaacgctgttcgaagaactcaatatacggggaaacttcacctccgacgcagtcctaaagttcgtaaagctggacaagaaagaatgggaactaaactacaaaaagggaatagaaggcaaccgcactaacgaggtcctgtacaacgtctaccagaagatagccgaatacgagggctacggtttcgactggagtaaaaagtcagccgtggaaattaaagaggaactaaacaccatcttcagcgagataggcatcaatagcaaaatcctcgacttcaaccctgagattagcggaaacgactttgacaaacaggaaagctaccaactatggcacttactctactccgccgaagaagacggcttcctcaaacagaaactacaagataaatacggtttcaagtccgaatacgcaaacatgctcgcaaacgtatccttccaaagtgactacgggtcactaagcgcgcgggccatcaaaaagatactaccgaacctcatcgccggacacgagttttccgaggcctgcagcctaagtggatacaaccacagcaacagcctgaccaaagaggaactcgccaaccggcctctaaagggaaaactcgagctcctgaaaaagaacagtctgcgtaaccccgtggtcgagaaaatcctaaaccaaatggttaacctagtcaaccaagtaatcgagtcgtacggcgagatcgacgaagtgaggattgagctggccagggagctaaagaaatcggcccaggaacgtgcactcatgacaacaaacatcaacgccagcaaaacaaaatacgagtcctttcgaaaactactacaaaaagacttcggcatcaagaaccccacgcgaaacgatatcataaaataccggctatacgaggaactaaaagccaacaaataccacaccatttacaccaataagtacataccgcgcgacaaactcttctcgaaggaaatagacatcgaacacatcatccccaaggcgaaacttttcgatgactcattttccaataagacacttgccttccgcaaaccaaaccaagacaaagggaacatgactgcaatcgactacatcctctcgtatcagagcaaggacatagacaactataagagccgcatagaaaaccttttcaagaacgggaagggagatatatctaaggcaaaaaggaataaactactcatggaagaaaaggacatcccggacggcttcatagaccgcgacctgcggaactcgcagtacatcgccaagaaagccaaacagctgctggaagaagtgatacgtacagtcaacacgacaaccggcagcgtcaccaacaaactccgagacgactggggactgataaacgtcatgcaggaactaaatatgccgaaatttaaagcgatcgacgaatccctgatagaacaaatcgaaaagaaagacgggacattcaaaacacgcataaaggattggtcgaagcgaaacgaccacagacaccacgccatggacgccctcaccgtagcgttcactaggtataaccacatacagtacctaaacaacctaaacgccaagagcgacaagaagggggcgatctacggaatccaagaactagaaacctacgtaaacagcaaaggcaaaagaaagttcatcaaacctatgcacaactttcgcgaagaagcaaagaaacacatcgaggatatcttaattagctttaaggcaaagaacaaggtcgtgaccaaaaacatcaacaagatcaaatcaaaagacggtttcataaagaaagtacaactaacgccccgaggacaactgcacaaagaaacagtctacgggaaaatcaacgaggtggtcgtaaaagaagagaaaataaacgcgaaatttgacctggaaaagatcaacaaagtcaccaagccaatatacaggaacgcactcctaaagcgcctgcaagagttcaatggagagccgaagaaagcattcacagggaaaaatagcctcagcaaaaacccaatatacctggacgtcgcgcaaacgaaaactctgcctgagtccgtcaaggtgcaatttttcgaggaaaattatacaatccggaaagaaatcagcccagacctgaaaattgacaaaataattgacaagggaatccaacgaatcctgctaaaacgcttagacgagttcaacggaaaacccaaagaagcattctcgaacctagagaaaaacccgatatggctaaacaaggaaaaaggcatagcaatcaaaagggtcaaaataaaaggcgtcaaaaacgtagaatccctacacaacaaaagggaccacctgggaaacgagatactccagaaaggtaaatccgcacccaatgactacgtcagcacgggcaacaaccaccacgttgccatatatcaagacaaaaacgggaagctgcaggaaaaagtggtgtccttctacgaggccgtcgcccgcgtcaacaacaagctgcccatcatcgaccaagatttcaataaggatttaggttggaagttcctgttcaccatgaagcaaaacgaaatgttcgtcttcccctcggaagacttcaagccgctcgaaaccgaccttatggacaagaaaaacaactcaaaaatctccaaaaacctcttccgagtacaaaagctggggaataaagactatacattcaggcaccacctggaaactaaaatcgaagacataaagaagctccgcgacttcacgtatatccgcaagcggaatcctgaatcgatcaaaaacatcattaaggtgcggatcaaccacctgggcaacatagtccacgtcggggaatactga

SEQ ID NO: 6507 - RNA, 4056 nt, synthetic construct
  misc_feature 1..4056: note = Cas9 variant
  source 1..4056: mol_type = other RNA
atgagcaagaagtactacctcggcctagatataggcaccaattccgtagggtgggccgtaaccgatgaaaactacaatctctgcaaatacgccggaaaaaggatgtggggaatacggctatttgaagggggagaaacagccgaacaacgcagaataagtcgaagcaaccggcgacgcctatcccgaaagaaacaaagaatcgacttgttacaagaactctttgcagaagaaatcgccaaaatggaccccacatttttcatccgcctaaacgaatcacgactacacctcgaagacaaaagcacaggtgaaaaattccccctttttcgcgataaagactacacagatatccaatactacaaagaatatccgactatgtaccacctccgcaaggaactaatagaaaacagcaaagtccacgatatacggttggtgtacctagcctgccaccatatcctgaaaaaccgcgggcacttcctcataaacgggagcttcagtgacgtaaagaaactctcatcagtctgcgaaagcatgctaaattcatttaacggaatctcgaaataccaaatcgaaatcaacgatatcgaacgattagaggaaatcctatccgacaggaagaaacagaaaagcgtgaaagcaaaagaactcatccaaatatttgaatgcgggccatgcgaagacaaaaccgacgagaaaacctgcaaagccatcgtctcaaacctatgtaaatggctcaccggcctaaaaggaaacataaacagcatattcgacatgcaattcgaagagattgacacaagcagcttcagcttcacagaaccaaagtacgaagacaccatcagcgcggccctagaggagaagtacccggactacgctgacgtaatccagaaaatcaaggcagtctacgactggtccgtgctagtcgagatcatggcgggagaggactacctctcgttcgccaaagtcaacgcgtacaacaaacacaaggagaacctgtgtattctaaaagaggtgatacgcaaatactgtgacagcgagatataccacaaattcttcaatggcttcgacgagaaaaacgggtacgggaactatataggctcgatatacaaaaacggccatagctacgccatgaagaaatgctcgaccgaagacttctacaaaaccctaggaaaaattctcgacaagattcaacccgaaaaagaggacgaaaacgtactggaagaactaaaagtagaagtgaaaaaccaaacgctccttcctctagccaggacaaccgctaacggcaccataccaaaccaagtacacatccaagagttgcgcgccatcctcgacaacgcaaagaagtacctacccttcctgaatgaagaggacgaatacggcacggtagcagagaaaattatttctatcgccaaattcagaataccctactacgtcgggccactgtcaacccgacacaaagaacagggcgccaatagctggatcgtaaggaagcaagaagggagaatatacccctggaatttcgaagaaatggtcgacctcgaacaaagcaacaaggagttcatccaaagaatgactaacaagtgcacgtacctcatcggcgaagacgtactgccgaaaaacagtctcctctacagccgttacatggtactgaacgagctgaataacctccggatccgcgggaacaaaatctcagtcaagctaaagcaagagctatacaaggaactcttttgcactaaggccaaggtcacggggaaaggcctattcaactacctgaaaaaggaggatgaagaactggccctcgaggacatcagcggattcgacatcgacttcaaaagctcattaacctcatacctcgacttcaaaaagcaaatcctcggcgaggaaatcgagaaagacaaatataaaggcatcgtcgaaaacataatcaagtggaaaacaatatacgacgacgattcaaagatgatgaagaaaatgatagaacgggaatacccaaacgtcttctcaaaagacaagatcaaaaagatatgcagattcaaatactcggggtggggtaacttctcgctctcctttcttaacggcatacgaggagctgatagggagacaggagagagcttcacgataatcgaggcactatggaaaacgaactacaacctcatgcaactcctaagcaaacaattcacatttagagaagagatagacctgatcaacgccgaaaaagtcggaaagatcaacaaagtaagctacgataacaccgtcaaagacctcatcgtgtcgccagcaaacaaacgagccatctggcaaacagtccagatcacagaagaaatcaagaaagtcatgaaatgcgagcccgagcgcatattcatagaaatggctcgcggtggagaaaaagagaagaaacgcacggtaagccgcaaagcaaggcttctggaactctacgccgcgtgcaaggatgacgtacgtgactggaccaaagagatcgaagaccgtgaggaaagagagttcaactcgaagaaactgtacctatactacacacagatgggacgctgcatgtactccggggaagaaatcaatatagacgaactaatgcaaaagaacagcaaatgggacattgaccatatatacccccaaagcaaaatcaaggacgacagtctggacaatatggtgctagcgaaaaaggtaatcaacaactctaaacagaacaaacttctatcgtccgatatccgtataaaaatgaagaaatactggaacgcactatacaaaggaaacttcatatcaaagaagaaatacgacaggctaacgcgtaccgaagacttcacaaacgaggaactcagcggcttcatcgagcggcaaatagtcgaaacccggcagagtagcaaagctgtggcggagctcctaaatcgcctatacgaacattccgaaatagtatacgtcaaagcaggactggtaagcgatttcaggcacgacaataaactattaaaatcgcgcaggatcaacgactaccaccacgccaaagatgccttcctaaacatagtggtgggcaacgtttacaacgctaaattcacctcaaacccgagaaaatggataaaagagaaccgaggaacaaactacagcataagacgagtattcgactacaacgtcaaacgcggcaacacagtagtctggcaaggagtcgaggacggaggacatagcatagatgagatccggaaaactatggcgcgaaacgatatcctctacactgagtacacctactgcgacaaaggcgagctattcaacgcgaccctgatcaaaaagggaaacgacaaggcaatcaacctcaagaaagccctggactccgtgaaatacggaggatacaacagcccgaaaacaagtgcattcgcattcatcgagttcgatgggaaaaagaaagaacgcaaaaaccacatcgttgaaatccccgtatatatcgttaacatcgcgaaacggcaacccgatacgataaaagaatacctagaacagaagaaaggctacaaaaacgtagtagtaaagaaataccccataaagaaaaacgcccttattaaaatagatggctacctggcacgcctcaggggagcaaacgagacggacatcctccttaaaaacgcagtacagctaatcctgaacgataagtattacgagataataaggcgcgtggagaaatatctggaatacaacgtaagatacgaggcggagtccatgttcgagggcttcgaccacgccgacctgaacagcctatacgacgaacttacctcaaagctggaaaccagtatctacaagaaaagacctgcaaaccaacttaacgccttagaaaaaggaaaagagaagttcaagaacatccaaacgctacgggaaaaagcacaaattataaaggagatgctcatcatgtacaggtgcgacgcggcgaccgtagccaacctaaaagcaatcggcggaagcgccaacgcgggcagcatgaaaatcaagaagaacacactaacgtcgcgatccctggtactcgtaaaccagagcatcaccggactcttcgaaaccgaggaagaattggtctga

SEQ ID NO: 6508 - RNA, 4056 nt, synthetic construct
  misc_feature 1..4056: note = Cas9 variant
  source 1..4056: mol_type = other RNA
atgtacaaaaagtacggcatcggactagacataggcacaagctctatcggctggagcgtagtagacgaatacggccatataatacgcgtaaaaggtcaaactggcctcggagtccgcctttttcgagaaggccagcccgccgccgaccgacgcaccttccgaacaactcgaagacgactagggcgtcgtcgctggaggctacgtctgctacgtgaaatattcgacccgtacatcgcagcccaagatcccaactttttcgcgcgccaaaaggcctctgcaatcgccccaggagacagcagattcaaagcggtgtaccgtctattcaacgaccagaccgaccgacaattctacgacaaataccccacagtgtatcacctccgccaaaaactaatgaccgaaaaacgccaattcgacatacgagaaatctacctcgcagtccatcacatcgtaaaatacagaggccacttcctaaccggcggcgcggctaaaaacttcaaaccaggaaaactcgacctcaacacctactttgccacaataaacgcgcaactagcagcaatctttatggatagccaagtcgaactaccacaactcgactgggacgccgtagtatcattgctaaccaatgaccaagagtcaccctccgatagacagaaagcactaaccaaaatgcttgtggcccaaggcgacgcaacccagaagcgcttctacacggagttcagcaaagccctcctcggactcaaggccaaactctacgtcctgacaggcttcgaaggcgacaaaaccgaccagaaggccctcacattatccctggaaaccctagacgatcaccaagacgacgtaacccaacttctcggagacgaacaacgccaattagtagaacttctggcccgagtgcagtccgcaatccagctcgcgatcataataccaaacggcaaaactttctccggccaaatggtacagcaataccaaacccactacgaccaactacgcctactgaaagactaccgtgaacaactcaccgaccaaaaacaccgtcgtgcccttaagcaagcctacgccgactacctagccaacgaccaagaccaagacgccctagttaaggcggtagaaaaagtcctcaaacaaaaccaacccctaagcaccgtaggggtacgactccaaaccgccatcgacgccggggactttctcccaaaacaacgaaccaaagcaaacagcgtaatacctcaccagatccaccaacaagagttggatcgaatcatcgaagcgcaatccgtctactacccatggctcgcagaggagaatcccgtagccgcgcatcggtcttacgcgccgtacaaactagacgaactcgtcgatttccgggtcccatactacgtaggccccctggtccagccacaagccgacaaagccgcaaaagaaacaaagttcgcttggatgacccgcaaagaagcacagagtaccacacccatcacaccatggaacttcgaacaagaggtggaccgaaacgcctcagccaacgccttcatccagcgcatgaaaacgaccgacacctatctactcggggaagacgtcctccccaaaaactcactcttataccagcggttcgaagtcctcaatgagctcaacaatgtcagagtcgacggaaaactcctaacaatagccgaaaaacaacggctattccaagacctcttcgtggacaggagccaggctagcgttacaatcgcccaactacaagcgaacctcatagcgcacggcgccgcaaaggacagagtggaaataaaaggactagcagacccaaaacgattcctctcgtcgcttaccacataccacgactatgcgcaaatcatccccgaggcgctcgaacaacccgacaagcgtgcggacatcgaaaagatcattaactggagcacaattttcgaagacacctcaatttttaaagaaaaacttcaagaaatcgcttggctcacacccgaccaacgcaggcagctgtcccagaagcgctatcggggctggggccagctaagtgacaaactcctcacacaactaagagacgccaccggacagtcggtaatggacttgctctggacagaaccaaacaacttcatgcaaataataagacgaaccgagttccaacaggctatagcccgcgttaaccaaaccgacctcaaacaacaagacttggcaaccacaatcaacgacctctacacaagcccacaaaacaagaaagcgatacgtcaggtcctgctagtcgtcgccgacatacagacggcgatgcacgaggttgcgccatcatggttattcatagaggcagcccgagggcctgaacaaaaccccaaacgaaaactcgcaaggcagcaacaactattagaggcgtacaaaacgtccgccaaagagatcgtcaacgaggccgtaaaggagaagctcctaagtgccatagacgaccatcaaaaatttgaggaccaagtcgttctatacttccaacaaaacggtctcgacatgtacacaggaaaacccctagactttgaaaggctgtccaaataccacatagatcacatcataccgcaaagcgtggtaaaagatgacagcctcgataaccgtgtcttaacaacgccggaagaaaacgagcgaaagggtgcccgcgtccccgggcctctttacgccagccaacagggacgctggcgactcctacagagagccggcttaatatcccaacgaaagctagaccacctcctccttcgacccgaggagctagaccagcaggcaaccggcttcgttgcccgccagctagtcgagacacgccaagtcatcaagctaatcacgaacatactcagccaacaatacgaccctgaacaaactaagctagtatccgttaaggccggactaagccaccaattccggaccagactcaacctacccaagctccgggaactcaacgattaccaccatgcgcatgacgcctacctagccgcaaggatcggaacttacctcttacaacgataccccaacctggaaaggttcttcgtgtacggccaataccagaaaacacgcttcgatctcaaacgacacttcaacttcatcggagaaatgcttaaaggcaaaccagaagacgcggttatcgtcaaagcaccccactctgagaccgtcatctgggacaagcaagacgaagtaaaacaacttaagaaaataatggaatatcgccatctcctcgtgacccacgaagtatacgataatcacggagcactctttaaccaaacaatacatccagcgaaaaaccccaaaaaccgaaaacttataccacgcaaaaccacgcaatccacagagctatacgggggctacagcggagagacgacaggatacctcgccatcgcaagaacagtcaccaaaaacaaaataagctatcaggtccttcgtgtaccaacacgactcgtgggccgtctccaacgttctagcgagtccgcacaacgacaaatactcaccgactggttcgcgcccagcttcgtgtcccggggaaagcaacaaccattcgaaatcgttctccgccatgtattcaaaaaccagacagtcatcgacgatatacacgagcaaagtcacagattcggactgcgatccgatacctactactgcaaccagcaacagctagttctatcactcgaacaacaacgcatgatcatcgaccagaaactcaacaacaccaacaaattaatggtcgtatacgaagcggtgtgcgaccaagtcgctaaatatttcccgctatacagaatgaaccacttcaaggaatccctactcgaagccggcccaaaactcgcagaactcccaatcaacaccgtccaaagcaagaacggcaaactgaaactaggccaaaggtcggttctccttcagacaatgcaaggacttcatgcaaaccccgaaacaaaagacctcagtatcattggatgccctaaatacttcggcaagctccaagtgtcctctggtatcaagctcacagaaaacgcagttcttatccacgaatcacctacgggcctattccaacgccgagtccgactgtccgacctatga

SEQ ID NO: 6509 - RNA, 4056 nt, synthetic construct
  misc_feature 1..4056: note = Cas9 variant
  source 1..4056: mol_type = other RNA
atgaaaatcctaggacttgacctaggcacgaactcaataggctgggcagtagtaaacgaagccgaaaacgaacgcgaaagcagcagcatcattcgacttggggtcagagtgaacccgctaacagtcgacgagcagaataatttcgaaaaagggaagcccatcacaaccaatgcagacagaaccctcaaacgatccatgcgaagaaatctccaacgatacaaactcagacgagcgaacctcgtctcactcctgaaaactcaaggctggataacagacgagaccctcctgagcgaacaaggcaacaacagcaccttcgaaacataccgcctacgagcagaggcagctacaaaggaaataaccctcgaacagttcgcgcgtgtcctactcatgcttaacaaaaagcgaggatacaaatcctcacgcaaaatgaagcacgacgaagacggatcattcgtcaataacctagacattgcccgcgaactatacgacagcggcttaacaccagggcaatacgcctacaacctactaaaagacggcaaaaagtatattcctgacttctacaggtctgatctacaagaggaactagacaaaatatgggcttaccagtacgagtatcatgagaacatattaacgcacagtctccgttcagccattatcgatcaatcaaaaacgggcaccaccaaaatatttttaaaaacacacggaatattcacagcagacatcaagggcaacagaaacgaacgaaataaacaactcttcgaactccgctgcggcgcgctcgagcgagccctaacagcggaggaactggccacggtaattgcagaagtaaacggccagataaactcctcatcagggtacttgggggccatcagtgaccgctccaaagcacttttcataaaccaccagaccgtcggacaataccttatgcagcaactggaccgggacccgaacaagagcctcaaaaaccaacccttctaccgccaagactacctagacgagttcgaacagctctgggaaacacaggcccactaccacccggaactgaccgccgcccttaagcacgaaatccgggacataatcattttctaccaacgaagactgaaatcacaaaaatggctcgtggcgaactgccccttcgaacaccgaaaagtctgcccgaaatcgtccccgctattccagcacttccgaatctggcaagtgctaaacaacgttacagttacagtcgacaataaaacatacgtgctaaacgaagaacaaaaatccatccttagtaaagagctcttgtataaagagaagatatcgaaacgtgatgcgttaaagatgctattcgttaaagctaaaggtgtagacatgaacttcgcctcactcgagggagaccgaaccatgtccaaccttctcaaggcagcccaagagatcgtctccatctccggacatggagactacgacttcggaaagatgcccgccgacgacattcacaatattatccgctcagtgttcggaggcctcggattcgctacagactggctaaacctagacacagacgcggacgatttagaacaagaatcacagatgcgattgtggcacctcatatactcattcgaaggcgataacagcaccacaggagataccaaactcgtcgagcgcctcatgtccctcctcaatcttccgcaagaatacgccagactgttcgcaaatgtgcacttggaagacgactattgcgggatatcaagtaaagccctcaagcgcatcctaccgttcatgaaggcaggccacatctactcagaggcttgcgccctcgcaggctacaaacatagcgaacagagcttgacacgtgaagaaaacaaaaatcgccccctcaaagaccaccttgaacaactacccaagaactcacttcgaaacccggtggttgaaaagatccttaaccaaatggtcaacgtggttaacagcatcatcgatacctacggacggcccgacgaaatccgaatagaactcgcccgggaactcaaaaacaacgcactgggacgacaagctatcttcgaagccataaaccgaaacacaaaagagagcgaaaggatccagcaaatcctcaagaaagagttcggcctaacccatgtgagcaggaacgacattatccgctaccgcctctaccaagaactgtcgggcaacggctacaaaacgctatacagcaacatctacatcccacaagagaaactcttctccaaggaaatagatatagaacacataataccccaagcccgcctatttgacgactccttctcaaacaagaccctggagtaccgagatgtaaacataaagaaaagcaatacaaccgccatcgactttgtgcgaaacgagtacggcgagaacgaagtcgaacaatacaagaagcgagtcaacgacctcctcaagagcggtgccatctcacaagcgaaagccaaaaagctcaagatgacagaggccgagatcccaaatgacttcatcgaacgagacctgcgcaacacacaatacatctccaggaaggcacaggaaatgttacgcgacgtcgcacgcgtagttacagcaacgaccggatccgttacggatcgactacgacaagactggcaactcgtggacgtcatgcaagagctaaactgggacaagtacgagcgccaggggctaaccaccgtcataaacggccgcgacggacaacagatccgtcgcataacagattggaccaagcgcaacgaccaccgacaccacgctatggatgccctcaccatagcattcacaaaaccggcttacatctcctatctcaatcacctaaacgcccgcagcgaagacgacatccgatcgatcgaacgacggttcctggaaagagacgcgaacggccatctgcgcttcatcagccctatagcccacaatttccggtcagaagccaaacgccacctcgagatgatcctggtttccatcaaggccaaaaataaagtcgtcacccggaacaacaacacaacaaaaacaaagggaggccgacgaaaccgcatacaactcacaccccgtgggcagctccacgacgctaccgtatatgggtccatcttgctcccacacacgaaaacaatcgccgtcgacggcaagatgacagctgaaataatcggccaagtccaaaacccagtattccgacaagcactttcacaacgactagaagcatgcggcaacgatccgaagaaagcgttcacgggcaaaaactcgcttgaaaaagcgccagtttggatcgaccaagcccacaccgaacacgtgccagccgaggtcacgatccaacgacttgaaccacagcataccatccgacgagccgtcaacaaagaccttaacattaacaaagtactggacaagggtatccagcatattctgcaagcccgcctagacgcgtacggcggcgacgccgcaaaagcgttcgcgaacctcgacaacaatccaatatggctaaatcaggaaaaaggaatagccataaaacgagtcaccacagccgagaacatctctggagaacccctccaccacaagcatgacaaagagggacgcccgatactagacaccaacggcaaacctatgccgtccgactttgtaagactcatgaacaaccaccacgtcgccatattccaagacgctgacggcaatctccaagaacatatcgttagcttctacgaagcagtcgcacgtgtaacagaactaggcttaccagtaatcgacaaggagtataacaaagacaaaggatggcaattcctattcacgcttaaacaaaatgaatacttcgtattccccaacccggcacaaggcttcaaccccgacgaaatagatctaacggatgaacgaaactactcacgcatttcgccgaacctctatcgcgtccagaaaatgtcctcaaaatattacgtcttccgccaccacctcgaaaccacggtcgaggacaagaaggaattacagggaataacctggaaacgaatccagagcctaaacaacctcaaaggaatcgtcaaagttcgcatcgaccacatcggaagaatagtccaaataggcgaatactga

SEQ ID NO: 6510 - RNA, 4056 nt, synthetic construct
  misc_feature 1..4056: note = Cas9 variant
  source 1..4056: mol_type = other RNA
atgttcagccaacagaacaacctgtactgcgagagcttgtccaaactttattacaacattaccaaaaacttcctctctaaaaacgaggtgtgccgaatctacgagatcttcttctgctccatcctgacgtacttcctaaagaaatataatcacgacatcttcaaaaagagcagcacgatgaagaccatccttgggctggacctaggcgtcacctccataggctgggccgtcatcgtaacggacgacgacaacacaccgatcaaaatactaggcatgggatcccgcataattccactatcaacagccgacaaagaagagttccaaaaaggacaagcaataagcaaaaaccagtcacgaacgatagcacgcacacagcgaaagggatacaaccgcaaacaacttcggaaagaggagctcaagaaaatcctaggcgaattaggaatcacgccctcaaaagaacttctcaacctccccagtatagagctatggaaactacgagccgacgcagcatccggcaacgcgccactcagcgcggaacagttaggtcgcatcttctacatgctgaaccaaaagcgcggatacaagagcgcccgatcagaagcgaaccaggacaagaaagacacagattacgtagccgccgtcaaaggacggcaccaacagctcaaagaaaaaggccagaccatcggtcaacacttctacacggaaatgctcaccctagaggaaaactccggacactttcaggttaaaaacaacgtatacccccgcgaagcatacctagaagagttcaacgctatcatcgctgcccaaaagccccagcacgccttcctgaccgacgacgtggtggatcgcctcagagacgaagtcatcttttaccaaagaaaactaaagagccagaaaggattagtgtccatctgcgagttcgaaggcttcgaacgtacctttttcgacaacgtcaagcagaaagacaaaaccatcttcacaggccccaaggtggcgcccaaatcatccccgcttttccagctgtgtaaaatctgggagaccgtcaacaacataaacctcaaagtgaagaacaccgacggaagcaaaaataaatgggcagattacgtacccaccctcgagcaaaagcaagaaatcatagaacacctcttcaaaaatgccggcattagcctcgatgcactgagaaaaatcctcggattcaataaggacgaaatcttcgtaaacaagcaaatcgagaaaggacttcaaggaaacaccacctacgcagaaattcataaaatactgggcgacagcaaacctgaactactgggattcaacataaacatagagcccagcaaacacagcgcgcttctcgtagacaagcgtacaggcgaaatcctagccgaaaaagaaggacagcaagtctccgcagagatcgaaaaggagaatttctaccagctctggcacacaatatactccattaaggacctagacgaatgcgccgcggcgctcatcaaacgcttcaacatcgacccaaacgtagcggctcagctagccaaaatcgacttctccaagggcgcattcgggaacaaatcgaacaaagccatgcgaaaaatcctgccatacctcatgcaaggctacaactacgccgacgcctgctccctcgccggctacaatcacagcgactcccaaaccaagaaagaaaaagaagaaaacgtagtcgatgacaagctaaaattactcgagaaaaactccctacgccaaccggttgtagagaaaatcataaaccaaatgatccacgtagtcaatgccatcatcgacaaatacggaaaacccgacgaaatccgcgtcgagctcgcaagagatctcaaaaagtccaaagacgaacgaaacgaggccgaactgcaaaacgccagcaacaagaaacttaacgaagaagtcgcaaaccgactaaaagaacttggcctcccggtaaccaaacgattcgtgcaaaaatacaagttcattttcccagtccgagaccgcaaaatcaaagaagcccagctagttaaccagtgcatctactgcggggaaacatttaacgtcaccgaagccctctccggggacaatttcgacgtggaccatatcatcccaaaaagcatgttattcgacgacagccagaccaacaaggtactcgtccaccgcaaatgcaatgccaaagacaaatcaaacaaaacggcctacgactttatagccgcgaagggagaaaacgaactcgcaatatacctagacagggtagacgactggttcaaacgcggggtactcagctacggcaagatgcaacgcctgaaggtcagctacgaacaatatgccgaacgaaagcaactcaagaaagaaacagaggcggacatcaaactgtgggaaaacttcatagagagagatctccgccaaacacaatacatcgcgaagaaatccaaagacctactcaagaaaatctgcaacaacgtcaccgtgacggaaggaaaaatcactgcgcaactgcgcaacctctggggctgggacgacgtcctcatgaacctccagcttccaaaatacaaagctctaggccagacagaaatcaaagaatggaccagcgaacacggacgaaggctccacaagaaagaagaaatcactaactggaccaaacgcgacgaccaccgccaccatgcaatcgacgccctcgtggtagcctgcacaaaacagggattcatacaaagaataaacacactaaactcatcggacacgaaagatgcaatggaccgcgaaatcaaagcggcgaaagagaaatacaacgaactctacgacaagaaactcctcacagagacaaacgaacaagtgaagaaccacacggaacggttcaacaagctagaaacatacctcaagtcccaacagcctccactcttcaccacacgttacgtggaacaggaggcggacaaaatctttgtcagcttcaaagcggggaaaaaggcagccacgtacggcatcagaaaaatcaagaaagacggaaagaaggtagtagtacaggagaaaatcgtagtccccaggggcgcactacatgaacagtccgtttacggaaagatcaagacccaagagaaagacaaaccactgaagtacctattcgaaaaccccgaaaccatagtagacaacagaataaaaattctagtcaaagaacgactagacaagttcgaaggtgacgtcaagaaagcgctcacctccctgaagaaagaacctctcttcattgacaacgagaaaaacactctcctcgaaaaagccgcctgctacaccgatgccacagtactcaaatacaaacttcaagcactcaaagcgaatcaggttaacgatattgtagacgaaggagtcaaacgcatcgtcaaagcccgcctcgcccagcataagaacgaaaaggaagccttcaaagacaccgtgtggttcaaccaggagaagcgaatcccgatagttagcgtccgggtcttcgcgcgaccggacgcatcgaagctagcaataattaaaaccgacgagaataataaaccgatcggtttcgcgctcaccggaaacaaccaccacatagctatatacaaggacaacacagggaagctagtacaacacatttgcaccttctggagcgctgtagagcggaagaaattcggcgtgcccaccgtcgttaaaaacacggggacactctggagcgaactcctgcacaaggacctaccgggtacattcctcgacaaacttccgcaagacggactcgaactagaatactcactacagcaaaacgaaatgttcgtcctaggattaccgaaggagtccttcgaggacgcaattaagaacaatgacctgccccttctgagcaaacacttatacctcgtatggagtatcagtgataacgactactggttccgccaccacctcgaaaccaaaaactctgagctcaagtcgacaacaggcgccaaagaaagcaagcgatactatagatttcaatcagtcggcactttcacaaaagaaaacccaataaaagtccagttaaaccacctaggagaaattacgaagataggtgagccatga

SEQ ID NO: 6511 - RNA, 4059 nt, synthetic construct
  misc_feature 1..4059: note = Cas9 variant
  source 1..4059: mol_type = other RNA
atgaagaaacgaaaccgagaagagtactacgtcggactcgacatcggcacaagctccgtaggatgggcggtagccacgcccgactaccgcataccaaaattccgcggtcacaaaatgtggggaagccgcctcttcgccgaaggaaagcgtgccgccgaacgccgccaatttcgaacaaaccgacgacgactagctcgcagaagagaccgactccagatacttgaagaactcttcgccgaagaaatggccaaagtagacaacacgttcttcatgcgcttaaaagaaagcaaattctttctggaagacaaaacggtcaaagagaaacacattctcttttccaccgacaaattcgacgccgacagattttacaaggacaacccgacgatataccacgtacgcaagcgccttatggaagaggaaccccaagacatacgcgaactcttcctcgccgtgcaccacatacttaaatacagaggccatttcctgttcgcggggagcctcgaacagaacggtgcaagcatcgaagaactcgtacgtaccttactaggcaaacaaggactagctattctcgatgacaccatagactccaacgaaatggtaaacatactgaaaaacaccggcgaaaccaaaagcgaccgaaagaaagacgtccaagagttatggaacccactgaaagacaaggtaaagaaagcgcaagcagctgaaatggcaggactcgtgctaggactgaaaagcgatatatcgaaactcttcgccaactctgactataaggacctcgacagtagcataaagaacatcaacttcagctctggagactacgaggagaaaagggacgactacgcgaacagtatcggagacgacattgtcctgctagacacaatgaaagcactctatgataccctcatactctcgcaaatcctccaaggcaaacgttccatcagcgctgccaaagttgaggactacaacacacacaaagagcagctacgcgcactaaaagccattctaaagcctcacaaaaggctctacaacgagatgttccgcgaaaataacaagaaagacctctcaaactacgttgcgtatatcagctcctattcggaaggcaaacgagtcaaccgagaaggattttacaaatacgtccaggcagtactcaaacaggtcgacgattcagactctaagcaagcgatcctggaagcgatccgcctagaaacgtttctccccctgctgcgagtcaaagataacgccgtgattccgcaccaaatccaccaggccgaactggaggcaatccttgaaacagctcgcaagaaatacaactttttaaatgacgtatccgatggcgtaagtgtaaaagacaaaatcattcaactgttcactttccgaatcccctactacgttggaccgctcaacccccacagcggcgagaccgtagcagatcgcaaacagggaaccggttgggtcgtccgaaaacaaagaggaaaagtgtatccctggaacttcgcagacatggtagatgttaaagcatccgcggaagcatttatcacaaacctaaccaacaaatgtacttacctaataggagaagacgtactgcccaaacggtctctcctctactcagagttcatgctcctcaacgaactaaatatgataaaatacgacggccacgaactgcctgtggccatcaaacaactctacatagagcaagtctttaagcaagaacacaagaaacaaaccaaagggcgggttctcgacttcctaaaacgaaacggattgataaccggctcggcaactgcagtaataacaggcatggatgatgcaatcaaaggagacctccaatcctatagagacatggtgcgtatattcggagccggattcgaccacagcatggccgagcgaatcatcagatgggtaacactcttcggagaggccaaagacatcctcgaaaacaaaatacgcgaggtctacggcaacagcatcagcgatagccaaatgcgcgccataaagaaactcaagtacgctgactggggacgcttaagtcaagcattcctaatagcagtcaaagggtgcgacaaaagcggtgtagaacgcaacatcatcacatgcctacgcgcatcctcccaaaacctaatggaaatcctaagcgaccaaggcacctacatcaagcaaatcaaagcctggaaccaccaacacacaaccaacatgatggacaccctggactaccaactcgtagacgacctgtatgtcgcaccctctgtcaaacgcagcatctggcaatcgctatgcatagtggaggaactcgtcaaaatcatgggccaagcaccaaagaaaatcttcgtcgaagtcacacgtactaaacaagcggaaaagaccaagaaagacagccgaaagaaacggttggtcgaactatacacggccatcggcaaagaaggagctgcgtggaagaaagaaatcgaagcccaccaggccggcgacttccggcgaaagaaactctacctctattacacgcaaatgggacgctgcatgtactcaaatgaaccaattgctatggatgccctcttcaccagcgcatacgacattgaccatatctaccctcaatcactcacaaaagacggtagctgggacaacctcgtgctcgtcaaatcccaactgaacaaagaaaaatcagaccaatacccactccgaccagcgatccgcgagaaaaacaaagcccactggcagtacctctgcagagcgggcttcatctccgaaaagaaatacgagcgactcatgagaacaacggaactcaccgcagaggaactctcaggcttcatcgctagacagctagtcgaaacctcgcaagccaccaaagcagtcaccggcctattagaaaggatttacaccaatacagaaatatgtttcgtgaaagctgagacggtaagccaattccgacaccaacacaacttcatcaaaatccgggaacttaacaactaccaccacgcaaaagatgcctacctgaacatagtcgtcggaaacgtctaccacgaaaaattcaccaaaaacccctgggagttcatcgccagaagcacagaacgtcgaccctacaacctaaaccgcatgtatgatttcgacctactcaagcaagggagagttatatggcaagtgccgaagagtctcgaaacggtacaagccatgatgaaatccaacgacgtgcgcataaccaagaaacttctagtccaaaagggagaactctacgatgcgacgatcaccaaagcacacaaagcgaaagaggggacatacttcccacttaaaggcgccgacgcgcgtctaagagacgtgcaccgatacggaggctacgagaaaatcaaaatagcatactacagcgtattcagctgtcgcgaaaaggcaagcaacacgatccacaccttaataatacctatcccagtatacaaggctgggctcctccaaacagaagccgacctgaccgcctacgcatggcaaacaaagcagaaaacaaaaccgatcaaggacatatatagcgccatcacacccatatacaaaaagctgtgcatcaacacggtggtaaaaatagatgggttcaaatactttcttgggggcaagacaggggactacatgtggctagacccagccatcccagtcgtgctcgatgaacaggcggccgcatacctaaaagccatcagcaaagtcggccgagctgacgatgtcgaaaacacagcccaggccatagatttaattacagcagaggccaacgaagcgttctacgacgttctactgaaaaagatggaggcgaaaatctttgccaaagcctaccagactatagtagaaaagctagcgtccgaaaccgcacgggagcggttccgcgaactctccatcggggcacagtgcagctgcctgctagaaatcctcaacttgctcgccaacaacaaaaccacatttacattctttaaagacaaaatgggcgtgaccatgagccgaaggaaacaaccgatggaccttaccaaactagaggagtgcatcgtctacgaaactagcatcacaggactttacgaaaaagccgtctccctactgtga

SEQ ID NO: 6512 - RNA, 4059 nt, synthetic construct
  misc_feature 1..4059: note = Cas9 variant
  source 1..4059: mol_type = other RNA
atgggcaagaggtaccacatcggactcgacatagggacgtcaagcatcggatgggccgtaatggacgacgacttcaagataatgcgcgtcaaaggcaagaagggcataggcgtccgcctcttcgaggaagggaagaccgctgccgagcgccgaggacacaggacaacccgacgacggtacagccgacgcaagtggcgactcaatctcctagaagaaattttcgaccccgagatcgccaaggtcgaccccaccttcttcgcccgactcaaagagtcaaacctatcccccaaagacgaccgcaagcaatactcgggaaatctcatcttcccggaaaaagcgaaggaagaaatccgcgagtggaccgagaagtaccccaccatctaccaccttcgaaacgcgctaatgacagaaaaccgccagttcgacattcgcgaggtcttcctcgccctccaccacatcgtcaaataccgtggcaacttcttgtttaacggtaacttccagaccggtgaggtcaacttgtccgaccggttcgacgacataaacagtgctttcatcagcgcctgcggagaggaagaggcaccccagatcccatccgagctgtacaacgatatccaggaactcctattcgacaaaaacacgagaaagctagataaccaaaaacaactcgccaccaaactatcccaagacaatgacaaggattggtcaacccaattctccaaagcactgttcgggtacaagaccaagttcaaagtagtcctccaaagcaacgaggacctagacgactttcaattagactccgacgacgccgacgacaaaatcgcaagcatcagcgagcagatagacgacgaccgaggaagcatcctggacaacattaagatactttacagccgaataacgctcaatgaaatcgtcccagacgggaaaacactttctcaatccatgatcgaaaaatacaaccttcaccgggaccacctcaaagaaatcaaagaccaactaaaacacactgacaactgggtcaaattcgacgatctgtacagccaatacgtgaatgggaaactagagtcagaccgacacaagaaactctcatcagacgacttctacaagaaagtccttaccctcttcgacggggaactaaaaactcgcgtcaaagagtggcaagagaaaggagaatttctccccaagcaacgcacaggaagcaacggagtcataccccaccaactccaccagaacgagctggaccaaatcatagaaaaccagtccaaatactacccctggctagccacactcaaccccaacgaaaagaggcaacgggtagccaaatacaagctaagcgagttggtcgctttccgtatcccatactatgtcggaccgatggtcactaaggaccaatcggacttcgcatggatggtccgcaaaagcgacgagaaagaaatcacaccatggaactttgaccaagtcgtagaccgagacaaatccgccgaagaatttatcaaccgaatgacaaccaaagacacgtacctcataggggaagacgtcttgccagcgaaatccctactctatgagaaattcactgtcctaaatgaactaaacaacattcgtatcaatggcaaaccactcacgacagatgaaaaacaccaggtataccgcgacctcttccaaaacgccaaaagcatctcaacgaagaaattccacaactacctcgtgtgtaaactcaacaaacccaatcacctgaacatcaccggcttcagtgacctcacgaagttcaactcctcactcgactcctacatcgaccttaaaaagatattcgcagaccaaatcgacgaccagtcgttacaggacgactttgaaaagatgatcagatggtcgacggttttcgaagacaaacaaatatttgagcggaaactatcagagatcaactggctcaccgaccaggagcgatccgaagtcgccaagctcagataccgcgggtggggccggctatccaaacgactactcgcaggcatccacgacgagaacggacagcgaatcatcgacgccctctggaactcgcccaagaactttatgcaaatccaagcagaagtcgcttttaataaacaaatcaacgacctcaacaccaaagaactctccgacaacaacgtcgaagatgtcctcgccgacgcatataccagcccacaaaacaagaaagccatcagacaggtccttctcgttgtagaggacatacagaaagcaatgcatggcgacgcgcccacgtcaatcagcctggagttcgcccgcgaggaacaagaaagcagcaggacgcgctccagacgcgcagcactttcggcaacctaccgacagatatcagacgaaatcgtatcagccaccgtcaaaggagaactcggaaaagcaacttccatctccgacagactctacctttattttacacaaggtggacgcgacatgtatacaggtgaaccgatcaacatcgacgaaataagcaggggctacgaaatcgaccacatactaccccaatcattcatcaaagacgactcactcgacaatcgcgttcttgtaaaaggagcaataaacaacggcaaatcggccaactacgtcatggaccagagctgggccccagatcgcctcgcttggtggaagaagctactcgataacaggcttatctctcgaaagaaataccaaagcctcactctaaccccaggcaaaataaacaaatactcccaaaacggcttcatcaacagacagttggtcgagactaggcaagtcatcaagctagtcgccaacatcctcaacgaccaatactccaacgacgacacaaaaataatagtggtcaaggcagcgctcaactcccagctacgtgggtttctagagctattcaagaaccggaacatcaatgactaccatcacggaatggacgcctacctctccaccttcatcggaaactacctatacaaaaagtatccaaagctacggtcctacttcgtatacggcgagttcaagaaattctcaggcaaacaaaacctcaaatcgttcaacttccttcatgacctcgaagacgactcaattaatattatatccaacgatgacggcgaaatcgtcggaaaccatcacgaaatgatagaagaactggagaaagcctaccagtataaatacatgctcgtcagccgggaagtctttgagaagacaggtgacctcttcaatgtgacagtatactcccgaaaagcgaaaaagaccctcatccccatcaaacaggacaagcccataaacatatacggcggctacagcggaaacaacgacgcatacatggctatcgtcaagctaccagggaaaaagggaaaacccgacacctacaaaatcgtgggcatacccctgaggttcgccggtgaactcgaacgtgccaaacaattaggagagtcagcataccgcgagaaactcagcgctgtcatcaccccacagttcacgaaagaaaagaaagatcgcaaaacaggtgagatcacgaaagtagtcgacgacttcgaggttgttctagaccgtgttccctataggcaactattcaaagacagcgacaaatggtttatgctaggctctgcagcgtaccaatacaacgcaaaacagctcgttcttaacaacgatgacgtcaaactcctaaacgaacaaggcagaaagaaactagaacttcccaacgaaaaactgtcctccgccctaaatgacgttttcgaccacataatacagatcatgaatagcaaattcggcttatacgacaaaaacggcttcaggacgaaactgaccgaggcagcttccatcttctacgacctcccactacgcgcggaatacaatggcaacaagaaagtcaccgacggaaaactagaggtactcgacaacatacttataggtctccacgccgatccatccttcggaaacttaaaacagctaaacatgtccacgccgttcggccaaatgcagacaaagggaggagtcgtcctcaacggtaacagcacactgatctaccagagccccaccggactattcgaacgacgcgtgaagctgaaggacctatccaaatga

SEQ ID NO: 6513 - RNA, 4059 nt, synthetic construct
  misc_feature 1..4059: note = Cas9 variant
  source 1..4059: mol_type = other RNA
atgaaaaagatcctcggcctggacctcggcaccacgtcgatcggctgggctttcatcaacgaaggtgaaaacgacaacgaaacatcctcgatcataaacgcaggcgtacgaatcgtcccgctgaccacagacgaagaagcggacttcaagaagggcaacactatcagcatcaacgcagaccgaaccttgaagcgcggcgctcgccgcggactccagcgcttcaaacaaagaagagacgcactcctacagtccttcagaggcattaactttatatcgagcaactacgtatacgcggaaaccggcaaacaaaccaccttctcctcatacaaactacgcgctaagtccgcgaccgaactcgtcaccaaggaggaattagtacaagtcctcctcatgctgaacaaaaagcgaggctacaagtcttcccgaaaagctaaaaccgcagaagaaggcgacgccatcgatggaatgaagatagcaaaggaaatctttgagaacaatctaactccgggccaatgggtatacaacagcctgagcatcgggggaaaattcattccggacttttaccgctcagacctgcagaaagaagttgaaaagatcgtccggttccaaaaccaattccacccagaacagatgaacgaaaaactcctagaaaacatccaaggcaaagcccgcactgtcacgtcccaatacttctcaaggattcttaacatcccactggccgaaaacaaagggacccgagaagaaacaaaactccaacactacaaatggcgaaatgaagccctaacagaggagctcgacctaaaagtactcgccttcatcatcaccgaaattaacaaccaaataaaccaatctaacggctacctgggagcaatctccgaccgctcgaaggaactatacttcaaccaggaaacagtcggacaattccaatacaatcaactcaaagaaaacgcccacaccaaactcaagaaccaggtcttctatcgacaagactacctggatgagttcgagaaaatctgggaaacacaaagcaaattctaccccgaactgaacgacgaactcaaaagcgaagtccgagacatcacaatcttctaccaacggaaactgaaatcccagaagcacctagtcagcttctgcgagttcgaaaagggccacaaggcgatcccaaaaagttcgcctttgttccaggaatttcgcatatggcagaacatcaataacatagtggtcaaaaacgaaacgacaaaggaacccttcctcctaggggaagacctcaaaaaggtcatcgcacaggaactctccttcaaagaatccatgaccgactcacaactacttacgttctgcgatctcaaaaagggaactcacacggtcaatttcaagaaaatagaaggcaaccgcacgaacacctcactattcaaagccttcgaaaagatcctcgtcctcgaaggctacgacgaattggatctgtccaaactcgacgcgtccgacatcaaaagcatcatcaaatcagcattctctgacctcgaaatcagcaccgccattctcgacttcgaccccacgatccaaggcaatgattacgacaaacagtcctactaccaactctggcacctactatactctagcgaagaagacgatttccttaagaagtccctcatggacaagttcggattcaaagaaagccatctgcccttcctactgaacattaatttacaagccgactatgggtccctctcagccaaggcgatcaagaaagttctaccccacctaatggacggtcacatctatgataaagcctgcacgctggtcggttataaccactccagctcactcaccactgaccaaaacaatgaacgagtcctgaaagacacactcgaactgctcaagaaaaattccctgagaaatcccgtggtagagaaaatcctaaatcagatgataaacgtaataaacgccatcataaaagaccccgccatgggaaaaccagacgaaatcagagtggagctggcccgcgagcttaaaaacaataacgaacagcggtccgagatgaccaaagcaatcaacaaatcaaccaccgaacacgaacaaatccgcaaattattacataccgagttcggaatacaccgagttacacgcaacgacatcatccgctacaagctatggaaggaatgcgacggcatttccctatacacaggcaagcctatcgagccatcaaaactcttcaccaaagactacgacatagagcacataattcccaaatcccgtctattcgacgactcgttctctaacaaaaccatctgcgaacggcaactcaacatagacaagtctaacaagaccgcctacagcttctttcaggaaaaactttccgccgaagagtttgaccagttcgaaaagcgcgttaaatcccttttcggaaagatatcccgaaccaagcaaaacaagttactgatggccaacaacgaaattcctgaaggattcatcgaccgtcaattacgcgaaacacagtatatcgctaaaaaggccaaggaaatcctcctcgaagtaagccggaacgtcaccgccacaataggtagtgtcacagacaaactgcgagacgactgggaactcgtagacgtcatgaaggaactcaactgggaaaagtacgacaaactggggctcacatacatagaggaaggcaaaaacggggaacgtctatacaaaatcaaagactggacaaagcgcaacgaccaccgtcaccacgccatggacgccattacagtcgcattcaccaaacccgcatatatccaatacctcaacaacctgaacgcccgaactaacacagacaagaaaggcaactccatcataggtatcgagaacaaatacctcaaacgagacaagaacaacaaactacgcttcatcgaaccaatccccaacttccgcgaggtagccaagaaacaactagagagcatactcataagctataaagctaagaacaaagttgtcacgaaaaacaaaaacgtcacaaagaaaagcaacggcaccaaccagaaaattcaactcacacccagaggacaactccacaaagaaacagtatacggcaaactacaacaatacgtgacaaaagaagagaaaataaatgcaaatttcacaccagaatatgtcaccaaggtcgccaagaaagaataccgagaagcactgctaaaacgactaatcgaaaacgaaaatgatcctaagaaagccttcacaggcaaaaatgctctttctaaaaatccgatctacatctcattagaaaacaacatcctagtgcccgaaaaagtaaaaatagtctggcttaaatcggactacaccatacgtaaggacatcacacccgacctcaaaatcgacaaagtcatcgacatcggactaaaaacaatactgcaaaaccgcttgaacgagttcaacggagacacaaagaaagccttcgttaacctagacgagaaccccatctggcaaaacaaagaaaaaggcatagccatcaaacgcgtcacgatatcgggagtttccaacgcccaagccctccatacgaagaaagaccaccttggcaacgagatcctagacgagaatggccaaccactccccgtcgacttcgtgtctacaggtaacaaccaccacgttgcaatataccgcgacgaaaaaggaaatctccaagaggaagtcgtcagcttcttcgaagccgtaacccgaaacaacctaggcctctctatcataaataaaaaccatgaaaaaggatgggaatttctcttcagtatgaagcaaaacgagttcttcatcttccccacggatgggttcaacccgcacgaaatcgacctgctaaacacagaaaactatcatctaatcagccgcaatatgttccgcgtacagaaaattgccaccaaaaactacatgttcaaccaccacctcgaaacaaaatccgtagatggggaaatgctgaaaaccaagaaacaactaagcaaaatatcgtaccacttcatacaaaccccctcctacctgaactacatcatcaaaatccgtatcaaccacctcggccagatcgttcagttaggagaatactga

SEQ ID NO: 6514 - RNA, 4059 nt, synthetic construct
  misc_feature 1..4059: note = Cas9 variant
  source 1..4059: mol_type = other RNA
atgaaacaagactactacataggcctagacatgggaacggagtccgtcggctgggccgtgaccgacgtcgactacaacttgatcaagaaacgcgggcaagactactggggcgtatacctgttcgacgaagctcaaaccgcccaagggagacgcgcattcagaacaaatcgacggcgcctagcccgcgtacgccaccggctgaacctgctccaggaactcttcgactcagagatcagcgcaaaagacttcggcttcttctatcggttggagaatagcaaatacttcgacgaagacaaacccgaaatcgcaagagggaagttcctgcttttcaacgacaaagacttcggagacaaagagtattacaagaactacccgaccatattccacctccggaacgccctaagaacgcaagagattaaggacgtgcgactactatacctagccgtgcaccacatcctcaagaacagaggccacttcttattcggagaacaagacttcaatgtaaacgatgcctctgacgtgtcaggggagttcgagaagatcaaccggttcctcagtgagaacgacggcgcaggcttcgaccgggagaaaatccccgaaatcttcgaaacactatgcaatgagaacctggccaaacgcgagcgcaaagagaaaatcctcgaactcgcagggaacagtaagaacaaactcctcggcgaagcggtcaatgccgtagtcggcctcaatttctcactatcgaagatgttcggtgaggacagagacttccagggagaaaataagatgtccttcaccgacagcagcttcgaagagaagctggcaaaggcacgcatggcgctggacgacgacgaagccgacttcctggaaacgctcaagaaagtccagagcgttgccagcctccataacatcctacacggcaaagagttcatatcagaagccaaaacggaggcttacgaaacgcaccgcagagacttgagcgagttgaagaaatacgtaagggaaaactgccccgaaaaatacgccctagttttccgccgccaggtaaagaagggaaagaaaaacaccagcggagcagacgaaaacgagaaagatgacaagaaagtgaacaattacgcggcctacataggtatggataaaggcaaaggcttcgaaaaatgcaagaaagaggacttctacgcattcctcaagaaagaaataggcataaacgacgagtcgctccttgcgaaaatcgacgaaggcatatttctcccgaaacaaatctcagcagaaaactgtgacattccataccaagtgcacctcgcggagctgaaagcgatcctcgcgaacgcggaaaactacttccctttcctgaagcaaaaggacgagaactgtgaaatgacagtctccgagaagatcatatccctcatgaaattccgggttccctactacgtagggcccttcaccgacaaggaaaccagattcagctggatgatcaagaaagaagggctttcgacacagaaaatcacgccctggaacttcgacgacgtagttgaccgggacgcctccgagaaaaagttcatcgagcggatgacaaacttctgcacctacctaaccggagaaaaagtgctaccagcatcgagcttcctttatagcgagtacgcattccttaacgagctcaacaatctaaaagtgaatggaacgaaagacctccgcgtcaaaaacatcctattcgacttcgccaaaacgaacaagaaattgacactaaagaaatgctgcgaacaacttgtgaaaaatggcctcctgcccgagggttccaaagcccgcgacgtattctccggaaccgacggcgacttcaaaaactccctaagcagctacatagatttcaaaaggataatcggagacaaagcagacttatatagggacatgtgcgagaaaatcatactgtggattactgtcatctcggacaaagaaagactcgtcaaaatcattaaggacaaatacggcaccgtactttccgacgaggaaataaaaggcctgaaagcacttaattacacaaagtggggccggctaagcgaaaagctgttggacggaatctttgagactgactccgaaggcgaggtcggaaacgtgtcaataatcgagaaaatgcgcaccgatactgaaaacttcatggaattgctctccaacaaacacaactacaagcgcgcaatagaactcgcaaacagcgaatcgatagttgacgagcgagtgacctaccgggccgtagaggaactgtactgcagcccggcagtgaaacgctctatttggtcagccctaaagatcgtacgagaaattgtaaaagtccaagggcactccccgaagaagatatttgtagaaacaacccgcgaaaaacccgacgtcaccagaaaaggccaacgcacagtctcccgcaaacagcaattactcgacaagtacagggaaaacctaagaaatgaaacagagctgatcaagaaaatagaagagactgaggactcaaaattcaattcggacaaactcttcttctatttcacacagatggggaaagacgcctacaccggcgaaaagattgagttcgacgacgtattcaaaacagaaaaatacgacatagaccacatatacccccgatctaaaatcaaagacgactccctcgacaaccgggtcctagtaagacggaagataaaccaatcggtcaagaaagactcctacccactatctgcggagatacggaaccgaatggaaggactctggcgtcagctgagagacaagaaactaatatccgacgaaaaattctacaggctaacccgtagcacaccgctgactgagaaagaatgcggcgactttattaacgcccaactaatcgcgacgtcccaatccgcaaaggctgcaatccagttgctaaagcgcatgctgcccgagagcgaaatcgtgtactcaaaggccggcaacgtaaacgagttcaaaaagcgcctcgaatttgtaaagatccgagaactaaacgaccttcaccacgcgaaggacgcctacttcaacatcgtcgtaggcaatgtattcaacaccaaattcaaccacaacccagccgtcttccagcgctcgaacggcacaggaaactatgatttcgaacggttatacgacttcgacataaccaacgcctggaagaaaggagacgaaaaccgcatcaggagcgtagcagagaaaaacacctgtcgagtcgtgagattcagtaaaacagagaaagggcagttctacgacgcaaccatttaccccgcagggaagaacgacaaactagctccagtcaaaggaaaagccccactaaacgacacctcaaagtatggcgggtacgacaaagagaccacggcctacttcatgctcgtaaagagccgcgacaagaaaaagaaagacaaaaccctgctcagtctagaatgtgtcaccgtcttggccgacaaaaacttccggacggctgaagacaaactaaagtattgcgaaaaagagcttggactaaaggagccagaaatactgattgagaaaataaaactcaacacacttttcaaaataaacggctcatatgcctggatccggggccgaacgaacgaccggctggtgctctgcaacgcgaaccagctttggctggacaacggtagcgcgaaagaactcaagaaaatctccaatcacttcagagatgtcaagaaatacaacaacaaagacctgcctgtacgcgaagaggagttcagcaaagaacagaacctcgccctgtacgacctgttcaccgaaaaactcggaggcaaaatatacgccggcctgcccgtacaaggccaaatcaaaaatctagaaaaaggaagagacaagttcgaagccctcgaactcaaagaccagttattcgtcctaatggaaatactcaagttcatgcaatgcaacagcatgaccagcaatattaagctcatagggggcgcagagaacgccggaaagaacagaatcagcaaactgatccaagacagcgacgtcaaaatgatattctgcagtccgaccggctacttctgtaaggtagtggacttcaaaaggttcctttga

SEQ ID NO: 6515 - RNA, 4059 nt, synthetic construct
  misc_feature 1..4059: note = Cas9 variant
  source 1..4059: mol_type = other RNA
atgaagaaaatactgggcctggacctggggaccacatccattggctgggcattcatcaaagaacccgaaaaagacgtcgttggctcggaaatagtcgacatgggggtcagaatagtacccctaagcagtgacgaagaaaacgacttcgcaaaaggcaacaccatcagcatcaacgccgacagaacgctaaaacgcggggctcgccgaaacctgcaacgcttcaaacagagacgcaatgcactactcgagatattcaaagagaagaaacttatatccacgaacttcaaatatgcagaagacgggccatccagcacgttctctacgctaaacttacgagcaaaagccgctaaagagaaaatcgaactgcaggacctggtgaaagtcctcctccagatcaacaagaaacgtgggtacaaaagttcaagaaaagccaaaagcgaagaagacgacggatcagctatcgactctatgggtatagcgaaagaactctacgaaaacgacctcacccccggacaatgggtctacgaagcactccaaaaagggcgcaaaaacgtgcccgacttctaccgatcagacctacaggaagaatttaagaaaatcgtaaactatcagtcggagttctttccggacatattcaacgcctcattcgtggaagattggatgggcaaagccagcaccccaacgaaacagtacttcaataagaaaggtgttcagcttgcagaaaataaaggcaaacgagaggagcgacgactgcaagaatacaaatggagggcagaggcggtgaacttcaaaatcgacctctcagagatagccctcatcctcagccaaatcaactcccagatcagcaattcctcaggctacctaggcgcaataagcgaccgctccaaagaactctacttcaaaaacctaacggtgggccagtatctttaccagcaaatcaagaaaaacccgcacacgcgcttgaaaggccaagtattctaccggcaagactacctggacgagttcgaacggatctggagcgtccaatcctcgttctatccacagcttaacgacgcactaaaacgcgaagtccgtgacatcacaatcttcttccaacgcaggcttaaaagccagaaacatctaatatcgaattgcgaatttgaagaccatcacaaagtagttcccaaaagccacccagtcttccaagagttccgtatatggcaaaaccttaataacttactacttatcaagaaagacaatctaaacgaaaaatttgacctcgaactcgagagtaaaatcgctctcgcaaacgaactcgccttcaaacgcgagctcaacgtcaaagacgcactgaaaatactaggcctgaagccaaacgagtgggagttcaatttcaccaagattgaaggcaacaggacgaaccaagccttctttgacgccttcgcaaagatcatcgagttagaagacggagaaccgattgatctcggtgacctaaaagccgacgatatcttggatcaattcagcgaagcgttcctgaggattgggatagatacagaattgctacaagtaaactcagatatagaaggcgcagaatacgaaaagcaaagttacatacaattctggcacctactgtactccagcgaggacgaccagaaactcaaactgaacctcatacgcaagttcggcttcaagccagaacacgccaaaatactagcctccataagcctacaagacgaccacgcctccctgagcagccgggcgatcaagaaaatactaccccatctgcaaagcggactaatctacgataaagcctgcacctacgccggctacaaccacagttcatcattcacgaaagacgaaaacgagaaacgcgagctacgcgcagaactcgaactcctcaagaaaaactcactccgaaaccccgttgtcgagaaaatcctgaaccaaatgatcaacgttgtcaatgccatcctaaaagaccccgaactcggacgtccggacgaaataagagtcgaaatggcacgcgagctcaaagccaacgccgagcaacgcaaaaacatgacaagcaacatcgccagcgccacccgagaccacgacaaataccgagaaattctaaaatctgaatttggcctaaaacgcgtgaccaagaatgacctactacgctacaaactgtggctggagaccgacggaatctcgctatacaccggaaaaccgatagaagcctcgaaactcttcagtaaggagtacgatatagaacacatcataccgaaagcacgacttttcgacgactccttttcaaacaagaccatatgtgaacggcagctcaacatagacaaagcgaacgtgaccgcgttctcgttcctccagaacaaactaagcgccgacgagttcgaacaataccaatcgcgggtcaaatcactttatggaaagctgagcaaggccaaaatccagaaactcctcatggcaaacgataaaatcccggaagatttcattgcacgccagctacaggaaacgcgctatatatctaagaaagccaaagaaatcctattcgaaataagccgacgcgtcagcgtaacgactgggaccatcacggacaaactgagagaagactggggactcgtagagattatgaaggaacttaattgggagaagtacgacaaactaggcctaacctacaccatcgaagggaaacacggggagcgcctcaacaagatcaaggactggagcaagcgcaacgaccaccggcaccacgccatggacgcactgacagtagcactaaccaagcccgcatacatacagtacctgaataacctgaacgcgaaagggctaaacaataagaaaggcaccgaggtattcgccatagaacaaaaatacctcaaacgcgaaaacgggaaactttgttttataccgcccatcgaaaacatacgttccgaggcaaagaaacatctctcgaggatcctcgtgtcctacaaagccaaaaacaaagtcgtcacgatcaacaaaaataaaacaaaaagcaaggccggcctaaacgagcaaatcgccctcacacccaggggccagcttcacaaggaaacggtatacggcaagtcatttcactacagcacgaagttcgagaaaattggagcttcctttaacgtacagaaaatcaacacagtagcaaagaaagaagaaagggaagccctcctcaagcgacttgcggaaaacggcaacgaccccaagaaagccttcactgggaaaaacaccctcaataaaatgcccatatacctcgatttgggtaaaaacataaaattaagcgagaaggtcaagacagttgtactcgaacaaaactatacaatccggaagaacatagaccccgatctaaaggtcgacaaggttatagacgtgggaataaaaagaatactcgagagtcgacttgaagagttcggaggcaacgctaagctcgcgtttagcaacctagaagaaaaccccatctggctaaacaaagagaagggaataagtatcaaaagagtcaaaatctcgggcgtcagcaacgtcgaaagcctacacgtcaagaaagaccacttcggggaaccaatcctcgaccaagagggcaacgagatcccagtcgacttcgtcagcacaggcaacaaccaccacgtagccatatacgaggacgaaaacggaaacctacaggaagaagtcgtgtccttcttcgaagcggtagtacggcaaaatcaaggactacctatcatcaagaaaaatcataccctcgggtggaaattcctattcacgctgaaacagaacgagtactttgtgttcccgagcgacgacttcgtcccagccgacgtcgacctaatggacgagcaaaactaccacctcatcagcccgaacttattcagggtccagaaaatcgcacgaaagaactacgtcttcaacaaccacctcgaaaccaaagccgtcgacaatgacctgttgaaaagcaagaaagagctatccaaaataacctaccatttctaccaaacccctgagcatctacgaggtatcattaaaatcagaatcaaccacctcggcaaaatcatccaaatcggcgaatactga

SEQ ID NO: 6516 - RNA, 4059 nt, synthetic construct
  misc_feature 1..4059: note = Cas9 variant
  source 1..4059: mol_type = other RNA
atgaacaaaaagtactacctgggcctagacatagggacaaacagcgtgggttgggcagtgacagacgaaaactataacctgtacaagtacgccggaaaacggatgtggggcatccgactgtttgaagcagccgacaccgcagccgagaggcgaatgaagagaagcaaccgcaggcgcctaagccgcaagaaacaacggatcgacctactacaagaactgttctccgaggaaatagtgaagaaagacctgaccttctttatacgcctcaacgaatcccgcctacacttcgaagacaaaagcaccggcgagaaatatcccctattcgtagacaaagaatacacagacatcgactaccacaaacaatacccgacaatgtaccacctccgaaaagagctaatcgaaaaccccgaaccacatgacatacgactggtgtacctagcatgccaccatatactaaagaaccgcgggcacttcctaatcaatggcagcataagcgacgtaaagaatctgagcttcgtttgcggagagatgataaaagagttcaacagcgtaagcgaatatgaaatcagcctcacggacatacgagaactcgagcggattctaagcgacaaaaagaccgcgaagagtgtaaaggcgaagcaagtcgcacagctctttgaatgcaccccggcagaggacaaagagcaacaaaagtgcgcgaaagccatcataaccaacctctcgaagctaatcgtcggactgaaagggaatatatcaaaaatgttccaccaacccctcgaggaaatatcaaccaaatcattcaaattcaccgaagccaaatacgaggatgaaatcatgcccgccatcgaagagaactacccagactacgcgtccgtcatagacaggataaaaggggtctacgattggagtgtacttgtagagatactcgatggcgaagattacctcagcttcgcgaaagtgaaggcctacgaaaaacacggcaaaaacctacacatcctcaagaacgtcatgaagaagtactgcaaagacgaagtctaccaggctttcttcaacgggataaatgagaaaaatggctacggaaactacataggagcgattaggaagaacggtcacacctacaagatggaccgctgcaaaagcgaggaggacttttacaaagggctacagaaaatcctatccacaatagtgcccgaccaagaagacgaggaactactagagaaactcaaggcagaggtcgaaaaccaaaccctcctacccctcgcacggtcgaaagaaaacggaacgataccgaaccaagtacatctgcaagagctcatgaaaatactagataacgccaaggaatacctggacttcctcaagaaagaagacgaatacggcacaatagccgagaaaatcatctcaatcgccaaattcaggatcccttactacgtcggccccctctcgcggcgccacaaagaagaaggtagcaacagttggatgatcagaaaggaggaaggccgcatctacccatggaatttcggagacaaagtcgacgttgaacaaagtaacaaagagttcatcgaacgaatgactaacaaatgcacatacctaataggggaagacgtgctccccaaaaactcgctgctatatagcaagtacatggtactgaacgagctaaacaacctaaaaatacggggaaacaagatcagcgtagaactcaaacagcgcatatacaaagacctgttctgcacgatggcaaaagtcacaggcaagcgcatcctggagtacctcaagatggaagacccagagatagtccaggaggacatatcaggattcgacatagactttaagtccgccctggccagctatctagatttcaagaaacaggtcgtggggaacgaaatagagaaggaccactacaaggaaataatcgaagagattataaagtggaaaacgatctacgacgacgatagcaagatgatgcgacgcatgattgaaagagaatacccagaagtattcgacaaagaacagatcaagaagatatgccagctcaagtatagcggatggggaaacttcagcgaccggttcctaaacggagtccgcggcgccgacaaagagacagaagagtcatacaccattatcgaggcactgtggaagacgaactacaacctgatgcaactactgtcgaaacaattcagcttcaaagaggaaatcgaccagataaacgccgaaaaagccggcgacgtcggcaaaataaattacgaaaacaccgtcaaagacctgatagtgtccccgagcaacaaacgcgcaatatggcagaccatacagatagccgaagaaataaagaaagtaatgaaatgcgaacccgagcgaatattcatcgagatggctcggggaggcgagaaagagaagaaaaggacggtctcgagaaaaacacgactgcaggagctttacgctggctgcaaagacgacaccagaaactggatgaaagaaatcggggaccgagaagaacgtgagttcaacagtagaaagctatacctgtactacacacagatggggaaatgcatgtacactggcgatgaaatagacgtagatgccctaatgaaggggaacagcaactgggacatagatcacatctacccacagagccgaatcaaagacgacagcctagacaatatggttctggtgcgcaaagacgtgaataacaagaaacgcaataaaatactaagcccgaaaatccgagaagacatgaaagggtactggaccatgctttgccagaagggcctcatttccaaacgcaagtacgaccgcctaacgcgaacgaccgacttcaccgatgaggaactctcagggtttatagaaaggcagctggtagagacccgccaaagctccaaagcagtggccgagctactaaaccgcctctataaagactcggaagtggtgtacgtcaaggcaggcctcgtcagcgacttccgccacgataacgacctgctcaaatcgagacgagtcaacgactaccatcacgcgaaagacgcattcctcaacatcgtagtgggcaacgtgtatcacgtgcggttcacgagcaacccgcgaaaatggatcaaggacaaccgggacagcaactacagcatacgcagagtcttcaactacgacgtaaagcaaggcgacaaaatcgtatggcacggcagtgagaacggaggacacagtatcgaccagatcaagaagataatgagccgcaatgatatattatatacggagtacacctactgcgagaagggacaactcttcaacgaaacgctggcaaagaaaggcaacgaaaaagcaatagcgttgaagaagaacctagacccagtaaaatatggcggatatacaacgccaaagacctcagccttcgccttcgtggagttcgacggcaagaaaaaggagcgaaagaaccacatcgtagagatccctgtttacgtcgttaacatcgcgaagagggaaccagacgccgtaaagaaatacctagaggagcggaaagggtactccaacgtcgtcataaagaaatacccgataaagaaaaacagtttaataaagatggacggctatctagcccggctacgcggggcaaacgagaaagacataatcctgaaaaatgccgttcaactcatcctaaacaaagacctctacgagatcgtgcgcaagatcgagaagtacttggaatataatctgcaataccaagcagatgcgaagttcgaaggattcacgatgaaagaccttaacatgatctacgaagaactctacctcaagctgaaagagagcatattccaaaaacgtccggcccagcagatgaaaacgctcgaaaaaggaaaagaagccttcatatccattgagaacctgggagaaaaagcaaaggtcataaacgaaatcatagcaatgtttaggtgcgatgccacaacagtagcaaacctcaaagtaatcaacgggagccaaaacgccgggagcatgaaagtgaacaaaaacaccctgacttcgaaaagtttaaaactggtacaccaaagcatcacgggactcttcgaaacagaagaggaactcgtttga

SEQ ID NO: 6517 - RNA, 4062 nt, synthetic construct
  misc_feature 1..4062: note = Cas9 variant
  source 1..4062: mol_type = other RNA
atgaagaagaaatactacctcggcctcgacataggcaccaactcagtcggatgggcagtcaccgacgaaaactacaacctatgcaagttcaacggcaaaaagatgtgggggatacgattgtttgaagacgcaaaaaccgccgcagaacgtaggacaaaacgcagcaaccgacggcgcatagcgagaaccaaacagcgcatagacctcttacaggaactatgcgagaaatcaatattcgaaaaagatccgaccttcttcatccggctgaacgagagttcgctacacctcgaagacaagagcaccggcgagaaatatccattgttcgtagacaaggaatatacggacatagactaccaccgagagtatccgactgtgtaccatctgcgcaaggaactaatcgagaaccccgagccgcacgacccacgtctagtatacctcgcctgttgccacatcatcaagagccggggacatttcctggttaatgggtcgatcagtgatgctaaagacctatccttcatatgcgaaaacatgataaacagcttcaacgcggcctccgactacaaaatcaacatacaggatatgaccgcactagaaacgatacttacagaccgcaagatggcaaagtccgtcaaggcaaagcaaatagtgcagctgttcaagtgcatcccctgcgaggacaaagaacagcagaagtgctgcaaagccataatcacgaacctgagcaaactaatagtcgggctcaaaggggacatcagcaaaatcttcaacgagagtttcgaagagatcaaatccttcaaattcgcggagacaaaatacgaagacgaaatactccccacgatggaggagatctacccggaccacgccgaaataatcgagaaaatcaaaagcatctacgactggtccatattagacgaaatactggacggcgaagagtacctgtcattcgccaaggtaaaggcctacgaaaaacataagaagaaccttcacgacctaaaaatactcataaagaaatactgcgacgatgaaacgtaccagtcatttttcaacggtatgaacgagaaaaacaaatacagtaactacatcggctcaatccgcaaaaacggacatacgtacaaggtggagaagtgcaaaagctccgaagacttctacaaagaactcctaaaactactatcgtcagtcaacccaggccaggaagatgaatcgctgctcgaacagataaagttcgagaccgaaaaccaaactctactgcctctactacgaacgaaggagaatggaacaatccctaaccaagtacacatgcaagaactcatcaagatactcgacaacgcaagcaaatacctagacttcctgaacgaaaaagacgaatacggaaccaccgcagacaagataatctcaatagcaaaattcaagatcccgtactacgtaggccccctctcggaccggcacaaggagaacggcagcaactcctggatggtacgcaaagaaaatgggcgaatatacccatggaacttcgacgacaaagtagacgccgagaaaagtaacaaagagttcatacagcggatgacaaacaaatgcacctacctcatcggggaagacgtcctaccaaagaacagcctcctttattcccgctacatggtcctcaacgaactcaacaacctgaagatacgcgggaacaaaatctccgtagagctgaagcaacaaatttacaatgacctattctgcaccaaggcccgtgtcacgggaaagaacatcctaaactacctgaaaaaggaagacccggaactcgcggccgaagacctaagtggcttcgacgtggacttcaagagcgcattaacatcatatctagactttaagaaacaggtcgtcggaaacgagatcgagaaagactactataaagagattatcgaagaaataatcaaatggaaaaccatctacaacgaagactccaagatgatgaaacgcatgatcggacgcgagtacccggaaacactcaaccaagaccaaattaaaaagatctgccatctaaaatacaacggatggggaaacttcagtgaaacattcctcaatggtataaagggagccaacaaagagaccggcgaatgctacacgatcatcgaggcgctctggaaaaccaactataacctcatgcaacttctgtcaaaacagttctccttcaaagaagaaattgaccaaattaacgcggagaaaaccggagcgatcggcaagattacctacgaaaatctcgtaaaagacctcgtagtcagcccagccaataagcgcgcaatctggcaaaccatacagatcaccgaagaaatcaagaaagtcatgaaatgcgagcccgaacgtatttttatagaaatggcgcgaggcggagaaaaagaaaagaaacggacggtctcacggaaaacgcgcctacaagagctatacacagggtgcaaagacgatacacgggactggatgaaagaaataggcgaccgggaagaacgagagttcagctcacgcaaactatacctatactacacccagatgggcaaatgcatgtacaccggcgaagaaatcgacgtagatctcctcatgacggccaactccaaatgggacatagaccacatctacccccagagtcgaatcaaagacgacagcttcgacaacatggtcctcgtacgcaaagacattaacaataacgtgaaagggaacaacatcgtcccctcatcgatacaaaaggaaatgacctcatactggaaaatgctccttcagaaagaattaatctccaaaaagaaatatgaaaggctaacgcgctcaacagactttactgacgaggaactatcggggttcatcgaacggcaactcgtagagactcggcaaagcagtaaagccgtggccgcactcctcaatcgtctctataaaaacagcgagattgtgtacgtaaaagcaggtctcgtatcagacttccggcatgacaacaaacttctcaaatctaggcgcattaatgactatcaccacgcaaaagacgccttcctgaacatcgtggtcggcaattgctacaggacaaaattcaccgcgaacccccgtcaatggattaagaaaaaccgggatacaaattactcaatacggagagtattcgacttcgacataaaacaaggggacaaaatcgtctggtacggcaacaaaaacgaaaacggcaaacacaccatcgaccaaatcaagaaagcgatgtccaggaacgacatcctctacaccgaatatacgtactgcgagaaagggaaactgttcgacgagacacttacgaagaaaggcaacaagaaagccattcctctcaagaaaaacctcgacccgctcaaatacggcggctacacctccgtgaaaacgtccgcattcgctttcattgagttcgacgacaaaaagaaggaacgtaaaaaccacatcgtcgaaatccccatctacgtcgcgaacatcgccaaaagagaaccagaagccgtcattaaatacctagaagaacaaaagggctatgtcaacatcgtcgttaagaaatatcccataaagaaaaactcactattgaaaatcgacggctacctagcccgcctcaggggcggcgacagctccataataacactcaaaaacgcagtccagctcgtgctagacaaaaagagctacgagattatccgcaaagtagaaaaatacctggaccacaacagcaagtatgaggcgaactccaaactagaaaagtttaacgagaacgacctaaatatcatctacaacgagctatgcctgaaactccgaaacagcatctaccaaaagcgccccgtccaccaactagagaccctggaacaaggcatcgacaacttccgtagcctcgagtccctaaaagacaaagcgaagataataaacgaactcctggcgatgttccgttgcgacgccaagaccggaatggacttgcgcctaattggaggagcaagcaattcaggcaggatgcggatcagcaagtcaagattaacaagcaaatccctgaaacttatcaaccagagcgtaacagggctgttcgagacggaagaggaactcgtctga

SEQ ID NO: 6518 - RNA, 4062 nt, synthetic construct
  misc_feature 1..4062: note = Cas9 variant
  source 1..4062: mol_type = other RNA
atggagaaaaactattacctaggcctagatatgggcacgtcaagcgtcggatgggctgtaacggatgaaaactacaacctgatgcgaaagaagggcaaggacctttggggggtacgactattcaaagaggccaagactagcgctgagcggcgcgtcaaaagaacctcccggcgccggctgcaacgcgagaaagcacgtataggctacctcaaagaactctttgcagatgaaatcaacaaagtagacgccgggttctaccagcgtatggaagactccaaattcatatcagatgacaagacagtacaccaaaaattcaccttgtttagtgacaccaactacacagacgaggactactacaacgactacccaaccatatttcatctgagaaagaagctaatagaaagcgacgacgaatacgacgtacgaatggtcttcctcgcactcctaaatatgtataaacaccgaggccacttcctcaacgcaaacctttctgacaacggcatgggagacataaacgaacaatacgaccgactcaaagagttgtgcagcgagtacctcaacgtcgaatgggaaaacaagcccgacaaattcgaggagattcttaaagagtgcaactgctcaaacagtctccggaacgagcggctgctagagacattcaacctaaagaaaaccgacaaagagaaatgcgaaatgctgaaactcatttgcggcttgagtggaacactcagcaaaatcttcaaggacctagacgacgacagcgagacgaaaaaaatgacgatctccttccgctcgagtaactacgacgaagaagccatcaacgtcgaagaaattatcggcagcgagaatttcgaaatcatagcagtactcaaagagatccacgactggagcatgctagctaacataatgcgtggcaaaaagtacctcagcgtcgcccgggtagaggagtacgagaaacacaaggacgacctcaaaatactcaagaaagtaatcaaggaatacagtattgaggagtacaataacttcttccgagtcatggccgacaacaactactcagcttacgtcaacagtgtaaacagcaacaaagaaagcacaaggcgaggggcaaagtgcgacaacgacacattcttcaaagaaatcaagaagatcgtaaacaagtgctacgactccgaagagaaagaatacatcctcaaagagatcgaaaaaggcaccttccttcccaagcaaatcatctcaagcaatggagttataccaaaccaagtacacaagatagaaatgaagaaaatcctacagaacgccgaaaaatacctccccttcctcacagagaaagacgactccggcctctccgtaagcgaacgaatcctccagatgttttcctttcaaataccctactacatcggcccaatttccggcaagatagggtccgacgagaaatcaaaaaacagctggagcgttcgcaaagaaaaagggagaatctacccatggaactttaaggacaagatcgatgagaaggagtccgccgagaaattcatcgaacgcatggtaaaccactgtacatacttgaacaacgaaatggtactgcctaaaaattcgctactttatgagaaattcatggtcctcaacgaactgaataacctaaaaataaacaacgaaaacatctccgtcgaactaaaacaaagcctatacaataatctattcaaaacgggcaagaaggtgacagccaaagggatcaagtcctacctcgagcgcaatggcctctgcgagcccaacgaggacataaatctcactgggatagatggtgacttcacgaacaggctcagtaactacgcgaaattcaagggaatcttcaacaccgacgaactgacgtacgaacaatggaacatggccgaaaaaataataaagtggtcgactatttacggcgacagcaagaaattcctcgaagagaagatccgaaacgagtactcagagaaactcgattcccaacaaatcaaacggatactgggaattaaattccgcgactggggtaggctttctgaagagctcctaaacatggaaggagcggacgttaacacgggggaaatcaaaagcgtgatcggacgcatgtgggacgaaaactacaacctcatggagctcatagctaccgacaacttcacgtacaaacaggtcatcaaagaaaagcagaacgggttagacaagagcctcagcgagatcgactacgacgacctcgacgagctctacgtaagcgccccagttaaacgcatgatctggcagaccctcctcatcatcaaagaactggtatcagtcattggctacgagcccacgcgagtatttgtagaaatggccaaagacgtaaacacggaaaagaagcgaacagactcccgcaaaaaaaaattcctcgacctatacaaacaatgcgagaaggatgaaagagacttctggataaaggaaatcgatgacaaatcagaagcagaatttcgcaaaaaaaaactctacctatactacacacagaaaggccgatgcatgtacaccggggagcaaatcaaccccctggacctaaccaacgacaacctgtacgacatcgaccacatctaccctcgacacttcgtgaaggacgactcgatagaaaataacttagtattggtcaaaaaggagaaaaacgcccacaaatcagatactttccctattgaagacgacatccgtaaaaaccaatacgccttctggaaaatgctatatgaaaaaaattttataacaaaagtcaagtaccagcgcctcacccgaaaagaaccattctcggacgaggaaaaggccaacttcatcatgaggcaaatcgtggagacacgccaaggcacaaaggtgatcaccgacatcctcgagaaaagtttcgataaaacacaaatcgtttacgtcaaggctgggaacgtcagcctcttcagacaaaaatatgaatgcatcaagtgccgcgagatcaacgacttccaccacgccaacgacgcgtacctcaacatcgtggtcggaaacgtatacgacacgaaattcacatccgatcccagaaacttcataaaagagtaccggaaaaatccccagaaaaacgaataccacatgtacaagctattcgactacaatgtccaacgaggagatcgagtcgcctggaccgcaagcaacggcgaatcaatgaaggtggttaaaggaaccctaaaaaagaacacacccctcgtaacctttatgagctacgaagaacacggcggcctctatgaccaaaacataatctccgcaaaagacatagagaaggtcaagggcaaaggttacctcccaataaagagctccgactcccgcctcaacaacaccgaaaaatacggcggatatgccaaagtcagcggcgcatatttctttgtggtcgaacacaccgtcaaaaacgtacgaataaggaccatcgagcccatgccatgctacttaaccaaggtactgaccacaaaggaaaagatagaggactactgttgtaatatactgaaatacgactcaccggtggtcaagtacgaaaaaatcaagatgtacagcctgatcaaagtaaacgggtacccgatgtacctcacaggacggaccggcaaccaactaatcgtcagtaacggcatacaactagtcttgtcctacgatgaagcaaaatacataaaagacctcctaaaaatcaatcaagaggagttcgaccaaaaccgcctcgaaaacctcggaataaacaaatttcgcaacgaaaagctttacgacaccctaaacaagaaatacactaacgagatctacaaaaagcgccccaatagcatggggaacaagatgatagaatggaaaaacacctttcagaacctttcgatcaaagaccaaaccgaagttctgctccaacttatacagctggggcaaaagcaaaactcaggcgtaaacttagaaaagcttggagcaagcaagaagaccggcgtcagcctagtgtccaaaaaaatcaccgacaaagaaagctttgagctaataaacaaatcaataacgggcctgtacgagaataaggtagacttacttcgcgtatga

SEQ ID NO: 6519 - RNA, 4062 nt, synthetic construct
  misc_feature 1..4062: note = Cas9 variant
  source 1..4062: mol_type = other RNA
atggcagccttcaaatactatctaggactcgacatggggactaactccgtaggatgggctgtaaccgatcccaattataatctcctaaaagccaaaggaaaagacctctggggaatacgggagttcaacgaagcaagcactgccgtagaaagacgcacacaccgcatctcgcggcgccgtcgtcaacgggaacaagtacgcatcggactactgaaagactacttccacgacgcgatcggcgaagtggacccagacttcttccaacgcctcgccaacagtaagtaccacctggaagataaagacaccgaagtacgctataagaacaacgtgttcaacgacgacgactacacggacaaagactactttgaccaatacccaaccatataccatcttcggaaggagctgatcgagtcaacagacaaacacgacgttcggctcgtgttcctcgccctcctcaacatgttcaaacaccgaggccacttcctcaactccggcctcggagagaactccggcgaaaacaacatcaacaatgcgtaccttgagctcaccaacctactaagtgaatttacccagtacaatcttaacgagaccatcgacgggaagaaaatcgaagatatcctcagcagacgagacatgtcacgcacgcgcaaagcagaaggactagccgaaatcctgggtgtagactacaagaacaaaccatacaaagaactcattcgcggcctctgcgggttaaagttcaacgcctgcgctatcttccccgaaatccagtccgacgaagttcccaaacttgacatatgtctttcagaagccagcttcgacgagaaatctgacgaaatagcaaacatcttaggcgaggactatttcgaaatcatcatggccatgaaggacatatacgacatcggatccctggcaggcataatgaaagggcacaactacctgagccaagcacgcgtcacgagctacgagaaacacaaggaagacttacgccttctcaaaaacgtgatacgaaagtactgctccaaagaggactacgacaacttcttcaacagcgaagccgacgggtcatacgccagctacgtgggaagctacaactccaagaccaagcagagaagagtcgggaacaaacggtccagcgaagaactctacaaggcgattaagaagatcctcaagaacgtccccgcggaggacgctgatgtccagcgtatcctcatgtcaatagagaatgagacgttcctcccaaagcaactaaccgcgtccaacggagtcatacccaaccaggttcacgccaaggagatcaagaagatcctctccaacgcagaaaggtacctcccatttctacgcgagaaggatgaaacagggctctcagtcagcgaaaagatcatgaaactcttcagcttccaaatcccgtactacgtcggacccacgacagagaaaagcagcaaagacggtggaaacggctgggtcgtgcgcaaagaagaaggtcaagttctaccatggaacatagacgagaaaatcgacatgaaggcaacaagcgaggcttttatctcgcgcatggtccgaaggtgcacctacatttccggggaacccgtcctccccaagagctctctcgaataccaatccttctgcgtgctaaacgaaataaacaacataaaaatcgacggcgaacgaatcagcgtagaactcaaacaggacatatacaaagaagtcttccaaaagggaaaacgcgtcactaagaagcagctatgcaaatacctccacacccgcggcataatagaagccgaagaacaggtcactgggatagacgtaaccataaacaacgctctaacgacatacggcaagttcaaagccatactcggggacgatatatctaaagactcagtacagaaaatggtagaaaatatcgtgttctggtgcacggtctatggcgacagcaagaaattcctaaaagacaggattgaagaaaagtatggggaaaagctcacgaaagagcaaatcaaacgaatagtaggattcaaattcaaagactggggaaacctcagcaagaacttcctcgagcttagcggcgctgacgtttccaccggcgaatcggttagcataatcagggcgctttggaacaacaacttgaacctcatggagctgatcaactcacgcctatacaactacaaagagcgcctagcagaataccagaacacaatgatgaaaacacttagcgacattgaagccgaagacttagacgagtactactttagcgcgcccgtgaagaggatgatatggcaaaccatactcatcattaaagaacttgtcaaagtacttgggtgcgaacccgatcgaatctttgtcgaaatgacccgacgacccgatgaaagaaaaatgcgcaccgagtcaagacggaaaaagttcgaggaactctataaaaaggtcaaagacgaggacgtagactggatgaaggtgatcgcgcacgccgatgaaaccgggtccataagaagcaagaaaatgtacctctacctcacacagaaaggccgatgcatgtacacagggaaacacatcgagttaagtgacctcttcaacaacaacctctacgacatagatcacgtatacccgcgacacttcgtaaaagacgacaatatagacaacaacctcgtcttagtgtgcaaagagaaaaacgcccacaaaagcgacatctaccccctcgaagacgaaatcctagccagccagaaaaacatgtggagcgaactcagacggagcgggttcatcaccgaggagaaatacaaccggctcatcggccgaaactccttcactgacgaacagaaggcaggattcatcgcccggcaactggtcgagaccagccaaggaaccaaaggcgtagcaaacatactccaacagctcctacccgagtccaagatcgtgtacgccaaagcatcaaacgtcagcgagttccgaaataccagggacatccccaagtcgagactcatcaacgagttccaccacgctcacgacgcatacctaaacatcgtcgtagggaacgtatactatgtcaaattcacccagaaccccctaaatttcataaagaacgactacgaccgtgacaaaacgaagaacaactacaaccttagtaagatgttcgactgggacgtcgagagaaacggcgaggtagcctggatagcgcagaaaaaggacggcgaagccggcaccatcgcgacagtaaagaaagtcctcgggcgcaacacccctctcatgactcgatactcattcgagggaaaaggaggcctaacaaacgagacattatacagtgccaagaaagcaaaagaggaagggtatatacccttcaagtcttcagacgaaaagatgaaagacgtaacaaagtacggaggcttcacatcagtaacaggcgcctacttcttcttagtcgagcacacagaaaagaagaaaagaagccgcatgatagaaagcgtccccctgtacctcgcgcaaaagatagagcaaaatccacacgagctcgaaaagtactgcgaacaagtactgggcctcatcgactttgatatccgcgtccggaaaatcaaaatagggagcctcataaaacggaagggatacttcttctacataacaggcaagacagggcaccgtctcatactgcgaaacgccgtgaacatgtgcctgaaaaaggaatgggtgaaatacatatcaaaactagagaaagcggtcgacaagaacaacgtagaaggaattataacgaaggagaaaaatgaactcctgtactccgaactaattgaaaaattcaagaatagcatcttcagcaatagacccaatcccgtcggagacaagctcgacgaagctaaggaaaagttcatcaacctggacatagagaaacaatgtatcgtcctatgccaaatcctccagctctcctccgttctaggcagcgagtgcgacatgaccttactcggcgaatccgcccactgcggaaaaatcctaatatcgaagaaaatcggcgatgaagacatatacctaatcaaccaaagcgtcactggcctgtatgagaagaaaatcaacctacgtaccgtctga

SEQ ID NO: 6520 - RNA, 4065 nt, synthetic construct
  misc_feature 1..4065: note = Cas9 variant
  source 1..4065: mol_type = other RNA
atgaaaaagatcctcggactagacctaggaaccaactcaatcggctgggcgttcatcaacgaggccgagaatgaaatagaagtgtcctctatagtcaacacgggagtccggatcgtccccctaaccacggacgaggaaagcgacttcaagaaagggaacacgatctcaataaacgcagaccgcacactaaagcgaggcgcccgccgcggcctccaaagatttaaacaacgacgggaagccttactagaaacattcaaccgcattaaattcatagcgactgacttcgtttacgccgaaacaggcgcagcaacgacgttctcgagttaccaactccgagcaaaatccgccgtggaagctgtgactaaagaggagctagtcaaagtccttcttatgctaaacaagaagcgaggttacaaaagttcacgaaaagccaaaaccgcagaagagggcgacgccattgacggcatgaaaatcgcaaaagagatcttcgagaacaacttgacaccaggccaatgggtgtacaactcgctcagcaagggcggaaaattcatccccgacttctaccacagtgacttgcagaaagaactcgaaaagatagtacgattccagaatcagttccactccgaacaaatcaacgacaaactcctagcagacatccaaggcaagtcccgaacacagaccagccagcacttttctaaaaccctgaacatcccgctcgcagagaacaaagggacacgagaagaaacaaaactccagcactaccaatggagaaatgaagccctagcgaacgaactcgacatgaagatactagcatttatcatcactgaaatcaacaaccagatcaaccaaagctcaggatacctcggcgcaataagcgaccgctccaaagaactgtacttcaaccaagaaacagtgggccaatatcaatacaaacaactccaagaaaacgtccatgccaaattaaagaaccaagtcttctatcgtcaagactacctagacgaatttgaaaagatatgggaaacccaggcaaaattccactcagaactcaacgaaaaattaaaagcagaaataagagacatcaccatattctaccaacgaaagctgaaatcgcagaaacacctagtctccttctgcgaatttgaaaaaggacacaaagcaatcccaaagtcatcgcccctattccaagagttccgtatttggcaaaacctcaacaatgtagtcgtgaaaaacgaaaccaccaaagaggtcttcgagctttcagaggaactaaaacaactaatcgcggaggaactccagttcaaagaaagcatgaccgacgtccagatgctgacattctgcgaactgaaaaagggaacccacaccgtgaacttcaagaaaatagaaggaaaccgcaccaacacaagcatttacaaagcattcgagaaaatcctagaagtggaagggtacgaaatcgacttctccaaaatgaaacccctagaaatcaaagaaaccgtcgcaccgatcttcgaaacactgaacataaacacggtaatcctcgacttcgaccccacaatacaaggcaatgacttcgacaagcaaccatactaccagttatggcacctattatactccgcagaagacgacgacaaactaaaggaaacacttaagaccaaattcggattcaaagaaaaccacctcccctttatacttaacatcaatctccaagccgactacgggtccctttccgcaaaagccatcaaaaagatcctgccccacctaatggacggacacatatacgacaaagcatgcctgatggtcggttataaccatagcagcagcttaaccacagcccaaaacaacgatcgcgtcttaaaagacaccctcgaactgctaaagaaaaattcgctcaggaaccccgtcgtcgagaaaatactcaaccaaatgatcaacgtcatcaacgctataatgaaagacccggccatgggcaaacccgacgagatccgggtcgaactggcccgggagctaaaggccaacaacgaacaaagaaagaaagccaccagcgacataaacacggcgacaaccgaacacgaaaggatccgcaagctgctccacagtgagttcaacatcccgcgcgtgacgagaaacgacataatccgctacaagctatggcttgaaaccggaggaatctccctatacaccgggaacccaataaaagcctccgacctattcagcaagaattacgacatcgaacacataattcctaagagcagacttttcgacgacagcttctccaacaagacgctatgtgaaaggcaactgaacatagacaaaagcaacaagaccgcctactctttcctacaggaaaaactaagcgagaacgactttgctgcatatgagaaccgcgttaaggaccttttcaagacgggcaagataaaaagctacaccaagtacaagaaattgctcatggccgacaacgaaatcccggagggcttcatcgacagacaactacgagaaacccagtacatcgccaagaaagccaaagagatcctgctagaagtgagccgcaacgttacggcaacaatcggcagtgtgacggataagctgcgccaggactgggaacttgtcgatgtaatgaaggagctcaactgggaaaagtacgacaaacttggactgacccacatagaagaaggcaaaaacggagagagactctcaaaaataaaagactggaccaagagaaatgaccaccgacaccacgcgatggatgcaatcaccgtagcgttcacaaaaccggcctatatccaatacctgaacaacctaaacgccaaaacacagggagaaaacaaggccaatagtataattgggatcgaaaacaaacatctgtatcgcgacaagaacaacaaactacgcttcataagcccgatgaaaaatttccgggaggaggcgaagaaacagctagagtcgatcctgattagctacaaggccaaaaacaaggtcgtcaccaagaacaaaaacacaaccaagaaaagcggaggcaccaaccagaaaatacaactcacgccccgaggccgactccacaaggaaacggtctatggcaaactacagcagtacgccacaaaggaagagaaagtcaacgcttcattcacagaagattacatccagaaagtcgccaagaaagaataccgggaggcactattgaaacgcctagaggagaacgacaacgaccctaagaaagcgttcaccggcaaaaacgcgctcaacaaaaccccaatatacatcagcctcaaagacaacatcatcgtccccgaaaaagtcaaaacagtctggctcgaaaccgattacaccatccgaaaagacataacgccagatctcaagattgacaaggtaatagacgtaggaatcaaacgcatcctccaaaaccgtctcaacgagttcaacggagatcccaagaaagccttcgtcaacctcggagaatcccctatatggctcaataaagaaaaaggcatcgcgatcaaacgggtcaccatctccggagtctcaaacgctcaagccctccacacaaagaaagatcatctgggaaacgaaatcctcgacaaaaacggcaacccaatccccgtcgacttcattagcacgggtaacaatcaccacgtggccatctaccgcgacgaaaaaggcaacctccaagaggaagtagtgtcattttacgacgccgtaatccgccgcaacttaggactcagcgtcatcaacaaaaaccacgaaaaagggtgggagtttctgttctctatgaaacaaaacgagttctttatattccctagcgacggcttcaacccccacgaaatagatctcctaaacccaaacaactaccacctcatatcacctaacatcttccgagttcagaaaatcagcacgaaaaactacatgttcaaccaccatctcgaaactaaagccgtggatggggaaatgctcaagtccaaaaaggaactatcaaaaacatcatatcacttcatccaaacccccacaaacctgaacggcatcataaaagtccgcattaaccaccttggaaagatcgtccacctgggagagtactga

SEQ ID NO: 6521 - RNA, 4065 nt, synthetic construct
  misc_feature 1..4065: note = Cas9 variant
  source 1..4065: mol_type = other RNA
atgaagaaaatcctgggactagatctcggcacaaactccatcggttgggcattcataaacgaagccgaaaacgaaatcgaagtaagctcgatagtcaacaccggcgtccgcatagtcccgctaacaaccgacgaagaatccgactttaagaaaggcaacaccataagcattaacgctgaccgcaccctaaaacgcggagctcgtcggggcctccagcggtttaagcagcggcgcgaggcgctgctagagacattcaaccgcatcaaattcatagccaccgacttcgtctacgccgaaaccggcgccgcgacaactttttcctcataccaactgcgcgcaaaatcagctgtcgaggccgtaacgaaagaggagctagtcaaagtcctgctgatgctaaacaagaagcgcggttacaaaagctcccgtaaggccaaaacagcagaagagggcgacgccatagacggaatgaaaatcgccaaagaaatcttcgaaaacaacttaaccccaggccagtgggtatacaacagcttatccaaagggggaaaattcatccccgacttttaccactcggatctccaaaaagaactagaaaagatcgtcaggtttcagaaccagttccactcggaacaaattaacgacaagctactcgcggacatccaaggaaaatcgcgcacccagacctcacaacacttctccaagacgctcaacatacccctggcagaaaacaaaggtacacgcgaggagacaaaactacagcactaccagtggcgcaacgaagccctcgcaaatgagttagacatgaagatactggcgttcataataaccgaaattaacaaccaaatcaaccagagctcaggctacctgggagcaatcagcgaccgctccaaggaactgtacttcaaccaagagacggtcggccaataccaatacaaacagctccaagaaaacgtccacgcgaaactcaaaaatcaggtattctacagacaggactatctcgacgagttcgaaaagatttgggaaacgcaagccaaattccactccgaactcaacgaaaaactcaaggccgaaatacgagacatcacgatattctaccaacgaaaactaaagagtcagaagcacttggtctccttttgcgagttcgaaaagggtcacaaagccatccctaaaagctctccactcttccaggagttccgtatctggcaaaacctgaacaacgtcgtcgtcaaaaatgagaccaccaaagaagtattcgaactctcagaggaactcaagcaactcatcgccgaggaactacagtttaaagagagtatgacggacgttcaaatgctcacgttctgcgaactcaagaaaggaacccacaccgtcaactttaagaaaatcgaagggaaccgaaccaatacctgcatctacaaagccttcgagaaaatcctcgaagttgaaggctacgaaatggacttctccaaaatgaaacccctcgagatcaaggagacggtcgcccccatcttcgaaacactaaacataaacaccgtgatactagacttcgacccaagcatacaagggaacgattttgacaaacaaccatactaccaactctggcacctcctttactcggccgaggacgacgacaagctcaaagaaacactcaaaaccaaattcggcttcaaagaaaaccatctgccattcctcctcaacatcaacctgcaagcagactatggatcactctctgcgaaggccattaaaaagatcttaccccatctaatggacggccatatctacgataaagcctgcctcatggtcgggtacaatcactcctcgagcctgaccaccgcgcagaacaatgaccgtgttctcaaagacacacttgaactcctcaagaaaaattccctccgcaaccccgtagtggagaaaatcctcaaccaaatgatcaacgtcattaatgcgataatgaaagatccagctatgggtaagcccgacgaaatacgagtagaactcgcccgcgagctcaaagccaacaacgaacaacgcaagaaagccacctcggatatcaacaccgccacgacggaacacgaaagaatacggaaactactacactccgagtttaatatccctcgtgtaacacgtaacgacattatccggtataaactctggctagagactggcggcatatcactgtacaccggcaacccaataaaaggcagcgacctattcagcaaggattacgacattgaacacataatcccaaaaagccgattattcgacgactcattcagcaacaaaacactatgcgaaaggcagctaaacatcgacaaaagtaataagactgcctactcattccttcaagaaaaactatccgaaaacgactttgccgcctacgaaaatcgagttaaagacctcttcaagaccggaaaaatcaaatcctacacaaaatacaaaaagctactcatggcagacaacgaaatacccgagggcttcatagaccgccaactccgagaaacacaatacatagcgaagaaagccaaagaaattctcctcgaggtctcacgcaacgttaccgccaccattggctccgttacggacaaactccgtgaggactgggagctagtcgatgtcatgaaagaactgaactgggagaaatacgacaagctaggtctcactcacatagaagagggcaagaacggcgaacgactctcgaaaataaaggactggacaaaaaggaacgaccatagacaccacgccatggacgcaatcacagtggcgttcaccaaaccagcctacatccagtaccttaacaacctcaatgccaaaacacaaggagagaacaaagccaactcgataataggcatcgagaacaaacacctctaccgagataaaaataacaaactccggttcatatcccccatgaaaaatttcagagaagaggccaagaaacaactagaaagcatcttaatctcttacaaagccaaaaacaaggtcgtcacaaagaacaaaaacaccaccaagaaatccgggggcaccaaccaaaagatccaactaactccgcgcggaagactacacaaagaaacggtctacggcaagctacaacaatacgccactaaggaagagaaggtgaacgcttccttcaccgaagactacatacaaaaagtagcaaagaaagaatatagagaggcccttcttaaacgattagaagaaaacgacaacgaccccaagaaagccttcacgggtaaaaatgctctaaacaaaaccccgatttacatctccttaaaagacaacataatcgtgcccgaaaaagtcaaaaccgtctggttagaaaccgactatacgatccgcaaagacataacccccgacctaaaaatcgacaaagtcatcgatgtcggcataaaacgcatcctccagaatagactcaacgagttcaacggagacccaaagaaagcattcgtcaatctcggggaatcacccatatggttaaataaagaaaaaggcatcgccataaaacgagtcacaatatcaggagtaagcaacgcacaagctctacacacgaagaaagatcacctagggaacgaaatactcgacaaaaatggaaaccccataccagtcgatttcatcagcacgggcaacaaccaccacgtcgccatataccgtgatgagaaaggcaacctacaagaagaagtagtcagcttctacgacgcggtaattcggcgaaacctggaactctctgtgatcaacaagaaccatgaaaaaggttgggagttcctattctcgatgaagcaaaacgagttctttatcttcccctcagacgggttcaacccccacgaaatcgacctcctgaatcccaacaactaccacctcatatcgccaaacatcttccgcgtccagaaaatcagcaccaagaactacatgttcaaccaccacctcgaaacgaaagcagtagacggggaaatgctaaaatccaaaaaggaactcagcaaaacctcctaccactttatacaaaccccaacgaacctgaacggcatcatcaaagtccggataaatcatctcggcaaaatcgttcacttaggcgaatactga

SEQ ID NO: 6522 - RNA, 4065 nt, synthetic construct
  misc_feature 1..4065: note = Cas9 variant
  source 1..4065: mol_type = other RNA
atggccgacttcgccaaataccagcccggaatggtagccgacggccgcaaaatccccctagactggaccctctactacctccggaaaaaggcgctaacccaagcgatacgcaaagaagaattagcatggatcctactcaatttcaaccaaaaacgcggatattaccaactgagaggggaggaagaagaagaaaacagcacaaagcatgaggaatactacgaactgaaagtagtaagcgtcgaagccgccgaagaaggcaaagggggaaacacttggtacaacgtaaccctggaaaacggatggatataccggcgtcagtctaaaatcgagcttaacgactgggtaggcaaagtacgccccttcatagtgacaacagaatacgagattgacggcgtcaccatcaagaaggacaaaaacggtgaggtcaaacgcagcttcagggccccgtcagagaacgactgggggctaaggaagaaacgcaccgagtctctcctcgaggaatccgggaaaacagtaggcgcattcatatacaaccatatcctaagcgaaccagcagataaaatccgaggcaacttcatccggacaattgaacgaaagttctacaagaaagaactcgaagcgatactgcgagaacagtcaaaacaccagaaggaactgaaagacatagacacccttattgcctgcatcaaggaattataccccaacaacaaaccacaccaggattcgttgatcaagaaagacatgacctacctcctcatcacagacctaatattctaccaaagacctctcaaatcaaagaagtcactaatagcggactgcccatatgaatactacgaatacgtgataaaagagactggagaaaacaagagacaatccatcaagtgcatcgcaaagtcaaacccctactaccaagagttccggctatggcaatttataataaaccttcgtctcttcgaccgcaacaacgacaaggaagtaacctctgagtacctatccagtatggaggactacactagactattcacctacctcaacgatagaaaggacatcaaccaggaaacactcctgaaggactttttcaaacagaaaaaggtgaaacgcgggatggaaaaggagttccccatccgatggaactacatagaagataaagagaagaaatacccatgtaacgagacgcgacacgagctcctaaccgcgctcggaaaagtagggatcgatcattcttggctagacgacaaagaactgttttaccgattatggcacctcctgtactcagtcgaaagcaaagaggaagctgagggtgcacttcggaaactcgtcgacaacgacgacttcgtgaatgccttccttaaaataaaacccttcaaaaaggaatacggggcgtacagcgaaaaagccatcaagaaacttctcgccgtcatgcggatgggaaacctgtggaacgaagtggacatctgcgagcaaactcgagaccgaatacagaacataatcaagggagacatagatgagaagatcaaggacaggatgggaagaacattctcgcaactttccgatttccagggactcccagaatggctagcgtgctacgtagtatacggtcaacactccgaagccaccgacatccagaggtggaccaagcccgaaaaccttatggcctacatcaacggattcaaacaacactcactccgaaatccaatagtcgaacaatgcattctcgagaccctccggacggtccacgacatctggaaagaagcaggacacatagatgagatccacatcgaactaggacgcggcatgaagtcgaccgcggaccagcgagcccggatgagcaaatcaataatgcaaaacgaaaacacaaaccttaggatcaaatccctactcatggagctcaaaaatgcaaaagagttcgaaaatgtaagaccgtactcacccatgcagcaagaaatcctgcgtatctacgaagaaggagccctccaagaactcaccaaggaagacgcccaatacaatgaaatcagcaaaattagccaaatggcacagccttctgccaacgaactactcaaataccggctctggcttgaacaaaaatactgcagtccgtacaccggaaaacccatctccctcagcaaacttttcaccagcgcataccagatagaacacatcatcccacagagtcggtacttcgacgactccttcaccaacaaagtaatctgcgaagcagaagtgaaccaactcaagagcaacatgctgggctatgagttcataaagaaacacggcggtgaaatcgtccgctgcacaatgatcggagacgtcaaactcttagacgcgaaagaatactataacttcgtaacagagcattacacaaacaaccgccgaaagaaagaaaaactactgatggaggacatcccacaagagttcctaaaccgccaaatgaacgattcccgctacataagcaaaaaggtaatggcaatcctcagcaatatcgtaagggaagaagacgagcaggaagccaaaagcaaattcgtcatagcatgctccggcggtatcaccgaccgattaaaacaagactggggactgaacgacgtatggaactccatcgtctacccccgattcgagcgcctaaacaagctcaccaatacagagaatttcggacgctgggaaaacaaaaagggcaagcaggtattccaaacaagcgtcccactcgaactccagaaagatttcagcaaaaagcgaatagaccaccgtcaccatgcaatggatgctctcgtaatcgcatgcgcgtcgaacaacatcataaactacctgaacaacgagagcgcgaaaagccaggagaaaagagaagacctgcggaagaaactctgcgacaagaaccgaatcatccgcaaaccctgggaaacattcactcaagacgctcacaccgccctagaaaacgtggtcgtctcgttcaaaaactacattcgtgtcatcaacaaagcaacaaactactacgaaaagtatgacaaaaacggcaagaaagaaatagcggagcagaaaggacaagacatgtgggctatccgcaaaccaatgcacaaagaaacggtcttcggacaggtcaacctgcgccgcaaaatcaccataaaactaaaagacgccctggagaaaatcccagcgatctgcgacaaggaacttcgagactacatcaatatactcgtagcaaaacaattcaacaagaagcagatacttgcccacttcaaatccataaactatcgcctaaacatgaaatcggtggataaagtggacgtctggcaattcagcaacgaaaaagaaccaatggtcgcgacgcgtaagtctgtagacacctccttcgacacaaagcgcatcgcaacgataacagacacgggcatacagaaaatcctgctaaactacctcaaggcgaaaaacaacgaccccaacatcgccttcacccccgaggggatcgccgaaatgaacaaacacatcacggaatacaacaacggcaagcagcaccaaccaatcctaaaagtccgggtcagtgaacccaagggcgctaaataccaggtcggggaaacaggcaacaagagatcaaaatttgtcgaagcccagaaagggacaaacctctacttcgccatctacgaggacaaagaagggaacaggagctataacaccatccctctcaatgaagtcattgagcgactcaaacaagggctgagccccgtccctgacgcgaacgagaaaagcatcccactgaaattccacctctcgcccaacgacctcgtgtacgtccccaaaacggacgaagaaaatgaaatcaagatgggccaaatctacaaattcgtggacagcagcgggactactgctaatttcgtgccccacagagtcagcaaccttatatacaacgtagacaagaaaatcgcagaaaacttctgtaaccatgaaatcatacagaatgagtacggaataggatcaccccaaagcaaaaaccaaaagagcataaccggcgaaatgataaaagcagtctgctggaagctcgaagtagaccgcctaggcaacatccacaagatcatcaagtga

SEQ ID NO: 6523 - RNA, 4065 nt, synthetic construct
  misc_feature 1..4065: note = Cas9 variant
  source 1..4065: mol_type = other RNA
atgaagaaaatcctcggccttgacttaggcaccacctctattggctgggcgttcatcaaagaacccgaaaaagatgtcgtaggatcggagatcgtagacatgggagtgcggatcgtccccctaagctccgacgaagaaaatgatttcgcaaaaggaaacacaatctccataaacgccgaccgcactctgaaacgcggcgcacgacgcaacctgcaacgattcaaacaaagacgaaacgcccttctagaaaccttcaaggagaaaaacctgataccctctaactttcagtacgcagaggacggtccaagcagcacattcagcaccttaaaactacgggacaaagcggccaaggagaaaatcgagttagacgacttcgtcaaagtgctactacagatcaacaaaaagcgcgggtacaaatcctcccggaaagcaatgtccgaagaagacgaaggaacagcaatcgacagcatggggatcgccaaggagctatacgaaaacgacctcactcccggccaatgggtctacgaagccctcaagaacgggcgtaagaacgtcccagacttctaccggagtgatctgcaggaggagttcaagaaaatagtaaactaccaaagtgagttctaccccgacatcctcaacacctcgttcgttgaagactggatgggcaaggcgagtaccccaaccaagcagtatttcaacaaaaggggagtgcaactcgcggaaaacaaagggaaacgcgaagaaagacgtctccaggagtacaaatggcgagccgaagccgtaaacttcaaaatagatctatcagaaattgcactcatcctaagccaaattaacagccagatctccaactcaagcggctacctaggagccataagtgaccgctccaaagaactctacttcaaaaatctgacagtcggacaatacctgtaccaacaagtgaagaaaaacccgcacacaagactcaaaggccaagtattctaccgtcaagactatctagacgaatttgaaaagatctggagcgtgcagtcgagcttctacccgcaactgaacgacgaacttaaacaagaagtccgcgacgtcaccatcttcttccaaagacgactcaaatcacaaaaacacctaataagcaactgcgagttcgaagaacaccacaaagtcgtgcccaaaagccaccctatcttccaggagttcaggatatggcagaacttaaacaacctgacactcattaagaaagacaacctaaacgaaaaatgcgaactagcgctagaagataaaacagccctcgccaacgagctagccttcaaaaaggaactatcggttaaagacgcgctcaaggtcttggggttaaaacccagcgactgggagttcaatttcacgaaaatcgaaggcaatagaacgaatcacgccttcttcgaagccttcgcgaaaataatagaactcgaagacggcgagccgatagacctcgggaacctaaaagcggacgacatccttgaccaattctccgaagcattcctacgaatcggcatagacacagaactcttgcaagtaaactccgacatcgaaggcgccgagtatgagaaacagtcatacatccaattctggcaccttctctactcaagcgaagacgaccagaagctcaaacaaaacctcattcgcaaattcgggttcaaaccagaacacgcaaaaatcctagcgagcatctcactccaagacgaccacgcctctctctcgtctcgggccatcaaaaagatccttccgcacttacagagcggactcatatacgacaaggcctgcacctacgctgggtataaccacagctccagcttcaccaaagatgaaaacgaaaaacgcgaactaagagccgaactcgaactactgaagaaaaactccctacgaaaccccgtggtagagaaaatcctgaaccaaatgatcaacgtcgtcaacgcgatcctaaaagacccaaacctcggacgacccgacgaaatcagggtcgagatggcgcgcgagctcaaggcgaacgcagaacaacggaaaaatatgaccagtaacatcgcctccgccacaagggaccacgaaaaatatagagagatactcaagaaagagttcggactaaaacgagtaacgaaaaacgacctactccgctacaaattgtggctcgagacagacggcatcagcctctacaccggcaagccaatcgaagcctccaaattgttctctaaagaatacgatatcgagcacatcatacccaaggcacgcctcttcgatgacagcttcagtaacaagacaatatgcgaacggcagctcaacatagacaaggcaaacgtgaccgccttctcattcctacaaaacaaattatccgccgacgagttcgaacaataccagagtcgggtcaaatctctctacggcaaactctctaaggccaaaatccagaaactacttatggccaacgacaaaatcccagaagacttcatcgcacgccaactgcaggagacacgctacatcagcaaaaaggccaaagaaatcctattcgaaataacgatgcgagtatcagtaacaaccggaacgatcacagacaagctacgggaggactggggcctagtcgagataatgaaagagctcaattgggaaaaatatgacaaacttggactaacttacacgatagaaggaaaacatggcgagcgcctaaacaagatcaaggattggaacaaacgcaatgatcatcgacaccacgccatggacgccctgaccgtggcacttaccaagccggcctacatacaatatttaaataacttgaacgccaaggctattggaaacaaaaagggcacagaaatctttgccatcgagcaaaaatacctcaaacgagaaaacggaaaactatgcttcataccgcccatagaaaacatcagagcagaggccaagaaacatctgagtaaaatcctcgtatcttataaagccaaaaacaaggtcgtcacgatcaacaaaaacaaaacaaagaagaaagcaggtttcaacgagcagacggccctcacaccgcgcggccagttgcacaaagaaaccgtgtacggcaagagctttcactacagcacaaaattcgagaaaatcggggccagcttcgacgcccagaaaattaacaccgtcgcgaagaaagaagaacgagaggcattactaaaacgactcgcagaaaacggcaacgaccctaagaaagcattcacaggcaaaaattcgctaaacaaaatgcccatctacctggacctcggcaaaaacatcaaactatccgaaaaagtgaaaaccgtagtcctggaacaaaactacacgatccggaaaaacatcgaccccgacttgaaagtcgacaaagtgatagacgtcggaatcaaacgaatcctagaaagtcgtctcgaggagttcggagggaatgccaaactggcattttcaaatctcgaagaaaaccccatctggctaaacaaagaaaaagggatccccataaagagagtaaagatatccggcgtaagcaacgttgaatcccttcacgtaaagaaggaccatttcggtgagaaaatcctggacgaggagggaaacgagatcccagtcgactttgtgagcacaggcaataaccatcacgtcgcaatctacgaagacgaagatgggaatcttcaagacgaagtagtaaacttctacgaagccgtcatacgccgcaatcaaggagaatcgataatcaaatataggcacgaagaaggatggaacttcctatacagcatcaaacaaaacgagttcttcgtgttccctagccaagacttcaaccccaacgactttgacctattagatcccaagaactacgacctcatatcaccgaacttataccgtgctcagaaatttagcaaagtcatgtacgggaactcagcagtacgagattacgttttccgccaccatctggaaacagtgctaaacgacgtgaaagagcttaaagacgtggcgtataaacaactaaagtcactacaatatctaaatggcataaagaaagtccgactcaaccacctcggacagatcatccaagttggtgaatactga

SEQ ID NO: 6524 - RNA, 4065 nt, synthetic construct
  misc_feature 1..4065: note = Cas9 variant
  source 1..4065: mol_type = other RNA
atgacactccactacaacgtcggcctagacatcggcaccaatagcgtcggctacacaatcgtagacgacaacggcaaaatcctacaagtaaaaggaaagaatggctacggagtaagagtcttcaaagagggcgcgaccgcagcagaacgccgcattttccgaaccacacaccgacggctcaagaggcgaaaatggcggcttcggctgcttcaggacttcttcgaaccctacatactgccacaggacgacggtttcttcatccgccgtaaggaaagtaacctagtgctaaacgaccgcgacgaagacacagccagtctattcaacgatcgctccgaccgcgatttctaccaggcctaccccacgatctaccacctacgccaagccctcatgaccgaaaaacggcaattcgacgtccgcgagatctacctcgccatgcaccatatcataaaatacaggggacacttcctactcaacggcaccgtcaataactttacaaacaacaagatcgatctacatagcgactttgaagaactaaacgcacttctactaaacgttatccccgaactaaaattccaaatcgacctcgatcacagcacaatgttccaaaccaccctactgaacaccaccatcagcagatcaggtcgacaacgcgacctcgtaaagtccttctacaatggctcagacgataagcagttagcaaaacaacaaaaatctgttgctacggagctcttaaaagctatcctcggcctgaaggcaaagttccataagctatttaaccttgatctcctcgaaaccacggagtgggagttctcattcgacgccgaagacatcgacgataaactcgcaaaactggaacctctgatgaccgaaaaccagcaacaggtgatggacatactccagagaattttcgcagcgataacgctcaacggcatcgttccagaagggaaaacactcagcgcaagcaaggttgacagctaccagaaacacaaacaagacctcaaacttctaaaagcaatagcccaacactccgacaagaaaacagccaccgtactgcagaccgcatataacgaatacatcaatggcatcgccagcaaacccctcaagcaggaggacttctacaagaggcttaccaacgcagttaaaaagagctccgacccacaagtcgcagacatgctcgcactaattgaccaggagaaattcctacctaaacagcgcactaaagagaacggcgccatcccccaccaactacaccagctcgagctcgaaagaataatcgacaaccaaaaggactactatccctggctagcagaattaaaccccaatcaagcccgacagaaagtagcaaagtacaaactatccgaactcgtagcattccgggtcccatactacgtcggacccctcattgaacccgaagtccaacaagcaactagcaacgcacatttcgcatggatggcccgcaaagaggcgggccccataacaccatggaactttgaccaaaaagttgacaggaacgtctcagccgaacgattcatcaaacgaatgaccacaaaagacacttaccttctcgccgaagacgtcctgccactccactcactcctataccaacgattcatagtcttaaacgaactaaacaatgtacgggtaaacggccaaaaactcaccaagaaacaaaaacaagccgtataccaagacctgttcaagaggcaaccgcatgtcaccaagaaacaatttaagtcctacctagtccaaaccggagagttcgcggaatcctccaaaatagagggactagcaaatgaaacatccttcaactccggcctgactaccgaaaacgaactacgtaagatatttggcgcccaattagacgaggctcgctaccaagtggatttcgaacaaatcatcgaatgggcgaccctcttcgaagacgcaaaaatcctccgcacaaaactcgccgaaatcacctggttaaccacagaacaaatagaaaaactagccggcatccggtaccgtggctggggacgcttctcacgcaaacttctcgcgggcctaagagaccaaaacggccaacagatcatagacctactctgggacaccccaaacaacttcatggtaatcgtttcgcaagcggcattctcagaggccataaccaaagagaacgaaaagctgattgaccgacggggtgcacaagacgtaataactgacctatacactagcccccaaaataagaaagccctccgtcaggtactagcgatcgtagccgacgtccaaaaggccatgggaggcgtaccgccccaacgcatctttattgagttcgcccgagaggacgaaaagaatccgcgtcgttccgtcgaacgctccagacaattagaaaagctctaccaaaccatctctaacgagttcctcataaacagcgaagttcgacaagagctcaaggaagcagtcgaccaaaaagtcaacttcaaggaccgactctttctctacttcctccagggcggcgtggacctctactccgggaaacggataaacattgaccaactaagccactacgacatagaccatatcctgccccaatccttcataaaagacgactccctcgacaacagagtactcgtttctcaaaaactcaaccgatcaaagtccgactccgttcccctctcagagttcgctaactacaaattcggaccggccatgcaagccaaatggctccaactaaaggaagccggtctcttaagtaaaagaaagtacgacaaccttaccctggacccaaccaaactcagcaaattcgcgccactaggattcgttaatagacaactcgtcgaaactagacaggtgatcaaactggcagctaacctcctcgcctccgaagaaacaaaggtagtcaccattaaagcaaacatgactcatcaagtccgcaaggaactagacttcccaaagaacagaaatgtgaacaactaccaccatgcatttgacgcatacctaaccgctttcgtaggcatattcttgagcaaacgctaccctaaactgaagccctacttcacatacggtgacttccaaaagggaaacaaactcccagacctcaaaaacttcaacttcttatacgaactgaaaaataaggaccgatcaattgactccaacacaggcgagataatctgggacaagcagcgagaccttgcctacatgaataaaatctacaatttcaagaaagttaccgtagtacacgaggtgttaactaaaagcggtgccctgtacaatcaaactctgtacaaggccagcgaagacaaagcctctggccgagggaccaaacaattgatccgcaagaaagacaacatgccaaccgaactctacggcggatacacaggatctacatcagctttcatgagcatcgtacgcttatggaagaaagacaaaccctattacaaagtcgtcggaatccccacccgcatggctgccaaactagctaaccaagcacagctactagattacctcacgaagaaattcaccacacggaaactcgtaaagaaaacgggcgattacaaaacaacggtcgaacgcttcgaacttgtcgtccccaaagtcggcttcaatcagctcgttatcgacggcggacaaccgtttatgttaggctccgcaacataccaatacaacgcccgcgaacttttcatctccaaagaagccgtcaaagcattaaacaagcagctaagcacccacgtagacctcgtgcaagtattcgacgaaatactcgtccaagtaaaccgctggttccccctgtacgacacgaacggcttccgcgagaaactgtcccacggccgggacagattcatgaaactgaacgactcttttgaggaaaagagcgacacgcaaatcgacgtccttaacagaatactcatcggcttccacgcaaacgccgcacgcacaaatctaaagatactgggattgggaactgatctaggattcatgacccagcaagccgggatccgactcaccgaaaaagcaattcttgtccaccaatcaccatccggactattcgagcgcaaggtagccctccgcgacctgaaaggtctgcgctga

SEQ ID NO: 6525 - RNA, 4068 nt, synthetic construct
  misc_feature 1..4068: note = Cas9 variant
  source 1..4068: mol_type = other RNA
atgacatactcaataggcctagacatcgggacgggatccgtgggctgggctgtaatcggcgacgactaccgacttaaaagagccaaaggcaaaaatctcatcggagttaggttgttcgactcagcaacgactgccgccgaacgtcgcggttaccgaaccaccaggcgccgcctctcccgtcgtcactggcgcctgcggctacttaacgacatcttcgcatcagaccttgctgagcaggacgaaaatttccttccgcggctgaaatactcgtgggtcaacccggatgacgaacagaacccccagcttaacagcgacgtcgccaacggcgcacttttcggaagctctgagaccgacaaagccttccacaagaactacccgacaatctaccacctcaggcacgaactcatgacggacactgccaagcacgacctgcgggaggtctacctagccattcaccacatagtcaaatatcggggaaacttcctgaacaccgcagataaaatcaatgccgaaaatagctttaacgtcgacctgttcattgcagcactagacgaatacaacgagttcctggaaacccctatcaccagcataaaagacgcccaacttttctcggacaaactcaccgacatcaacgcacgaaacaaatcggtgagggtagaaaatgccatgtccgagacctacgacgacaaaagcaagatctttaaagccatactgacagcgctcgtaggcaatacggccaacttccaaactatattcgacctaagcgacctggaaaaggacgaagcgaaaaacttcaaattcaagctagacctcgaagacgtcgagacaaaactggacgtcgtacgcgcaaagttgagcgatgaacaaaacgcgttcctagaagctgtactgatcgcctacgacggaatcacccttaaaatgatactcggggactataaatctatcagtcagtcaatgatcgaatcctataagagccaccaacgcgactggaaatacatcaaaaacaacgttcgcctgaacgaacagaagatagagcccgacaaaaacagcgtcaaattctttaaactcgacccaaagaaattaatatacccttccaacctcgcgtacctacaagtgatctccagcaacgaagacgagcacaggaaaggactcgactacttcaaaacggccatccaagacgcagacatattacaaagaatagaaaacgacaccttcctcccccgccagagaacaaaaaggaacggagtactcccatatcaactccacctagccgaactcgaacaaataataaagaaacagagcaaatattacccattcctcgcaaacatctacacgcaggataacaaaactgaaaacaaactcataggtctcttaaaatttagggtgccctactacgtaggacccctagtcgaagcagagaaagtgaccggtgacggcaagaaccattggctaatcaagaaagaactccaagaaaacaccccaatcacccccttcaacttcgacgacgtcgtagacaaagacaaaagcggcgaacagtttataaaacgaataaccggaacagattcttacctcataggcgaacccacgctaccagaaaattcgctactctaccaaaagtacaacgtcctccaagagctgaacaacgtccggaatgagcgacaccagcggctaccaataaaagtcaaacaagacatattcgagcacgtattcaaaattgacaagaacgtcaatgcaaagaaagtcatggcatacctaaaattgaacggatatggcgactttcagatcgccggcctatccgacactcgaaccggaaaattcaattccaacctcagctcctacaactacttcgtcgacctcctaggccgagaaaagacagagaaaattagagaagaccgcctagaagaaattatcgaaatacaaacagttttcgaagacaaaatccttgtcgccaaacgtctctccaacctcgacttcctaactccccaagaaaagtcaaaactgtcagccaaacattacaccggctggggccgactctcacagaagctcctcaccacacagttcatcaaaaccgcactctccgaagccggagacatcatacctcagtcccacagcatcatcgacctcctgtattacaccgacaaaaacctcatggaaatcctcaacgacaagaccttcaacgttcgaaactggctcaccgaacaaaacaaaggaaccgaatccggtaattccctctacgaccagatcgacgcgctggccggccccaaggacatcaaacgcggcatcacccaagtcttctccataatcgacgacatcaagaaagcaatggggagcaaccccgaaaccgtatacctcgaatttgcgcgcgaaacccagacttcgcgcctgaccaactcaagactaaatcgcgtccaggaaatctacaacagccccgagctaaaaactgagttcgcgtaccttgctaagaaactagaagcagaaaccaaagaatccatccacgacgaccgcctctacctctactacctgcaagaaggaagagacatgtacacgggcaaagaaatacctttcgaccagatctcctcaaattacgacatcgaccacatcatcccccaagccttcacgaaagatgactcgcttgacaaccgcgtactcgtaaatagggcgacaaacgcacgcaaaagcaactctcctacattcaccaacgacatcatagacaatcgcaaaagctggtggcaatccttagtgaaacgcgggcttatgtctaaagagaaatttgaacgcctcaccgacaaacgtaagaccttctcagagaaccaaacaaaccacttcatcgccaggcagcttgtcgagacacggcagatcatcaaaaatgtcgcggatttaatcaaaaacaactacgatggaacacaagcagtggcgatcagggcaagcctgaccggagagatgcgacgctacctagactggcccaaaaaccgagacatgaacgattaccatcatgcgcacgacgcactgatgatggcgaccgtcggtaaatacgtagaccgccgtggcttcttcgacaacggctccgtctccgatggcgcagggaacgcctacaatctgtacaccaaggactggctcgtcgccgcacgagtcggcacccgcaacgacagccagcgtgtcaacccctacgggttcatcgtcggaagcatgaacagcaaagccgtgcgccagcaggtaaacaaagagacaggtgagatagtatggggtaacgaaaacctcgactacttaaggcacgtcctctcatacaagaagatcctcgtcacgcgccgcctcagcggaagctcaggaagactatacgccgaaaccctcttttcacccaacccaaaagccaaacttatcgcacagaaggccaaccgatccgtcgccctatatggcggatttacaaaagccgaatccgcctacaccgccctcgtcgagttcaacaaaaagggcgaccgctcctacaaactgatcaaggtccccatggcaatcgccaaccgagtaaacgacaagcaaatcaccgtcaccgcgtacatagcatccctaaaccttagagatttctcccgagtggtcctcgaacaccttcccctgggcaccctaatccgggaaagcgacggttctgagttttacgccgcctcctcagaatacaagcacaacgccaaagagctatgggcccctaaagaaatcctacgctctagcaaaaagctagataaagccaccgccgacaatctgatcgacatcttcgacttccttacgaacgataaaaccatcagcaacttcaagttttacgaaaaagacctcttacaccttaaaaacgtacgagacaagttcgtggaagcatcagacgaaatcaaaataaaagttctttccgacgtgatatacgaactgcacaacgatgccggatggcgcgaccccttcaaacacatccaggaaaaacctgcctggacgatgctccaagtaaaaggagggatcaaactcagtgaaaaagcggccatcgtctaccaatcaccaaccggcctatttgaaacaattaccatagtcggtgagtga

SEQ ID NO: 6526 - RNA, 4071 nt, synthetic construct
  misc_feature 1..4071: note = Cas9 variant
  source 1..4071: mol_type = other RNA
atgaagaaattcgaagaatactacatcggcctagacatgggcacagggagcgtcgggtgggccgtcacagactctgcgtacaacataatcaaacgacatggcaaagccctctggggcattagactattcgaaagcgcgaaaacggcggaggaacgaaggatattccggacctccagacggcgcacagaacggcggaagaatagactccacctcctacaagaaatcttcgcagaggaaataagcaagaaagacatggggttctaccagcggatgaaagagtctaagtactggcacgaggacaagaaagacatcaacggtaatatgccagaactcccgtacgcgctattcgccgacgatgggttcacagacaaagactactacaagaaataccccacaatattccacctacgttacgcccttgctactaacaccaccgacaaaccagacatacgcctcctctacctcgcactccaccacataattaaacacaggggtcatttcctcttcgaggggaagaaactgtcagaggtcaaagagtttagtacagcgatcgaggcactggtccagcaagcagaagaacaggaaatcgacctgaagagtctgacacaagaagaggtactcacccaactcgaacacatcatgagcgacgcacagtgcaccaaatcggacaagaaaacccaggtaagcaaactcatcgtaggcacagacaaacagaaacaaaagcaggaaaaagccatcgcggcgctgataacaggatgcaccgtcaaactaagcgacatcttcgcggacccagaactagacaaagaagaaataagtaagatctgcttctcagataatggatatgaagaaaaagaggtggaaatagaatcagtactcgcagatcgcttcctcctaatagcagcagccaagggcgtctacgactggaccgtgctacacgacatcctaggagatgcccggtttctgtctgaggccaaagtgaagacatacgagaaacaccgcgatgacctacgaaaagtcaaacaactcctacgcatggacaaggaggtctatgaagccgtcttcggagtgagtgagaaaaacgaagccaactatagcgcctacataggaatggcgaagaaaaacggtaagaaacaacccatcgaaaagaaatgctcacaagaagatttctacaaattcctcaagaaacaattggaccgccttagcgtcgatgagatggggcaggagatcatcgatgagctcaaagccgagatggacctggggaccctgttccccaaacaaatgatacgagacaacggcgtgataccttaccagttacatgagaacgaactgaacgccatactcgacaacgcccagaagttttacccatttctactggaaaaagaccaagacggatacacccccgttgagaaaatccagaaaatattccgattcaggataccatactacgtgggtccgctgaacacggcacaccaggacaagggtgggcatagctggtcagtaaggaaaaaggaaggaaaaatctatccctggaacttctccgaaatgatcgacgaggaagaatcagctacgaagtttatcgaaagaatgaccaacaagtgcacgtatctaatcggagaagacgtcctacccaaagaaagcctgttatacgcaaaattcaatgtgctgaacgaactaaacaacctcagaatcgacggggaactaatcgcgcccgaactaaaacaggacatatacaacaacgtattcaaaaagtaccaacgcgtaacgggaaagaaagtcaaagactacctacggatcaacggcgtcataagcaaagaacaagaactaagcggattcgaccaaaacttcaaatcgtcgctaaaagcctaccacgacttcaaacaaatcgtaggcacaggagtcctaagcgaaagcgaacaagaagacattgtaagagatataaccctattcgcggactcccagaaaatgctgaaacaaaggatccaccgaaagtacccaatgttaagcgacaagcaaatagcccaactcgcaaacaagaagtacgccgggtgggggcgtctctcccgaacgttcctagaaaacatcgaatcagtcaacaaggaaaccggggaagttatgaacattatcacagcactctgggagacgaacgaaaatttgatgaagctgcttagcgggaagtacgactacacaaaacagatagaacaatggaacgcaagacaaatgaaaaagggcgaaatagagtatcaagacatcgaggaactttacgtcagcccagccgtcaagcgcccaatatggcaaaccatcaaaatagtaagagaaataacgaacatcatgggcggagcaccaaaacgcattttcgtcgaagtcgctagggagcccggggaaaagggcgtgagaaaagtctccaggcgaaaccaactccttgatctatacaaggcatgtaagaaagaagcgccggagctctacgataggctagccaacaaagagtccgacaacgcgctaaggtcagacaaactctttctgtactactcccagatggggagatgcatgtacagcggagacgcgatagacctagacgaactcttcacaaacagatacgatatcgaccacatctacccccagtcgaaagtcatggacgactccatagacaacagggtcctcgttaaacgcgacttgaactcgaagaaaacagatacctttccagtgagcgaagagtacagaaaagcagggaaggctctctggagcacactgctcaagaaaggtctaataagcaaagagaagtataaaagactaactcgaacagaaccattcggcgaggacgagctggccggattcattgcgagacaactggtggaaacacggcaaagcacgaaggctgtcgcccatctgctcgaggaagcgtaccccgatgccgagatagtatacgctaaagccagagccgtgagcgagttccgacacaaattcgacatgatcaaagtacgggaagtaaacgactttcaccacgccaaggacgcatacctcaacatcgttgtaggcaatacttattacgtgaagtttaccaaggacgccgcctggttcgtgagaaacaacccaggacgcacttacaacctaaagaaaatgttcgaaaacgagactgtaaaacgcggcaacgaaacagcatggatccccggagacaatggcactatctgcacagtgaaaaagtggatgcgcaaaaacaacgtcctcttcacgcgacgagcatacgaagtaaaaggaggtctgttcgatcaaaacatcctaaagaaaggaaaaggtcagatccccatcaaaggcggagcagacgaaagactgcgaagccgggacaagtacggagcctataacaaagcgtcaggcgcttacttcatgctcgtagagagtgatgggaagaaaggggaacggaagcgcacaatagagttcgtcccagtatacctcgccaagtcactggaagaaagcgtggaactacgacgaaggtactgcgaagaggaactgggcctcgtgaatccggacgtccgcctcagtaaaatccgaaagaacgcactcatcgacgtggacggcttcaaaatgcacttagtcgggcgaacagagaacagactactgctcatcggcgccacccagttagtactctccgaagacgaccaacaacttatcaaaaagatagggaaatactgcctcgaccatagagaaaataaagatgcagtcctgtccgaaaaatacgaactcacaatggatctattcgaaaaactatacgacatatttgtctttaaactggaacaaacggtgtacgccgtcaaactgagtaaacaggcaaaagacctgaaagaggtgaaagaagagttcctagcactagacgacgaacagaaatgcctcctacttatggaaatcctacacctatttcaatgttcaccgcagcttgccaacctcacaaacataggaggcgggaaaagcgccggcagcctcaagatcctaagcgacataacaaagcaacaaagcgtgctgctaattaaccaatcgataaccggattttacgagcaagtaattgacctaaaaaccatatga

SEQ ID NO: 6527 - RNA, 4071 nt, synthetic construct
  misc_feature 1..4071: note = Cas9 variant
  source 1..4071: mol_type = other RNA
atggaggtcggcaactactatctaggcatagacgcaggcaccgactcagtcggatgggcagtaacagacaaccaatacaacgtgatacggaagaaaggcaaatccctgtggggaattaggctattcgacggagccaacacggcgcaagagcgacgaacgttccgcgccctcaggcgccgaaatgagcgcaagaaacagcgcataaatctcctgcaggaactgttctgcaaagaaatctgcaaactcgacccaaacttcttcatcagactgcgagactccagcctctggtcggaagacaaggaagaaaaacaaatatactccctcttcaacgacaaaaacttcaatgaccgaaactaccacaacaactacaaaaccatctaccaccttcgcgccgatctaatcaaaaacaaggaaaagcatgacgcccgactcgtgtacctagcgatccaccatatcatgaaaaataggggccatttcctattcaacggcaacatcgaaagcgtaacctccttcgaaaacacgttcaacgaatttaaaaactgcctcctcgacgaactggagataaacctagaatgccccagcatctcagagttcgaaaatatcctcaaagaccgcaccttcaaaggaacacaaaagtgcaagaaactaaaagagctgtgctccatcccatcaagcgacaagaagctcgacaacatcttcaagctgatctccggactcaaagccgacctatccataatcttcgaagacgagtcattcaaagagaacgaacacaacaaaatctccttcgcagacagcaattacgaagaaacccgggaggtactaaactcagaaattcaggagaaaaccctgataatcgacatcttcaactccatctacaactgggtcatcctttcagacatcctatcaggaggcgagtacaatggtggtttatacctgtcaattgcaaaggtaaacacatacaacaagcattcaaaggacctaaaaatactgaaatcagtcatcaagaaatactttccccaaaagtacaccgacatcttcgcgagcaacaaagaaaacaactactgttcctacatcggaatgtacaaatcaggcggaaagaaatactcggtcaagaaatgctccgacaaaccagaagagttctacaaaacgatcaaaaacataattaacaagaacaccgccgaagaaatatctaacgacaaagacgtccagtacatcctcagcgaaatcgaaaacaatagcttcctaccactccaaatcaataagaataacggcgtcatcccctaccaagctaataaaatcgaactcgaatcaatactcaagaatgccgaaaactacctgccttttctcaaggaaatagacacagaatgcaacaagaccaccagtgaaaagattatcgatctcttcgagttccgcattccctattacgtcggacccctcaacacatccaagggagaaaacgcgtggatgatccgaaaggaagacggtactatacgcccctggaactttgagcaaaaagttgacatagacaagacagcggctgagttcatcacacgcatgaccaatcagtgtacatacctgaacaacgaaaccgtactgccgaaatacagcctcctatactccgaatacaccgtgctaaacgaaataaataacatccgcattaacggagagaaaataagcgtagaactaaagcaagacatattcaacatactgttcaaaaacaacaaacaagtaacatgcaaaaagctcctctcgcatctaaactcaaacgggtacaacctcaagaaagatgaccttagcgggttcgacgggaattttaagagcagcctctcctcctacatagacctgaaaaactacatattcggcgacaacatcgacaaaccccagatttacaacctagccgagaaaatcatactctggatcacactttacggggacgactccaaattactcaagcgggtcttacaaaagaactgctcagaacagctcaaccccgaacaaatcaagaaaatcaccaaactgaaattcaaaggctggggcagactctccaaagcctttctcagcgaactgcgcggggccgaccgcgaaaccggcgagaccatgaccatcatcaaaggactccgaaatacccaaaacaacttaatgcaactactatcccaaaactatacgttcaccgaagaatgtgagaaaataaattcaggatacttcataaaccccaacgaaatatcgtacgactccattgtcaaaaacatagtcgcttccccctccatcaaacggagcgtctggcaaaccattcaaatcgtcgaggaaatccagaaagtcatgggctccaagccccgtaagattttcgtcgagatggcccgcggtgaggaagaaaaagtccgtaccacatccaggaagcagaaactccttgacctatacaagaacatttcggacgaatgcgcaaagggtatgtacgacgaaatatactcaaaagacgagtccgacttcaaaaacattcgcctctatctatattatactcaaatgggatgctgtatgtacagcggcaaacacatagacctttcacaactatcgaacacaaacatctgggaccgcgaccacatttatccgcaatccaaaaccaaagacgactccctagacaatctcgtgctagtatataaaagcatcaacagtgaaaaatcggacgacatcataagccccaccatacaaaacaacatgcgaaccttctggaaactcctattcgaccgtaaattcatctccgagaagaaataccaccgcctgactcgaaccaccccactcactgacgaagaactcgccgggttcatcaatagacagctagtagagacgcggcaatcaaccaaagtgatggccagcatcttcaagagaatctaccccaacactgaaatcatctacgttaaagccaaaaacgtcagcgacttccggcaccgcaaagactgcgagaatggcgtcaaggtaagggaactgaatgactaccaccacgcaaaggacgcatatctcaacatagtagtcggaaacgtctactccagcaaattcacaaacaatcccctaatgtggctcaaaaacaaccgaaatgtaaagtactcgctgaaccgcatgtacgacttcaacctaacagtcaacaatgaaaacatctgggtagtcggcaacgaagggacccagaagacggtcaacaaatacctgggcaagaacgacatactctacacacgatacgccatgacgaacaaaggcgagcttttcgaccaaaacccccttaaagcaaccggcgacaaatcgaaacaaaccaccctagtcccgctaaagaaagggaaagaagtgtggaagtacggaggctacaattccattacccccagctacttcatgttagttgagagtaaggacaagaaaggaaactacatacgcaccatagagacgatgccactctacagagagaaagagttcagcaaaaacgaagaatttttattaaactactgtaaagaagttcacaaactaaaggaacctaaaatcattctcaaatgcatcaagaaaaacgcgctgctaatcgtcgacggcttccctatgcacctcaaaggatcaaccggcctacagctcaaactccaaggggctgtccaactgattctggaatcggatatggtcatctacctcaaaaagctaatgaaattcgtaaacgagaacaacataaacaagaacaaattagaagtcacaccctacatggaattaagcgcgaaggaaaacatcaagctgtacgacatctttatccaaaaactgactacaggcatctatagcaaacgacccgccaatcccgtagaaaaactgatcaacgcgcgtgacatcttcattgagctaaccgtaaaagaacagtgcatcgttctaagcgaaatccttcacctattccagtgcaaacccctaaccagcgccaaccttgtctccattaacctaaagaaaaccgttgggataatacaaatcgccaaaaacataacagccaagaacgttaaactcgtccatcaatcaccaacaggcatctatgaatacaccgtcgacctaaacaaaatctga

SEQ ID NO: 6528 - RNA, 4071 nt, synthetic construct
  misc_feature 1..4071: note = Cas9 variant
  source 1..4071: mol_type = other RNA
atgacaaagaaagaacaaccttataatatcggcctggacatcggaacctcctccgtaggctgggccgtcacgaacgacaactatgacctcctcaatatcaaaaagaaaaacctatggggcgtgcgcctattcgaggaagcacaaaccgccaaagaaaccagactcaaccggagcacccgcaggcgttaccgccgccgcaaaaaccgaatcaactggctaaacgagatcttcagcgaggagttagcaaagaccgacccttcgttccttatccgactccaaaattcttgggtctccaagaaagacccggatcggaagcgtgataaatacaacctatttattgacggcccctacaccgacaaggaatattacagagagttccctactatcttccacctaaggaaggagctcattctcaacaaagacaaagcagatatacgcctaatctatctcgccctacacaacatactcaaatatcgaggcaacttcacctatgaacaccaaaaatttaacataagcaatctcaacaacaacctgtcgaaggagttaatcgaactcaaccagcagctaatcaagtacgacatctcattccccgacgactgcgactggaaccacatatcggatatactaatcggaaggggtaacgctacccaaaaatcctctaacatcctaaaggatttcaccttagataaggaaaccaagaaactcctcaaagaagtcataaacctcatactcggcaacgtagcccatctcaacacaatattcaaaacctccctcaccaaagacgaggaaaagctaaacttttccgggaaagatatagaatcaaaattggacgacctagactcaatcctcgacgacgaccagttcacggtactagacgccgccaatcgcatatactctaccataaccctcaatgaaatcctcaacggcgaatcatatttctcgatggccaaagtcaaccagtacgaaaaccatgccatcgacctgtgtaaacttcgagatatgtggcacaccactaaaaacgaggaagcggtcgagcagtcccgccaagcatacgacgactacataaataaacccaagtacggcaccaaggaactctacacctccctaaagaagttcctaaaagtcgctctcccgaccaacctagccaaagaagcagaagagaaaatatctaaaggaacctacctcgtaaaaccgcgcaactccgaaaatggcgttgtcccctaccagctcaacaaaattgaaatggagaaaataatcgacaaccaaagccaatattaccccttcctaaaagaaaacaaagaaaaactcctctccatactatccttcagaatcccatactacgtcggccccctacaatcggccgagaaaaaccccttcgcctggatggaacgcaaatccaatggccacgcccgcccctggaacttcgacgaaatagttgacagagaaaagagctctaacaaatttatccgccgaatgaccgtcaccgacagctacctagtcggcgaacccgtcctacccaagaactcactaatctaccagcgctacgaagtcctaaacgaactcaacaacattcgaattacggaaaatctcaaaacaaaccccataggctcacgcctaacagtcgaaacaaaacagcgcatctacaacgagttattcaagaaatacaagaaagtaacagtcaagaaactcaccaaatggctcatcgcccaaggatactacaaaaaccccatacttatagggttgtcgcaaaaagacgagttcaactcgacactaacgacatacctcgacatgaaaaagatcttcggctcctcattcatggaagacaacaagaactacgaccaaatcgaagaactgatcgaatggctcacaatctttgaggacaagcagatcttgaacgaaaaacttcattcgtccaagtactcatacacgcccgaccaaataaagaaaatttccaacatgcgatacaaaggctgggggcgcctatcgaaaaagatccttatggacatcaccacggagacaaacaccccacagcttctccaactgtcaaactactcaatcctcgacttgatgtgggcaactaataacaacttcatctcaatcatgtcaaacgacaaatatgatttcaaaaactacatagaaaaccacaacctaaacaaaaacgaagaccagaacataagcgaccttgtaaacgacatacatgtctcccccgcgctgaaacgcggcataactcaatccataaaaatcgtgcaagaaatcgtgaaattcatgggacacgccccaaagcatatcttcatcgaggtcactagagagacgaagaaatccgagataactacctcgcgcgaaaaacggatcaagcgactccaatcgaagctactaaacaaggcaaacgactttaagccacaactcagggaataccttgtaccaaacaaaaagatccaggaagaactaaagaaacacaaaaacgacctgtcctcagaacgcatcatgctctattttctgcaaaacggcaaatcgctctacagcgaggaatcccttaacataaacaaactatccgactaccaggtcgaccacatactgccacggacctacatcccggacgacagcctagaaaacaaagccttagttctcgcaaaagaaaaccaacgcaaagcagacgacctactgctcaattccaacgtcatcgatcgcaatttagagcgctggacctacatgttaaataacaacatgatcggtcttaagaaattcaaaaacctgacccgccgcgtcataacagataaagacaaactcgggttcatacaccgccaactggtccaaacctcccaaatggttaagggggtcgcaaacatactcgataacatgtacaaaaatcaaggcactacatgcattcaggcacgtgcgaacctctcgaccgccttccgaaaagcactctcgggacaggacgacacttaccacttcaagcaccccgaactcgtcaaaaaccgcaacgtcaacgacttccaccacgcgcaggacgcttacctagcttcattcctgggcacctaccgcctccgacgctttccaactaacgaaatgctcctaatgaatggcgagtataacaaattctatggacaggtgaaagaattgtacagcaagaagaagaaactcccagactcacgcaaaaacggcttcatcatctcgccgctggtcaacggaacgacgcaatacgatagaaacacgggcgagatcatatggaacgtgggattccgagacaaaatcctcaaaatcttcaattaccaccagtgcaacgtaacacgcaaaaccgaaatcaagaccggccagttctacgaccagacaatatactcccccaaaaacccaaaatacaagaaactcatcgcacaaaagaaagacatggatccgaatatctacgggggcttctcaggcgacaacaaaagctccattaccatagtaaaaatcgataacaacaagattaagcccgtcgcaatcccaatccgactcatcaacgatctaaaagataaaaagacactacaaaactggctagaggaaaacgtcaaacacaaaaagtctatccaaatcatcaaaaacaacgtcccgataggccaaataatatatagtaagaaagtcggcctgttatccttaaactcagatcgggaggtagcaaaccgacaacaactcatcctcccgcccgagcattccgcactcctacggctactccagatacccgacgaagacctggaccagatactcgccttctacgacaaaaacatcctagtcgaaatactacaggaattaatcactaaaatgaagaaattctacccattctacaaaggagagcgcgagttccttatcgctaacatcgaaaacttcaaccaagccaccacgtccgaaaaagtcaactcactagaagaactcatcacgctgttacacgccaactcaacatcggcccaccttatattcaacaatatcgagaagaaagcctttggccggaaaacacacggtctcacacttaacaacacggacttcatctaccaatccgtcacgggcctctacgaaactcgcatccacatagaatga

SEQ ID NO: 6529 - RNA, 4071 nt, synthetic construct
  misc_feature 1..4071: note = Cas9 variant
  source 1..4071: mol_type = other RNA
atgacaaagaaggagcagccctacaacattggcctcgacatcggcaccggttcggtaggatgggcagtcaccaacgacaactacgacctactgaacatcaaaaagaaaaacctctggggcgtgcgtctcttcgaaggtgcccaaaccgcaaaagaaacccgcctaaatcgctccactagacgccgataccgccgacggaaaaaccgcataaactggctcaacgagatcttcagcgaggaactcgccaacaccgacccctccttcctcatccgcctccagaactcttgggtctcaaagaaagaccccgaccgcaaacgagacaaatacaacctcttcatagacaacccctacacagacaaagaatactaccgtgaatttccgacaatatttcacttacggaaagaactaatcataaacaaaaataaggccgacatccgactcgtctacctggctctccacaacatactcaaataccgaggaaattttacctacgagcaccagaaattcaacataagcacactcaacagcaacctatccaaagaactaatagaattgaaccaacagctaatcaaatacgacatctccttccccgacaactgcgactggaaccacatcagcgacatccttatcggccggggaaacgccacacaaaagtcgtccaacatcctgaacaacttcaccctggacaaggaaaccaagaaactactaaaagaagttatcaacctaatactcggcaatgtcgcccatctcaacactatattcaaaacctccctgactaaagacgaagaaaaactcagcttctccggcaaagacatcgaaagcaagctagacgacttagactcaatcctggacgatgaccagttcaccgtactagacacagcaaatagaatatactcaaccataacgctcaacgagatcctcaacggggagtcctattttagcatggccaaggtcaatcagtacgaaaaccatgcgatagacctctgcaagctacgcgacatgtggcacacaaccaaaaatgagaaagccgtaggcctctcaagacaagcctatgacgactacatcaacaagcccaaatacggcactaaagagctgtacacatccctgaagaaattcctcaaagtcgcgctccccacaaacctcgccaaagaggcagaagagaaaatcagcaaaggaacatacttagtcaagccccgaaacagcgaaaatggcgtcgtcccctaccagctgaacaagatagaaatggagaaaataatcgacaaccagtcccagtactacccgttcctgaaggaaaacaaagaaaaactactgtccattctcagtttcagaatcccttactacgtcggacccctccaatcttccgagaaaaacccctttgcctggatggaacgcaagtcgaacggtcatgccagaccctggaactttgacgaaatcgtcgaccgggagaaaagctccaacaagttcatccgacggatgactgtcaccgactcttacctagtcggagagcccgtattacccaagaactcgctaatctaccagcggtatgaagtgttgaatgaactcaacaacattcgaattaccgaaaacctcaaaacgaaccccacggggtcaagacttaccgtagagaccaaacagcacatttataatgaactattcaaaaactacaaaaagataacagtgaagaaactgaccaagtggctcatagcccagggctactacaaaaaccccatcctgatcgggctatcacaaaaagacgagttcaattccacacttacgacctatctcgacatgaagaagatctttggcagcagcttcatggaaaacaacaagaactataatcagatcgaagaactcatcgaatggctcaccatcttcgaggacaaacaaatactcaatgaaaagctccactcatccaactacagctacaccagcgaccagataaagaagatttcaaacatgcgctacaagggatggggtcgcttatccaaaaagattctcacctgtattactaccgagaccaatactcccaaatccctccagctctcaaattactcagtccttgacctgatgtggactaccaacaacaacttcatttccataatctccaacgacaaatacgactttaaaaattacatagaaaaccacaacctcaataagaacgaggaccagaacatctcaaatcttgtcaacgatatccacgtatccccagccctcaagcgcgggatcacccaatccattaaaatcgtccaagaaatcgttaaattcatgggccacgcccccaaatacatcttcatcgaagtaacacgcgaaactaaaaagagcgagatcacaacctctcgtggcaaaagaatccaacgcctacaatcgaaactattgaacaaagccaacggcttcaaaccgcaactccggaaatatcttgtgcctaacgagaaaatccaggaagaactcaagaaacacaaaaatgatctgtccagcgaacggatcatgctctactttcttcagaacgggaaatcgctctactccgaagaaagcctgaacatcaacaaactatctgattatcaagtcgatcatatcctcccacgcacctatatccccgacgacagccttgaaaacaaggcgctagtcctagcaaaagaaaaccaacgcaaagccgacgaccttcttctcaactcgaacgtaattgacaagaacctcgaacgctggacatacatgttgaacaacaacatgatgggtctcaagaaattcaagaatctaacacggagggtcataacagacaaagacaaactgggcttcatccaccgacaactcgtgcagacatcccaaatggtgaaaggagtcgccaacatactcaacagcatgtataaaaaccaaggcacaacatgcatccaagcccgagcgaatctctcaaccgcattccgcaaggccctctccgaccaggacgaccggtaccacttcaaacacccggaactcgtcaaaaaccgaaacatcaacgacttccaccacgcacaggacgcatatctcgcctcatttctcggcacttaccgactacggcgcttccccactgacgaaatgctcctcatgaacggcgaatacaacaaattctacggccaagtcaaggaactctactccaagaaaaagaagctccctgatagtcgtaaaaacggattcataatctccccgctagtaaacggcacgactcagtatgaccgcaacaccggcgaaatcatctggaatgtcggatttcgcgacaagatccttaaaatatttaactatcatcagtgtaacgtcacgcgcaaaacagaaataaaaacaggacaattttacgatcaaacaatatactcccctaaaaacccaaaatacaagaaactaatcgcccaaaagaaagacatggacccaaacatctatggaggtttcagcggcgacaacaaatcttcgataacaattgtcaagatagacaacaacaaaataaagccagtagccatccccatccggctcataaacgaccttaaagacaagaaaacactccaaaactggctagaggagaacgtgaaacacaagaaatccatccagatcatcaaaaacaacgtacccatcggccaaatcatctacagtaagaaagttggtctgctctccctaaacagcgacagagagatcgctaaccgccagcaactcatccttccacccgaacactccgccctcctccgaatcctccaaattccggatgaagatcccgaccagatccttgccttttacgacaaaaacatactcgtagagatactccaggaactcatcacaaaaatgaagaaattctatccattctacaaaaatgaacaggagttccttgcctcgaacatcgaaaatttcaaccaagctacgacatcggagaaaataaactccctagaagaactaatcacactcctccacgcaaactccacaagcgcccacctcatcttcaacaacatcgaaaagaaagcgttcgggagaaagacccacggactgacgctgaacgatactgacttcatctaccagagcgtcaccggcctctatgaaaccagaatccatatcgaatga

SEQ ID NO: 6530 - RNA, 4071 nt, synthetic construct
  misc_feature 1..4071: note = Cas9 variant
  source 1..4071: mol_type = other RNA
atgagcaagaaagactcagagtactatattggcctcgatatcggtacgaactccgtcggatgggcggtgaccaacggtaagtacgacctcttgaacatcaaaaagaaaaatctatggggggtgcgcctgttcgaggcagccgagtcagcagcaggccgccgcatcaacaggtcgacacgtagacgataccgcagaagacggaaccgtatcaactggctaaacgaaatcttcgcagacgagctctcgaaagtcgacccctccttccttacaagactcaactcttcatggatatctaaaaaagacagcagccgcactcgcgataaatacaacttattcatggacgcagactataccgacaaaaattaccatcataaataccccaccatataccacctccgccgtgacctcatgttcgacgacaaacagtttgacatacgacttgtttaccttgccctacacaacataattaagtaccgcggtaacttcacctacgaccaccgaaaattcaacgtcagcgaaatgtcgtccaacctaaccaaagccctggaaaacttcaaccaagaactaatggaattcgaagacgcgttccctgacaacacagactactccgccatatcggaagtgcttctcaaaagcaataacgtctctacaaaaattgacgagatcatctcaaacctagaactcgacaaggacaccaagaaatacctcaaagaggtcctgaaactcattctcggcaactccgccaacctaaataccatcttccacacctcgctcgacaaagatgacgagaaactatccctatcagcaaaggacatagaactcaaactaaacaacctggattccctcttatcagacgaacaaatccacttcataagcagcgctaacgaactttacagcagcattacgctaaacgacattctggacggcaagacctacctcagcctagcaaaaatcaaacagtacgacacccattgctccgacctacaggaacttaaagaaatgtggtacaagactacgaacccagacctcattaaaaaaagtcggaaagcctacaaagaatacgtccacggctcgtacaacacagaagacttttataaagcgatctcgccattcttgaaaatagcaatccccgaagaccttgccaaggacgccctgaaaaaaatagacgccaacacttaccttccaaaacagcgcacatcaaacaacggcgtaatcccgttccaactcaatctaatagaactcgaaaaaataatcgataaccaatcaaaatactaccccttcctaaaggaaaaccgcgagaaaatcattagtatcctctccttccgcataccgtactacgttggaccaatacaagcaccgaccgacaagaacttcagttggatggtcaaaaaaatacaagccaaagcgcgcccatggaacttcgacgaagtaatagatcgcgaaaaatcctcgaacaacttcatcaagcgtatgacaacgactgacacctaccttgtcggtgaacccgtcctccccaaaaactcactaatctatcagaagttcgaagtactaaacgagctcaacaacatacgaatctcaaaaaacctgtcgcaggaccccctcgggagcaaactctcggtcgaagtcaagcagcaaattttcgaggaactcttcaaacgttacaaaacagttaaatcagaccaactgaaaaaatggctcatccgaaactcatatttcactgacccaaccatcatcggcctctctaaaccctccgaattcaactcctccctgtccaccttcatagacatgaaagcgattttcggcatggacttcgtcaacaaccctaggaacagctcacagctcgaagagctcgccgagtggctcacagtcttcgaggataaacaaatcctttccgaaaagatccgacactcgaattacccctactccgaccaacaaatccgcaaaatatcgaacatgagatatagaggctggggccgaatatcgaagaaattactatgcgacatcaaagttgagagcaccatatacaaatcacaccaactccacccctactcaatattagacctcatgtggtccaccaacaacaacttctacagtatccttcataaggacaaatacaacttcgaatccatacttgaagactataacctaggaaccgacgacaagacggacatcaacgaactcgttgacaacatacacacctcccccgccctcaagcgcggtatcatacaatccattaacatcgtgaaagaactcgtcaaattcatgggccacgccccccaacacatattcctagaattcacccgcgaggacaaaacatcaacactttcagaatcgcggaagaaaagactcaagaagctctacaacaatctctcagaagacacaaagaagttcaaactcgacctcagagactacctagtccccgacaaatcaattcagaaagaattagaaagtcacgataaagacctgagtaaagagcgcctaatgctatatttcctacaaaacggaaaaagcctctactcagacgaagcactggacatcaaccgactctccgagtaccaagtggatcacatcctcccccgcacatacatcaaggatgacagcctcgagaacaaagccctcgtcctagcgaaagaaaatcaacggaaagccgatgatctcttactccaaccctcaatcataaacaaaaacatggaacgctggatctacatgaaggaccacggcatgatctcacctaaaaaattcaagaacttaacacggaccacgattacggaggatgacaaagtacacttcataaaccggcaactcgtacaaacctcacagatcataaaaaacgtagccaacatcctagataacatgtataaagagcaagggaccacatgtgtcgaaacaaaagcaaacctctcctcagccttccggacagctttctctgaacaggacgacaaatatcatttcaagcaccccgagtttatcaaaaacagggacgtcaacgactttcatcacgcccaagacgcgtacctcgcctgcctgctcgggctatacaggatacaacgattccccagcgatgaaatgctcctcatcaagaaggagtacaggaagtttttcgcgcaagcgcaaaacagcgtcaagaaccacggaaagatcccagacagccaaaaaaacggattcatcctcgcccccctcgttaacggggaaaccttaattaataacaaaactatggagaccatctggaacatggattacaaacggaaagtaatcaaaatctttaactataaacaatataacatcaccaaacgaaccgagataaagaccggcgaattctacaaacagaccctgtacagcccccacgacgaaaacgtcaaaaaccccataccacagaaaaaaaacctggaccccaaaatctacgggggttacagcggcgtccagtcctcctacctcgcaataatcaaagtagaccaaaaaaaacctacaatggtcagcgtcccaatacgtttcagcaagatgattgacgacggaaagctctcgcttcaatcctggctagagaacaacatcaaacacaaaaagaccattgaagtactgaaaaccaaaattcccatcggtcaactgacatataaccccaaaaacggatacctaagcgtccagtcggaaaaagaaatcgcgaacgctcaacagctcttcctgcccttcgagcacgtcgctttactgaccctcctccatgcgcccacgtccgaatatgaccagatcctgtcgttctacgacacagacatcctcctagagatcttcgacgagataaccaacaagataaaaacgttctttccattctacatagatgaacaggagtatttagtcagcatccgcgaaaacttccagtctgccactgtcatcgaaaaagtcaacgtgctacaacagctactaataatgctacacgcgaactccagccgaatcagcataaaactgggcgaagtctccaagaaagatcttggccgcaagaaaaagcgtatcccactcgaaaacaccgacctagtctaccaatctgtcacgggtctctatcaaacgaaattccatatcgactga

SEQ ID NO: 6531 - RNA, 4074 nt, synthetic construct
  misc_feature 1..4074: note = Cas9 variant
  source 1..4074: mol_type = other RNA
atgaatgaccgcaacaaaaagtataacatcggactcgacatcggtacaggaagcgttggttgggcagtaacggataacaactacaacctgttacacgccaaaaagaaaaatctgtggggtattcgcctcttcgacggcgccgaaactgccgccagccggcgaaccttccgatcaacgcgccgccgataccgacgacggcggaaccgaatcaactggctcaatgagatattcgcagacgaactagcaaagaaggaccaatcctttttggtccgtatgaacagctcctgggtcagcaagaaagacaagatccggcaaagggatcagtacaacctctttatggactcagattacacagacgtcgaataccatcgcgagttccccacgatattccatctgagaaaacgactaatcgaagacaaaagccaggccgatatacgcctggtctacctggccctccacaacatcatcaaatatcgcggcaactttacctacgaacaccagaacttcgacgtttctcatatggatagtgggttagccctgctcctcaatcagctcaatcaacaactacaagcattcgaggtagcattcccggacgaaacaaactttgaaagtatgagcacaatactactcgaaaagaaaacacccacccagaaaatcgacgaaatcgtcgatcaaatccaaccggaaaaagatctcctgcaaataaccaagaacatcatgaagatgctcctaggtaacaaagccgacctggtcaaaatcttcagcctcgactcggacgacaaaatcacagttgagttcagcagcaatagcatcgaacaggacctctccaacctggaggagacactttctgacgaacagttcaacataatcacactagccaacagcatatattccagtatcgttctcaacgatatcctttcgggcgaaacatacctctccttcgccaaagcacgtcaatactcagaccacaaaaaggacctcgctaaacttaaaaccatgtggagagaatcgcccgaccgtaaagcagtcggcaaggccaaaaaggcttacgatgactacctacactccgggaaatatggcatagaggacttttacaaagacatgtccaaattcctcgaaacggccacgccagtcgaactcgccaaagaagccaacgagaaaatcttaaacaaatcctatctcctcaaacaacggaacaacgaaaacggcgtgattcccttccaactcaacaaaaacgaaatgatagaaatcataaacaaccaggcaaaatactaccccttcctggcagaaaacaaagacaagctactcagcatcctatccttccgaatcccctactatgttgggcccctacagtccaagaaagataacccgttcgcctggatggaaaagaaatcccaaggcaaaatacgcccctggaacttcgatgaaatcgtagaccgagaagcctcaagcaacaacttcatcagacgcatgacctccacagacacctacctaataggcgaaccagtactaccactaaaaagccccatctaccagaaatacgaagtactaaacgagctctccaacgtccgcataaacgccgacgaggtcgataacccactgggagacaaactgtccgtcgatcttaaacaggccatctacaacgagctattcctcaaacatcgatccgtcagcaaggctctcctaacaaaatggctcatcaaccaatcatacttccagaacccacaaatctccggcctagccgacagtaagaagttcaactcaggcctgaccacttaccacgacttcaagaaaatcttcggcgaagacttcgtcaacgaccccaccaaccaatctcagctcgaacaactcgcggagtggctcaccatcttcgaagacaagaaaatccttaaaatcaaactcgacgactcacagttcaactgcacccccgagcaaattaaaaagatcgccggcatgagataccaaggctggggcaggctatcaaagaaactcctgtgcgacatcaaaacgaccaccgtcacaagcaaaaaccaccagcaggcctcctactcaatcctcgacctcatgtggaataccaaccgcaacttcatctcagttttgaaaaacgacacctacaaattcgaagacaaaatccaaacatttaacctagacaaaaatgaagcggcaactccgcaggcaatgatagatgaattacaaaccagccctgcactcaaacgaggcatacgccaatcagttacaatcatccaagaactcgtgaagttcatgggccacgccccagaacacatcttcctggaatttaccagagaggatgatgtaagcagccttaccaaaagccgggacagccggctaaacaagctctacgcacgcatcgccaagaacactaagaaaacagacgacgagctaaagaaatccctgctccccagttccgacatcaaggccaccctaaaagccaacaaaaacaacctatccaacgatagactcatgctatattatcttcagatgggaaagagtctctactccaatcaacctctagacatcaacagactctccgaataccaaatcgaccacatactccctcaatcatatataaaagacaacagcctcgaaaaccgggccctagtactcgcgtcggaaaaccaacacaagagctcagacctgctcttgaagcctgaaatcatcaaccaaaacatcgcacgatggcgttacatgaaggatgccggccttatgggaccgaaaaagttcaaaaacctcacccgaatccaaataaccgactccgaccagaacaatttcatcaaccgccagctcgtgcagacctcccaaataattaagcacgtatccaatatcctcgactcgatgtacggagaccaaggcacccaatgcgttgaaacgcgggcccacctatcaaccgaatttcgcaaggcattctccaacgaagacgacaactaccacttccaacaccccgagttcgttaaaaatcggaacatcaacgactatcatcacgcgcaagacgcctacctggcgtgcctgctaggtctctatcaaatgaaaaagtaccccaccgacaacatgatcctactgaagaaagaatacaaacgcttcttctcaaacacaaagaaaatctacgacaagaaacaccacttccctgattacgtgaaaaacggctggatcatcggctcaatgttcaacggagaaaagtacgtcgacgaagagaccggccaaataatctgggaccaacagaccaaagatatggtatcgtgcatcttccaatataaacaatacaacgtcacgaaacgcacagaggccgctaacggtgagttctacaaccagacagtctacaaaaaggacccaaacgaaaagcgcaaacttatttcactaaaacaaggactcgacactaaattatatggtggctattccggcgataatcccgcctacatcgtactcgtcaaaatcgacgacaagaaaaacaagctcgtcaaaatgcccatcagactcgccgaacaagtagacaacaaaacgatagatctacaaacctggctcgaagaaaacgtaccacacaagaaaggtatacaggttctcaagacgaaaataccccttggccaggtgatctacagcaaaaagaacggctatctcgcactcaagagcgataccgaaatagtcaacgcccagcaactcgtcctgccatacggttacgttgccttactcacactactccagaaaatgcctgaaaataaatatgacgaagtgctcgcatgttacgatgacggtatactagacaacatcttcgtggccataatagacaagatgaagcacttctacccatactactcaggcgaactcaagaccctctccgacaacatcgacaacttcaaagaatcacctgacgtcaataaaataaaaactctccagcaactccttctcctccttcacgcttcatcaaccacggcctcgattgagtttaataacgtcaaaaagaactcccttggaagaaaaccaaactccatcaacatacagaacactgacctcctgagcttcagcgccaccgggctgtacgaatcccggatacacatagactga

SEQ ID NO: 6532 - RNA, 4074 nt, synthetic construct
  misc_feature 1..4074: note = Cas9 variant
  source 1..4074: mol_type = other RNA
atggccgctaagaactacaacatcggactcgacataggaacctcatcgatcggctgggccatcgtcgatgacaactaccaattgatgcatgccaaaggaaaatacgggtacggcactcgcatctactcggaaggccaaacggccgccgaccgacgtggattccgaaccacgcggaggaggctcaacagacgcaaatggcgcctacgcctactgcaagacttcttcgaaccctacatactcccccaagacgaagccttctttatccgccaaaagcaatcaaacctcgtaccccaggacacaaagaaacagtaccccgaatcagtacttttcgatgacacatcagacaaagacttctacaccgagtacccgaccatttaccacttacggcaggccctcatgaccgagaaccggcaattcgacataagagaggtatacctcgccatacaccacatcgtcaaataccggggacacttccttaacaacgcaccggtaaaaaccttcaaaagcgggaacctggacctggcaataaagttcaacgagctcaatgaagagttcaaaagcgtctaccctgacctggaattacagttcaacctcgatcaaattgacgagatcaagaaaatattacttgacagcaccaagagccgcttcgaccgccaaggcgaagccgtgaaactaatatacacagtgagtgaagtcaaaacaattgaaaaacttcagaacaagatcgtgaaacagtttctaagtggaatcctcggcctaaacacacgattcgacgtactcacaaatacagaaagcgacgactcgatgtggaaattctccctcgacagcgaatcctcagatgacgcactagacgagatcatcgcacaattggacgaccccgcaatacacgtcgtagagctagtcaacgaaatacattcctccatcacgctcgcgggaatagtaccagaaggacaaggattaagcgaatcaatggtcgagaaatacgaagcccacaaagcacacctacagctcctgaaagcagtcgaaaagctagtagacaagaaagccgccgacaagctcgaagtggcctacgaccaatacatcaacggcaaagacagtaagcagtttatcaaagaggacttctacaaggctgtacaaagcgagataaaaggagtagcaggcgacgaagtcgccgaaatcaaccaactcatcgaactcgatcaattcatgccaaaacaaagaacgaaggagaatggagcaattccccaccaactccaccagcacgaacttgacgtcattatcgaaaaccagagcaagtattacgattggctcggagaaaaggtcggaaacgaatacaaactcgataaactggtatcattccgggtaccgtactatgtcggccccctggttgacacggcaagcaaggaaaagaaagatgaaacgaggttcgcatggatggttaggaaaaatcccgaatccacagaggcgatcacaccgtggaacttcgaggacatagttgataaaaacgcctcagccgaaaacttcatcaaacgaatgaccaccaaagacaaatatctcttaaacgaagacgttctccccaaatgctcgctattaacgcaagacttcgaggtttacaacgaactaaacaacatcagggtaaacggagaaaaattcaccgcagaacagaaacaactcattcatgacgaactattcacgaaacacgcaagtgtatcaataaaacaacttaaagacttcctggtctcagaactcatgtacgtccgcgacaacctcaaagtggaaggcctagccgacgaaaagaaactaatgagctcacttagcacgcagtttgattaccagaaaatcatcccagaccaaataaacgatgtaaaatacagggaagatatagagcaaatcatcgaatggtcaaccatcttcgaagacgccgccatattcaaaaccaaactcaaggaaatagactggctcacggacgaacagaggaacaaacttgccaataagcgctacagaggatgggggtcgttaagcaaacgactactagcatgcctagtcgacgagaacggccaacgaatcatcgacatcctccgagattcaagcgacaacttcatgatgatagtcaaccgcccagagttcaaacaagccatcttcgacgaaaacgcaaacctcactgagaccaactctaaaaaggacatgttcgaaatgatagacaacttctacacctcaccccaaaacaagaaagccatacgacaagtactcctagtagtgcaagacatccagaacgccatgggcggggtcgctccacagaaaatatttatagagttcgccagggaagacgaagtcaatggccggcgaacaaactcccgctactcgcagatccgagagatgtacagcaaggtaaccgacgacgtaattaacaaaaccgtgcgaggcgaactcgaagcaaacaagggctcactcaacaaggaaaaactgttcctctacttcctacaaggagggattgacttgtactcgggcaagaccataaacatagacaacatctcgagctatgacgtcgaccacgtactaccacagtcattcattaaagacgactccataaacaacaaagtcctagtaaacgctaaaggaaaccgcgttaaaaacgacaacgtacccatggaactgttcggcgccaaaatgtacccaacatggaaacgaatggtagacaccggcatcatgagcaaggccaagttcaaaaacttgacactgaaccccgacaacgtcgacaaattcaaggccgaaggcttcatcaacagacagctggtagaaacacggcaaataataaaactggtagcgcaaatacttaacgacaaactgggagatgacaccaagatcgtctctgtcaaggcaaacctaacccacgacatgcgagtgttcttcgacttccccaaaaaccgaaacgttaacaactaccaccacgcctttgacgcttacctaagcgccttcgttggcacatacctgtacaaacgatatccaaaactccagccgtacttcgtatacggcgagttcaagaaaatggataaattgaagaacatgacgtcattcgacttcctccgagacctaaagcacacagacaaagtcgtggacaaggacaccggcgaaatcatcgccgacaagctggccgtcataaccaatatgaacaaaatttacgacttcaagaaagtcctcgtcacccacgaggtccacgaaaatagcggcgccatgtacgaccaaaccctgtacccggcaaaactcgacaagagtctgggccgcaaaggggccaaacagctcatccctaagaaagacgacatgccgaccgcgctctacggaggatataccggctccaaagacgcattcatgagcatagtgcgtctgaaaaagaaagacgaggtctactacaaagtaatcgggatacccgtaagaatcgctgactccgtccagcacggaaaagaagtcgacgtggaagccctaacccaattcatcgagactaaattcaccaaagaaaacctcaacaagaaaaccggagagataacgcgcaaagtcgaatggttcgagctggtcctccccaaagtcctgttcgggcaagccgtcttcgacggagggcaaccttttatgctcggctcctccacatatccccacaacctaagagaactggttctaaccaaagactccgttaagaaaatcgcgggaaaagagagtaacaaaagctacctcgacgcatacgacgaaatcatggaggctatgaacaaatatttccccctctacgacacaaacaaattccgagaaaaagtcatcgaaggcagaagcaagttcatcgacctccccgacaaagacgaatacgagaacaacaaactcgtacaagtgggcaagtctactataatagacagaatgttcatcggcttacacgcaaatgccgcgcgcacagacttgaaaaacatcggcatcacaacccccttcggattcatgcagcaagcgagcggcatcaaactaacaaaagacaccgtagtcctatttcaatcatcgacgggtctcttcgagcgcaaggtagcactcaaggacctatga

SEQ ID NO: 6533 - RNA, 4077 nt, synthetic construct
  misc_feature 1..4077: note = Cas9 variant
  source 1..4077: mol_type = other RNA
atgaaagagccgtatggagtaggactcgatatcgggaccaatagcgtaggctggacagtcgtcgacgcctccggtcatgtccgcaaaataaaaggacaaacgggaatcggagtaagactattcaaagaaggcgccgccgcagccgaccgccgaggattccggaccacacggcgccgtctcaaaagagtgaagtggcgtcttcgcctacttcgcgagttcttcgaccaaccaatatcgaaagtcgacatcaacttctttgcaaggaggaagtacagcgacgtctcacctagagacccgaactacaacggcctagagaaaacactcttcaatgaccgctccgaccaggacttttaccacgactatcctacaatctaccatctaagagaagcactcatgacacagcaccgcaaatttgatgtccgagaaatctacctcgcaatccaccatatagtaaaatatagaggcaacttcctccgtaacgacgctgctaccgcctacagatcgggcacccttgacctacaacaacacttcgaaactctcaaccacctattctcgcaagctgacttagaactcaacctcaatctaacgaccgacgtcgcccttctcgacagcatcaaacaaacactcgtacgtaccgacataagccgatccgacaggcagaaactcatcatgccgctcctagccgtcctgacgggcgcgaccactgccgagaaaaagcgccaaaaagccgtagtaaccgagttcgccaaagcacttgtgggcaacaaaacaaagatagacgtcctcacacttacggacatcgacgccacggaagccaaagactgggcattctcactcgaagaaaaccaagataaactgcccggtatcgaagacagattttcggaagtaggacaacaaatcatagacgaagtcatacgactatacgcgtccgtcaacctcgcacagctaatcccagaaggcaaacgcttttcccaaagcatggtagaaaagtacaaacgacacggcgaagatctaaaactcctcaaggcctatatcaggagccagtccgacgctaaacgcggcagagctatcagagcaacatacgaccaatacattgacggagtcaaatccaagcaggtcacccaggaagcattccaaaaagccctcgggaaatttgtcgacgcggacgtagacttaaactcctgggccgcccagatcaaacaggccatagacagcgagcaattcatgcccaaattacgaacaaaacaaaacggagcgatcccctatcaagtccaacaaaacgagctagaccaaataatatcaaaccaaaaggaatactacccatggctcggagaggaaaatcccgtcataaaacgccgcggaaaattcccatacaaactggacgaattattcggcttccgcgtgccctattacgtgggaccactgataacgaaggaaatgcaagcagccaccgccaatgcaggtttcgcctggatggtccgtaaagcggacggaccaataaccccttggaactttgacgataaagtcgatagagtcgcctcagccacagcattcatccaacgaatgcaaactacagacacctacctgattggcgaagaagtcctgccggcgcgctctctgatatatcagcggtttatggtcctaaacgagcttaataacatccgggtagacgacggccaactaacaccccgacaaaaacaacgcctatacaaccaagtattcaagaaacacaagcgcgtcaccgccaagaacattcaagacaacctcgtcgcggcacgagagttccccaccgcgccccgcataacaggactagcagatcccaaagtgttcaactcaagcctctcaacctaccacgacctcaaacaagtacttcccgaggcaatgtccgacgtccgtaaacaggcagacatagaaaagataatcctatggtccacaatattcgaagattcaaccatcttcaagcagaaactcacagaaatatcctggctgacggctgcccagctaaaacaactaggccaactgcgttacagaggttggggccaactactacgtaagctactaacaggactcaaagacgacaacaaccgaagcataatggacgggctctgggaaaccaacgccaacttcatgcagctaagaagtcaacctgcgatcgaaaaccaaatcaaatccgctaaccaagcgaacctcacaacagccgacctccaagacaccataaacgaattatacacaagcccccagaacaagaaagccatccgcgaagtcatggtcgtcctagcagacataaaagacgccatgcatggacagacccccaattggatattcgtagaagccgctaggggcggaggcgtggccggtagacgcacacaatcccggtccaagcaaatagtcgccgcgtaccaaggcaccgcccaggccatagtccgcgaccaggtccagcgagaactcaaagagaaaatcaaaaacaaagcaaacttcaacacgaggctggtcctctactttctccaaaacggacgagacttatataccggcgacgccatcaacatcgaccgcctatcagaatacgacattgaccacatcctcccccagagcctagtaaaagacgactctctcgataatagagtcctgacaaacgcaaggataaaccgtgagaaaaacgacacattcgcgtcagaaaagttcggcaagaaaatgggcgccaagtggaaagaaatgcaccgcatgggattgatgaccaaacgaaagttggaccaccttctcatgcgaccagacgagataagtaaatacgccacgggcttcatcaaccgtcaactcgtcgaaacgcgacaagtcatcaaacttgtcgaggaactaataaacgcagagtacccctccaccgccatcgtaagcgtaaaagccaacctaactcaccaattccgccaaaccttcgatttccccaagataagggaagtaaatgactaccatcacgcattcgacgcagcgctcaccgccttcataggcacttatctgctcaagcgctaccccaaacttgaacgcttctttgtctacggtaaattcgcaaaacaaccggtcaacctcaccagattcaatgtaatacgcaaactcgcaaaaaccgacacccccattacggacatagacacgggcgaagtcctctgggacaaactcacagacataaagtacttcgaaaccctgtacgactataagcgattattagtaactcgcgaggtctcagaaaactacggtgcaatgttcgaccaaacacttctcaaggcatccgataacggcaaacgcctcataagaaagaaacagagcttcgacacagctatctatggagggtacaccgggaagaccctagcctatatggcaattgtcaaagtctccaccaagaaggacgtacaataccaagtggtcggcgttccaaccaccatggtgacccagatagaacagctagagcagcaaggcatgacgaacaagcaagctgtcactaaagtcatcgagcccctaatagctgcaaataacaagaaaatgttaacatacgaagtgctcctccccaaggtcagattcgaacaagtcgtcagagaccgcatcaagggtcaaacacaccgattcgcactcgggacggacacctactaccataacatacaagaattatacctgccactaacgctccaaagggccttcctcggcaagcaaaacgagtcagaagtacagctcaatcaaaacctacttaccgtcttcgatgcgacgctcgcacaagtaaaccgctacttcccactctacgagatgaacaaattcaagaaaatcctcaactctgcccgggatcaaatcgagctattagaagctaaaaaccagttcgtcaagaacaaacttgtcttaggcaaacagggcatcctcaccaatatgttcatcggattacacgcaaacgcatcctacggcgacctaaaagtgctcggtgtgaaaatcgactttggaaaattacaagtcccaggaggcataaagctcacgggcgacgccgaaatcatctaccaatcccccacgggcctcttcgaacgaaaaatcgccctaaaagacctatga

SEQ ID NO: 6534 - RNA, 4077 nt, synthetic construct
  misc_feature 1..4077: note = Cas9 variant
  source 1..4077: mol_type = other RNA
atgaacgagccatatggcgtcggactagacatagggacaaattcagtaggctggaccgtagtggacatgaacggacgggtcagaaaagtcaagggcaaaacagccctcggagcgcgccttttcaaagaaggcgccaccgcagaggaccgcaggggtttccgaaccacgcggagaaggctaaagagagtcaaatggcggctgagactcctgcgggagttcttcgaccaacccatcagcaaaatcgatcccaatttcttcgcacgtcgcaaatattcagacatctcgccccgggacccaaattacaacggactagcgaagacactattcaacgatcgcaccgaccaggagttctatcacgattacccaacaatataccatctgcgcgacaagctgatgacatccgaccgaaaattcgacatacgagaaatatacttggccatccaccacatagtcaagtacagagggaacttcctccgcaccgggccggcatctcaatatggatccgcgtcactacatctcgccacgagcttccaaaaactaaacgatctatttgcacagagcgaagaaagtctgaacttcaagctagtaacagacgaagcgcaactacagcaaatccaacaaatactcgtgcgcacggatctaagcagaagcgaacaacaacgacaaatatggcctttaatggtagtcctcatgggagcgaccgccgcagagaaaaagagacagaaagacttcgcgaaggaactcgcaaacgccctagttggactgaaagcgaagctgaatgttgttacgctcacaaacgtcgatacaaccgtcgtcaaagactggacattcacactagaagaatcgcaggacaaactgccagaaatagaagaacaactctcagaagtcggacagcagatcatggacgaagtcatacaactatacgcatcagtcaacctcgcccagctaattcctgcaggaaaacgcttttctcagcacatggtcgagaaatataaccaccacgagaaaaatctggaactactcaaggcctacatccactcacaatccgacagcaaacgaggccgggagatacgagcaacatacgacagatacatagatggcgtaaagtcaaagcccgtcactcaagaaatgttctacaaggacctcatgaaatacgtagaagccgacgctaccagcaaccacctcgccgccgagataaaggacgagatcgactccgagcaatttatgccaaaacttagaacaaaacaaaacggatcaataccataccaggtccaacagtacgaactggatcaaataatatcacaccagaagaaatactacccatggctgggcgaggagaaccccgtcgcagaaagaagaggcaaattcccgtacaaactggacgagctagttgggttcagagtcccctattacgtcggacccctaatcacaaaagaagaccaacaagcaacatctggtgccggtttcgcatggatggtccggaaagccgacgggccgataacaccgtggaacttcgaccagaaagtcgaccgcatcgcatccgcaaccgcatttatccaacgcatgcaaacaaccgacacctacctaataggagaagacgtgctccccgctcgatcactcatttaccagagattcatggtactaaacgaactcaacaatatgcgtgtagaagaccaaaaactcgcgccacgccaaaaacaaaggttgtacaaccaggtattcaagcaacaccagcacgtttccgttaaaaacatccaacagaacctgatggacgccggggaataccgagaaacccccaaaattacgggactcgcagacccgaaggggtttaattccagcctgagcacctaccacgacttcaaaaagatcctcccagaagcgatcgcagacgaacacaaacgcgccgacatagagaaaataatactttggtcaaccacattcgaagactccgccatcttcaaacagaaattagaagaagtagcgtggctaactgacgcacagcggaaacagctcagcggcctccgataccggggctggggacagctctcgcacaagctgctcaccgcattcaaagacgataacggacgatctgtaatggacggactctgggagaccagcgacaacttcatgcaactgcgcaagcaacccgcaatagaaacacaaattaaagaagccaatcaagcaaacctcaccgacgccgacatacaagacactatcaacgaactctacactagcccgcaaaataagaaggcaataagagaagtaatgctagtactagacgacatcaaaaacgccatgcacggccaaacacccagctggatattcattgaggcagcacgcgggggaggggtagcaggacgaaggacacaaagccgatcaaagcaaatcgttgaggcatataagagcaccgccaaagaaatcgtgtcagagaaagtccagcacgaactaaacgagaaaatcaaggccaaagcggatttcaacacacgtctggtactctacttcctccaaaacggtcgagacctatacacgaatgaagcgatcaacatagatagactaagcgaatatgacatcgaccatatcctcccccagagcctcgtcaaagacgacagcctggacaaccgggtcctaacaagcgccagaatcaacagggagaagaacgacacattcgcctccgagaaattcggccgcaaaatgggcgcgcaatggcgggaactccaccgaaatggcctgatgacacagaggaaactaaaacatttactcatgaggcccgacgaaatatccaaacacgcaactgacttcataaacagacagcttgtcgaaactagacaagtcataaagctagtcgaagaactgatctcctccgaatacccgtcagcaagcatcgtggcggtgaaagcaaacctcacacaccagttccgacagacgttcaacttccccaaactccgcgaggtgaacgactaccaccacgccttcgatgccagcctcacggcctttatcgggatgtatctattgaagcaatacccaaaacttgaacgcttcttcgtatacggtaaattcgccaaacaaccgatcaacctaacgcgatttaacgtaattcgtaagctagcggtcgcggaggaacccatcgctaatatagaaaccggcgaaatcctctgggacaaaacggcagacatcaaatgcttcgaaaaactctacaactataaacggctcctcgtaacacacgaggtccgcgaaaattacggagccatgttcgaccagacgatattcaaagccaccgacagccgaaaacggctcatacaaaagaagaaaggattcgcgacagagacatatggaggctacaccggacgaacactcgcatacctggcaatagtcaaagtcgtcacaaacaaagatacccagtaccaagttgtgggaataccaaccaccatggtaacccaaatacaacaactagaagcctcaggccttaccagcaaacaggccgtaaccaaagcaataggcgctatgatcaatgaaaacaacaaaaagctacaatcatacgaagtcctcttaccaaaggtgcggtttgaacaggtagtaagggacgaggtaaagggtcacatccaccgattcgccttagggaccgacacttactaccacaacatccaggagctttacctaccgcttaccatccaacgagcttttcttgggaagcgcaacgacaccgacgcacaaacagaacaaaatctgctaacggtcttcgaaaccaccctcgcccaagtcaacagatatttcccactttacgagatgaacaaattcaagcagatcctcaacagcgcgcaagaaaaattcgccgcgctcccaacaaagaacaaaacagtgaagaacaaactcgtcaccggtaaagacggagtcctaaacaacctattcataggcctccacgccaacgcaagtcttggggacctgaagatcctaggaatgaaaaccggattcggaaaattacaagtaccaggcggactcaaactaacagatcaggcagaaatcatatatcaatcacccacaggactgtttgaacgcaaagtggcactgaaagatctatga

SEQ ID NO: 6535 - RNA, 4077 nt, synthetic construct
  misc_feature 1..4077: note = Cas9 variant
  source 1..4077: mol_type = other RNA
atgaacgagccatacggcgtcggactcgacataggaaccaactcagtggggtggaccgtagtcgatatgaacggacgtgtacgcaaggtcaaaggcaaaacagcacttggcgctcgacttttcaaggaaggagcgacagccgaagacagaaggggattcagaaccacccgccgcagattaaaacgcgtcaagtggcgcctccgcttactccgcgaatttttcgaccaaccgatttctaaaatcgacccaaacttctttgccaggaggaagtacagtgacatttctcctcgcgaccccaactacaacggccttgctaaaacccttttcaacgaccgaaccgaccaagagttctaccacgactacccaacgatataccacctccgcgacaaactcatgacatcggatcgtaaattcgacatccgcgaaatatacctagcaatacaccacatcgtaaagtaccgcggaaacttcctacgcacaggtccagcttcacaatacggaagtgcctcactccacctcgccacgtccttccagaagctcaacgatctcttcgcgcagtccgaagaaagcctcaacttcaaacttgtcacagacgaagctcaactgcagcaaatccaacaaatcctcgtccgcacagacctaagccgctctgagcaacaacgccaaatctggcccctaatggtcgtccttatgggcgcaaccgcggctgaaaagaagcgccaaaaagactttgcgaaagaactcgccaacgccctcgttgggctcaaggcaaagctcaacgtcgtcaccttgacgaacgtcgacacgaccgtcgtcaaggactggaccttcacgcttgaagagtcacaagacaaactgcccgaaatagaggagcagctctccgaagtagggcagcaaataatggacgaagtgatccaactatacgcctcagtaaacctcgcccaactaatccccgccgggaaaagattctcacagcacatggtggaaaaatacaaccaccacgagaaaaacttagaacttttaaaagcgtacatacacagccaatcggactcaaaacgaggtcgggaaatcagagcaacctacgaccggtacatcgacggtgtcaaaagcaaaccggtcactcaggaaatgttttacaaagaccttatgaaatacgtcgaagccgacgccaccagcaatcacctcgcggcagagatcaaggacgaaatagactccgaacaattcatgccaaaacttcgcacaaaacaaaacgggtcgatcccataccaagtacagcaatatgaactggaccaaataatatcgcaccagaaaaagtactacccatggctaggtgaggaaaaccccgtcgccgagcgtcgcggcaagttcccatacaagctagatgaactcgttggcttccgagtaccatactatgtcgggcccctcatcaccaaagaagaccaacaagcgacttcaggcgcaggcttcgcctggatggtaagaaaagccgacggacctatcacaccctggaatttcgatcaaaaagtcgaccgcatagcgtccgccacagccttcatccaaagaatgcagacgacggacacctacctcatcggtgaagatgtccttccggcgcgttcactcatataccaaaggttcatggtactcaacgaactaaacaatatgagagtggaagaccaaaaactcgcgccccgccaaaagcagcgcctctacaaccaggtatttaaacagcaccaacacgtctccgtcaaaaatatccaacagaatctaatggacgccggcgaatatcgtgaaaccccaaaaataacaggactagccgacccaaaaggatttaattcctccctttccacataccacgacttcaaaaagatcttacccgaggccatagccgacgaacacaaacgggccgacatagaaaagataatattatggagcaccaccttcgaggacagcgcaatcttcaaacaaaaactcgaagaagtagcctggctaacagacgcccaacgcaaacagctaagcgggctgaggtaccgcgggtggggccaactgagtcacaagctcctgacagccttcaaggacgacaacggtcgctccgtcatggacggtctatgggagacatccgacaacttcatgcaactccgcaaacaacccgcgattgaaacacaaattaaggaagcgaaccaggcaaatcttacagacgcagacatacaagacaccatcaacgagctatatacctctccccaaaacaagaaagcaatccgcgaagtgatgttagttctcgacgacatcaaaaacgccatgcacgggcaaaccccgtcctggatattcatcgaagcagcaaggggagggggcgtagctggccgcagaacgcaatcccggtcaaaacaaattgtagaggcctacaagtcaaccgccaaggaaatagtgtccgaaaaagtccagcacgaactaaacgagaaaatcaaagcgaaggcagattttaacacacgcctagtcctatacttcctccagaacgggcgagacctatacaccaacgaagcaatcaacatcgatcgcctttcggaatacgatatcgaccacattctgccgcaatcacttgtaaaagacgacagcctagacaaccgcgtgctcacatccgcccgtataaaccgcgagaaaaacgacacatttgcatcagaaaaattcggccgtaaaatgggcgcccaatggcgagaacttcacagaaatggcctcatgactcagcgcaagctgaagcacctccttatgcgccccgacgaaatatccaaacacgcaaccgacttcataaaccgacaactcgtagaaacccgccaagtaatcaagctagtcgaagaactcatcagctctgaatacccctccgcctccatagtagcagtcaaagccaacctaacccaccaattccgacaaacgttcaacttcccaaaactccgagaagtaaatgattaccatcacgccttcgacgcatccctgacggccttcatcgggatgtatctcttgaaacaatacccaaaactcgaacgatttttcgtctacggaaagttcgcaaaacaacccatcaacctaacccgattcaacgtaattagaaagctcgccgtcgccgaggaacccattgccaacatcgaaacaggggaaattctgtgggacaaaacagccgacattaagtgcttcgaaaaactctataattacaaacgcctgttagttacccacgaggtccgcgaaaactacggagcaatgttcgatcaaaccatcttcaaagcaacagattccagaaagcggcttatacagaaaaagaaaggattcgcgaccgaaacatacggcggatataccggacgtaccctggcatacctcgcgatagtcaaggtggtaaccaacaaagacacacagtaccaagtcgtaggaatacccacgaccatggtaacccaaatccaacagctcgaggcctccggcctaacctccaagcaggccgtcactaaagccataggtgctatgataaacgaaaacaacaagaaactacaatcatacgaagtcctactcccaaaagtacgattcgagcaagtcgtaagagacgaggtcaaaggccacatccaccgcttcgcgctggggactgacacctactaccacaacatacaagaactctatctgcccctgaccatacaacgggcgttcctaggcaagcgcaacgacacagacgcgcagacagaacaaaacttactcacagtattcgagaccaccctcgcccaagtcaacaggtacttcccactgtacgaaatgaacaaattcaaacagatcctcaactcagcccaggagaagtttgcagccctcccgacgaaaaacaaaacagtcaaaaacaagctggtcacaggaaaagacggcgtgctaaacaacctattcatcggcctacacgcaaacgcctcgctcggcgacctaaaaatcctggggatgaagatcgggtttggaaaactacaagtcccgggcggcctaaaactaacagaccaagcagaaattatttaccagagccccaccggactcttcgaacgcaaagtagcactcaaagacctatga

SEQ ID NO: 6536 - RNA, 4077 nt, synthetic construct
  misc_feature 1..4077: note = Cas9 variant
  source 1..4077: mol_type = other RNA
atgaaagagccatacggcgtcggactcgacatcggaaccaactcagttggctggaccgtggtcgacgccagcggccacgtccgcaaaatcaagggacaaaccgggataggagtacgcctattcaaagagggggccgccgcagccgatcgccgtggcttcaggactaccagacgccgactcaaacgagtcaaatggcgactacgcctacttcgtgaatttttcgaccagcccatctcaaaagtcgacatcaacttctttgcgcgccgtaagtactctgacataagtccccgcgaccccaactacaacggcctcgaaaagacactattcaacgaccgatcagaccaggacttctaccacgactatccaactatctaccacctacgcgaagcactgatgacacagcaccgcaaattcgacgtccgcgaaatctacctggccatacaccacatagtcaaataccgcggcaatttcctcaggaatgacgccgccacagcataccgctcaggaacactagaccttcagcagcacttcgagacactgaaccacctgttcagtcaggccgacctcgaactaaacctcaatctcaccacggatgtagccttactggactcgataaaacagacactcgtaagaacagacatcagccggtccgaccgacagaagctcatcatgcccctattagcggtcctaaccggcgccaccactgcagaaaagaaaagacaaaaagctgtggtaaccgagtttgcaaaagccttagttggtaacaaaaccaaaatcgacgtactaaccctgacagacatcgacgcaacagaagccaaggactgggccttctctctggaagaaaaccaggacaagctacctggaatcgaagaccgcttcagcgaagtgggacaacaaattatcgacgaggtaataagactctatgccagcgtcaacctggcccagctaataccagagggcaaacgcttctcgcaatccatggtagaaaaatacaaacgccacggagaagacctgaagctgctgaaagcatacatccgctcccaatcagacgcaaaaagaggcagagctattagagctacctacgatcaatatatcgacggcgtcaaaagcaaacaagtgacacaggaagccttccaaaaagccctcggcaaattcgttgacgccgacgtcgacctaaacagctgggccgcacagataaagcaggcgatcgattccgaacaattcatgcccaaattgcgaaccaaacaaaacggggccataccataccaagtccaacaaaacgaattggaccaaatcattaacaaccaaaaggaatactatccatggcttggcgaagaaaaccccgtcataaaacgccgcggcaaattcccctacaaactcgacgaactggttggattccgtgtaccatactatgttggcccactgatcacgaaagaaatgcaagccgctaccgcaaacgcgggcttcgcatggatggtccgcaaagcagacggacccataaccccttggaacttcgacgataaagttgatcgcgtagcatcggccactgcattcatacaacgtatgcaaacgactgacacctacctcataggcgaagaggtgctcccagccagatcactcatctaccagcgattcatggtgctcaacgaactcaacaacatacgggtcgatgacgggcaactaacccccagacaaaaacagcgcttatacaaccaagtctttaaaaagcacaaacgcgttaccgccaaaaatatacaagacaacctagtggcagccggagagttccccaccgcccctcgaataaccggcctggcggaccccaaagtattcaactcctcactgtccacctaccacgacctgaaacaagtactacccgaagccatgagcgatgtcagaaaacaggccgacatcgagaaaatcatcttatggtccacgatcttcgaggacagcaccatctttaaacagaaactaactgaaatctcctggcttacagcagcgcaactaaaacaattaggtcaactacgctatcgcggctgggggcaactctctcgcaaactcctaacggggcttaaggacgacaacaatcgttcaatcatggacggactatgggagaccaatgcgaacttcatgcaactccgcagccaaccagcgatagaaaaccagataaaatccgcgaaccaggccaatctaaccaccgcagatcttcaagacacaataaacgaactctacacaagcccccaaaataaaaaggcaattcgagaagtcatggttgtcctagcagatataaaagacgccatgcacgggcagaccccaaattggatcttcgtagaagcggccaggggaggaggcgtcgccggtagacgcacacagagccgcagcaaacaaatcgtcgccgcctaccaaggcacagcccaagtcatcgtgagcgaccaagtccagcgcgaactaaaggagaaaatcaaaaacaaagcgaactttaacaccaggctggtgctgtacttcctgcaaaatggcagagacctctacaccggagacgccattaacatagaccgcctcagcgaatatgacatcgaccacatcctcccacagagtctcgtcaaagatgacagcctcgacaacagagtattaacgaatgctcgaatcaacagagagaagaacgacaccttcgccagtgaaaagttcggcaagaaaatgggcgcgaaatggaaagaaatgcacaggatgggactcatgactaaacgcaaactcgaccatctgctaatgagaccggacgagatcagcaaatatgcaaccggattcatcaacagacaactggtcgaaacgcgacaggtcataaagctagtcgaggaactcatcaacgcagagtaccctagcacagcaatcgtgagtgtcaaggccaacctcacacaccaattcaggcaaaccttcgactttcccaaaatacgtgaagtcaatgattaccaccacgcgttcgacgccgccctcacagctttcataggaacttacctactaaagcgatacccaaaacttgaacgattcttcgtatacggcaaatttgcaaagcagcccgttaacctcacccgctttaacgttataaggaagctagcaaagaccgacactcccataacagacatagacaccggcgaggttctatgggacaaactgacagacataaaatacttcgagaccctctacgactacaaacgcctcctagtaacccgagaggtttctgaaaactacggggcaatgttcgaccagacactgctgaaagcctcggacaacggaaaacgcctcatccgtaaaaagcagagcttcgacacggcgatttacgggggatacaccgggaagacgctagcctacatggccatcgtcaaggtttcgacaaagaaagacgtgcaataccaagtcgtcggcgtccccacaaccatggtaacacaaattgaacaactggagcagcaaggaatgacgaacaaacaggccgtcacaaaagtcatcgaaccactgattgccgctaacaacaagaaaatgctcacctacgaggtcctcctcccgaaagtccgctttgaacaagttgtccgcgaccgcatcaaaggccagacccacagattcgcactgggcacagacacgtactaccacaacatacaagagctctacctacccctgacgctccaaagagccttcctaggaaaacaaaacgaatcagaagtacaactaaaccagaacctcttgaccgtcttcgatgccacactagcccaagttaaccgatactttcctctctatgaaatgaacaaatttaagaaaatcctaaactccgccagagaccaaatagaactcctagaagcgaaaaaccagttcgtcaaaaacaagctagtcctcgggaaacaaggcatactcactaacatgttcatcggactgcacgccaacgcgagcttcggcgacctaaaaagcctaggagtgaaaacctccttcggacaactacaagtcccgggcggcataaaactcacaggggacgccgaaataatctaccaatcacccactggcctctttgaacgaaaaattgcgctcaaggacctctga

SEQ ID NO: 6537 - RNA, 4077 nt, synthetic construct
  misc_feature 1..4077: note = Cas9 variant
  source 1..4077: mol_type = other RNA
atgaaacaaggaaaacgcggctactaccttggccttgacatcggaacagactccatcggatacgccgtcacagacgaacaataccatctgctcaggttccacggaaatgacgcctggggcagccatgtattcgacagcgcatcactctgcgacgaacggcgcgggttcagatcggcaagacgccgtctggaccgtagacagcaacgggtcaaactactacaggaaatatttgcgaaagagatcgcgaacatcgacccacgattcttcatccggctctccgaaagctacagatggcgtgatgacacagacgacagatacatctacttcaatgaagaagaatacacggacattcaatacatgcgcgactaccccactatacaccatttaatctgcgaacttatggagaacgaagaggaacacgacatcaggctagtctaccttgcatgcgcctggctcgtcgcgcacagaggccacttcctctcacagctctccgtcgacaacatagactcgcttatagacatcgaaagcgtctaccaaaaattcttgcatttcttcatcgataacggatgcgagaacccctggatccaggacgccgaactcgtcggaggcatactgaaagaacacataggggtcaccgaaaaacataaccgactaggagaaatcatgttaggaaaccggaaaccgtcgaaggacgtgcgagatactttcctatactcggagtactgcatcatccggctacttgccggtggcacatgcaaactccgagacctctacggcaaagaagagtatgaggactttggctccgtctcgctggaaatggatgacgacaaactggccgaaataatgattaacattggcgaagactacgaactcatcgcggtactgcgcagcctccacgactggtccgtactcgcagacattctcgacgggcagaacggcctaacaaacatcagtaccgcaaaagttgccatctacgaacaacataagaaagatctagcaacgctcaaatacttcatacgaaaatactgtcctgaaaaatacaacgccatcttcaaggacgcccgtgaagacaactacgtcgcctacagctatcactacaacaacaagctcgacggacaaataaagaagaaagcagacacagaaacgttcagcaaattcctaatcaaaatcatccactcaatcaagcccgacaaagaagacgaaataatctaccaagacatggacaaccgcctggggctacgccaattcctaccaaagcaacggaacacagataaccgagtcataccacatcaactatacgaatacgaacttaagaaaattctcgaaaacgcggcaaaatacttgtccttcctaaatcaaaaagaagacgggatatccaacactgagaaaataataagcatcttcaaattcaagataccctactacgtaggcccattaaataaacacagcgagttcgcatggatagacagaaaatcaggaaaaatactaccatggaactacgaaaacatgattgacgacgacgccagcgaagaggcattcatcaagaaaatgaccaatcaatgtacttacctccccggggaatccgtactccccaaagactccctttgctaccagaaattcatggtactgaatgaaatcaacaacataaaagtcgacggcagaaaaatcagcgtgggtgcaaaacaaggcatatacagcgatctcttcctcaaatacaagaaagtgaaacgatcacagatagaagaatacctcatctcaaacggacaactagagaaaaatcggcgagaaaccctgtccggcatagacattcagatcaaatcgtccctctccagccacatcgcattccggcgactgctcgaacagaaaatcctcaatgaagcggacgtcgagcgaatcatcgagagagcgtcgtacgccgaggacaaggggcgagtcgctaaatggcttcgcgccaagtacccccacctcaccgaagctgacattaagtatatctgtaaggtcaaaataaaagacttcggccgactctcccgcaccttcctaacaggcattgagggcgcctgcaaggaaactggcgaagtcgcaaccatcatttcaatgatgtgggaaagcaacgacaacctgatggagcttctctcagaacgttacacattcgccgatacaatactcgagttcaaaagcgactactacacagaaagaaagcaaacgctaagcgaaagacttgacgaaatgtacgtgtccaacgcagtaagacgaccaatatacagaaccctagacatcgtgaaggaccttgaaaaagccttcggcaagccagagaaaatctttatagaaatgacccgaggcgcaatgccggagctcaaaggcaaaagaaccaaatcccgacaacaacagctgttggagtactacgacaagtgcaaagaggaagatgtacgtgacctaaaacaacaactagaggcactaggcgagtacgtcgacaacaaactccaatcagaccgtctgttcctctacttcatgcaattcggaaaatgcgcatattccgggatgcccatatcgcttgaacgactgatggccggctcaaaagaatacgacatagaccacatctacccacaagcatacgtcaaagatgactcgataattaacaataaggtcctcgtcctatccgtcgctaatggcgagaagaaggacgtataccccatcaaatcagaaatccgcaacaaaatgcagaaaacatggtccttctggcaccacgtaggaactatctcagacgaaaagtacaaacgtctcatacgctcaactccgttcacagaggacgaaaagtacggcttcataaatcgtcaactcaccgaaaccagccaaagcacaaaagtcgtcgccgagctgttaaaagagcggtaccccgaagcggaaatcgtctactccaaagcaggccttatatcagacttccgacacgagttcgacctctacaaatcacgctcctacaacgacctccaccatgccgtcgacgcatatttgaacattgtggtcggcaacgtatatcatatgcgcttctcccggcagtggttcaacgtaaactcatcctactccattaaaacgaagacactgttcacccacaccgtgaactgcaatgggaaagaagtctggaacaaggacatgcttcccggggtgcttaaaaccgccaagaaaaacactgcccacttcaccaaacatgcaacattcaaaactggcgggctctttgaccagaacccagtcaaaaaggctcccgggctaactcccctcaaggccgggttaccgacggaaaaatacggaggatataacaaagccggcgtaatgtttttcataccggtaagatacaagagcggcaagaaaacagtcctcatggtgctctccgtcgagctactctatgggaaccgctttctcgaggacgagatctttgcgaaggaatacgcaaaagaccgcctgcaacgcatgatcggcaaatcggttgacgaaatcgacttcccaattggaatgagaccatggaaagtgaacacaatattatccctagacggcttccgtatttgcataactggaaacgcgtcaggcggcaagtgccttatcgcccaacccatcatgcagtttagctccgacgagtactggaaatactacctcaagaaagttgaaaagttcgtagaaaaagtgaagaacaatagcagctacgtctacgacgtcgactacgatgccgttcaacacgaggacaacctgaaactctacgatctgtacttggacaaactacaaaactctatctaccgcaaacgaatcaacgcccccattcagacactcatcgaagggcgcgaaaaattcattgactgctcagtcatcgaacagtgccaagtattacttaacatccaccaagtttttggacggatgacatccgggtgcgacttaacgcttatcggcgggaagaccaggagcgcatcgaccgtaaacttcagctctatcatattaaattggaagaaaaactatacagacgtccggatcatcgaccagtccgcctccggtctctgggaagtcgtaagcgaaaacatcctcgagtacctatga

SEQ ID NO: 6538 - RNA, 4077 nt, synthetic construct
  misc_feature 1..4077: note = Cas9 variant
  source 1..4077: mol_type = other RNA
atgggcaaaatgtactatctcggactggacattggaacaaactccgtaggctacgccgtcaccgatccgagctatcacctactaaagttcaagggcgaaccaatgtggggcgcccacgtgttcgcagcggggaatcagtcagccgaacgccgcagcttccgaaccagccgccgaagacttgaccgccgacaacaaagagttaaacttgtccaagaaatcttcgcacccgtcatatcacccatagaccctcggttcttcatccgactccacgaaagcgcactctggcgcgacgacgtcgccgagaccgacaaacacattttcttcaacgaccccacatatacagataaagaatactacagcgactaccccactatccaccacctcatagtcgacctcatggaatcctcagagaagcacgaccccagattagtctaccttgcagtcgcgtggctagtcgcgcaccggggccacttccttaacgaggtcgacaaagacaacataggagacgtactatccttcgacgcattctacccggagttcctcgccttcctaagcgacaacggcgtatctccatgggtttgcgaaagcaaggcactccaagccaccttactatcgcggaatagtgtcaacgacaaatacaaggcattaaaaagcctaatattcggctcacagaaacccgaagacaacttcgacgcgaacatatctgaagacggcctaatccaactactagcagggaagaaagtcaaagtcaacaaactattcccccaggaatcaaatgatgcatcattcacactcaacgacaaagaagacgcaattgaagaaatcctcggcaccctaacgccggacgaatgcgaatggatcgcgcatatccgacgcctatttgactgggccataatgaaacacgcgcttaaagacggacgaaccatcagcgaatccaaagtgaaactctacgaacagcaccaccacgatttaacacagctcaagtacttcgttaagacctacctcgccaaggagtacgacgacatcttccgcaacgtagactctgagaccactaaaaactacgtagcttactcctaccacgtcaaggaagtgaaaggcaccctacccaagaacaaagccactcaagaagagttctgcaaatacgtcctgggcaaagtgaaaaacatagaatgttcagaggcagacaaggtagactttgacgaaatgatacagcgcctcaccgacaacagcttcatgccgaaacaggtctcaggtgaaaaccgtgtcataccctatcagctgtactactacgaactcaaaaccatacttaacaaagcagcctcctatctaccattcctaactcaatgcggcaaggacgcaatttccaaccaagacaagctcctaagcatcatgaccttccgaatcccctatttcgtcggcccactacgtaaagacaactccgaacatgcgtggctagagagaaaagccggcaaaatctatccctggaactttaacgacaaggtcgacttggacaaatcagaagaagcattcatccgacgcatgaccaatacctgcacatactatccaggtgaggatgtacttcctttagactccctaatatacgagaaattcatgatccttaacgaaatcaacaacatccggattgatggctaccccatcagcgtagacgtcaagcaacaagtcttcggactcttcgaaaagaaacgccgcgtcacagtgaaagacatacagaaccttctactcagccttggcgcgctcgacaagcacgggaaactcaccggtatcgatacaaccatccactcgaactataatacctaccaccacttcaaatcgttgatggaaagaggcgtcctcacccgagatgacgttgagcggatagtggagcgcatgacatactcggacgatactaaacgagtccgcctatggttaaacaacaactacggaactctcactgccgatgatgtcaaacacataagcagactacgcaaacacgatttcggtcgcctcagtaagatgttcctcactgggctaaagggcgtacacaaggagaccggcgagcgagcatcaatcctcgacttcatgtggaacaccaacgacaacctcatgcaactccttagcgaatgctacactttctcagacgaaataacaaaactccaagaagcgtattacgccaaagctcaactatcactaaacgactttctagattcgatgtacataagcaacgccgtgaagcgtccgatataccgcaccctagcggttgtaaacgacatccgcaaagcctgcgggacagcacccaagagaatcttcatagaaatggcccgagacggagaaagcaaaaagaaacgctcggtcacaagaagagaacagattaaaaacctataccggtcaatccgcaaagacttccagcaggaagtcgacttcctggagaaaatccttgaaaacaaatcagacggacaactacaatccgacgctctctacctctacttcgcccagctcggaagggacatgtacacaggagacccaatcaagctagaacacatcaaagaccaatccttttacaacatagaccatatctacccgcagagtatggtaaaagacgacagcctcgacaacaaagtcctagttcagtccgaaattaatggcgaaaaatcaagccggtaccccctagacgccgcaatccgaaacaagatgaaaccgctatgggacgcatactacaaccacggactcatcagcctcaaaaagtaccaaagactgacacgatcaacacccttcaccgatgacgaaaagtgggactttatcaatcgacagctagtcgaaactcgtcaatcaacaaaggccctcgccatcctcctaaaacgaaaatttccagatacagaaatagtatactccaaagccgggctaagcagcgacttccgccacgagttcggcctggtgaaatcaagaaacataaatgatctgcaccacgcaaaagacgctttcctagccatcgtcacagggaacgtctatcacgaacgatttaaccggcgatggttcatggtaaaccaaccgtactccgtcaaaacaaaaacactctttacccactcaatcaaaaacgggaacttcgttgcatggaacggtgaagaagatctaggccgcatagtgaaaatgcttaagcaaaacaaaaacacaatacacttcaccagattctctttcgatcgcaaagaaggcctattcgatatacaacctctcaaagcatcaaccggcctagtaccgcgcaaagcgggcctcgacgttgtaaaatacggagggtacgacaaaagcacggccgcctactacctcctcgtacgatttacccttgaagacaagaaaacgcaacataagctcatgatgatcccggtcgaagggctttataaagcccgaatagaccacgacaaagaatttctaaccgactacgcccaaacgaccatctcggagatactacaaaaagacaaacaaaaagtcataaatatcatgttcccgatgggcacgcgccacataaagctgaactctatgatctcaatagatggattttatctatccatcggcggtaagtcgagcaagggaaagtcggtactttgtcacgcgatggtaccccttattgtaccccacaaaatagaatgctacatcaaagcaatggagtcgtttgcccgaaaattcaaagaaaacaacaaactccgcatagtcgaaaaattcgacaagatcacggtcgaagacaacctcaacctctacgaactcttccttcagaaactacaacacaacccgtacaacaaattcttcagcacccaattcgacgtcctcaccaacggcagatccaccttcaccaaacttagccccgaagaacaggtccaaaccctgctaaacatcctcagcatattcaaaacttgccgttccagcggttgcgacctaaaaagcataaacggatccgcgcaagcagcacgaatcatgatatccgcagatctaacaggactgagcaagaagtatagtgacatccgactggtggaacaaagtgcatccggtctattcgtgtccaagtcccaaaacctcctagaatacctgtga

SEQ ID NO: 6539 - RNA, 4083 nt, synthetic construct
  misc_feature 1..4083: note = Cas9 variant
  source 1..4083: mol_type = other RNA
atgacaaaactcggaaaaccctacggcatcggggtcgacatcggctccaatagcatcggatttgctgccgtagacgaaaactctcacctcatcagactaaaaggcaaaactgtcatcggagcccgcctcttcgaagaaggtaaggcagccgcagatcgccgcgcgagccgcactacccgcagacgcctctcccgcaacaggtggagactcagtttcttgcgcgacttcttcgaaagtcatatcacccccacagatccgaacttcttcatgcgccaaaaatacagcgaaatcagccccaaagacaaagcacgctacaaatacgaaaaacgcctcttcaacgaccgcacagacgcagagttctaccaacagtacccaaccatgtaccacttacgcacccgcctactaaccgatccaagcaaagccgacgtccgagaaatatactttgcaattcaccatatcctgaaatccaggggacatttcttaacaagcggatacgcgaaagactttaacaccaacaaagtcgcactcaacgaaatattccccgccctccaggacgcctacgcgcaagtgtacccggacctagacataacattcgacgaaaacaaagtcaacgaatttaaaacggtgctcctagacgagaaagcaacccccagcgatacccaacgagccttagtcaacctcctcctggcggaagacggagacaaagatatactcaaacaacaaaagcaagtcctaacggaatttgcaaaagccgtggtaggactaaagacaaaactcaacgtggcactcggcacagaagtagactccagcgaagcaaccgcatggaacttctccctcggccagctcgatgacaaatgggcagggatcgaaagtgccatgaccgacgaagggacagaaatactagaccagatccgagacctgtaccgcgcccggctcctaaatgggatcgtaccggcaggaaaaaccctatcccaggccaaagtagacgactacgaacagcatcatgaagaccttgaattgttcaaagattacttaaaacagctggaagacgacggtatggcaaaagcaatccgccagctttacgacaggtacatcgatggcgacgacgcgaaaccattcgtgagagaagacttcgtcaaagccctcaccaaagaagtaaccgcacaccccaatgcaaaatcacctgagctcctagaaaggctggtacaacccgacttcatgctcaaacaacgcaataaagcgaacggagcgattcccgtccaaatgcaacaacgggaacttgaccagatcattaagaaccaaagcgtatactatgactggctagccgccccgaacccggtcgagaaacacagacaatccatgccctaccaattcgacgagctcctcaacttccgaatcccctattacgtcggccccctggtaacggccaaagaacaaaaagccgcacaaggcggagtattcgcctggatggtacggaaggacccggacggcaacataacaccctacaactttgacgagaaagtggaccgtgaagcctcagcaaacacgttcattcagcggatgaaaaccactgacacatacctgataggggaagacgtgctaccaaaacaatcgctcctatatcagagctatgaggtgctcaacgaactcaacaacgtccgcgtaaacgacaacaagctgtccttcgatcagaaacaacaggtcttaggggaactcttcgagcggcataataccgtaacgatcaaacaatttgtcgacaacctccttgcgcacggagactacgaccggataccagaggtccggggcctcgcagatgaaaaacgcttcctctcgtccctgtcaacctacaaccaactaaagggcatcctacacgaggcaatagacgatagcgacaagcagacagacatcgagaaaatcattgcatggtccaccatattcgaagataaagcaatcttcaagacgaagctcaatgaaatcagttggcttaacgccggaatgatcaactccctcgctaacatccgctaccgcggttggggccaattctcgcacaagctcctcaatgaactcacgttgtcaaccggccgcacagtcttcgaggaactccttatcagctcccataacctaatgcaaatcctgaccgacgaagtgctaaagcagaaaatcgccgagctaaacgcacacgagctaaaagcaagcggcatatacgcagccatagacgacgcctacacgtcaccctcgaacaaaaaggccctgcgtcaagtcctctccgtgatcgacgacatcaccaacgccgcgggccaggccccgaattggctctacatcgaaacggccgacggggatggcgtccctggcaaacgcacgaactcccgccagaggaagatacaggaaatatatgtcaatgcagctcaggagttaatcaccggctcagtccgcggagagctagaagacaagatcgcttcacgagccgacttcacagaccgtctagtactctactttatgcaagggggtcgagacatatacaccggcgaaccactcaacatcgacaaccttagctcatacgacatagaccacatcttaccacagagcctcataaaggacaacagcctggacaatcgcgttctcgtccacccgctcgtcaaccgtgagaaggacaccatcttcgcaagcactcgcttcgcaaagcaaatgaacggcatgtggcgccaatggcacgccgctggcctaatctccagccgaaagctccgcaacttacagatgcgcccagacgagatagacaaatacgcgagcggattcgtcgcgcgacaactcgtcgagacccgacaaattataaaactcacagaacaaatagtcgccgaccaataccccgacgccaagatcatcgccgtcaaggcaggcctaagctcccaactgcgcaaggaactcgacttccccaagaaccgagaagtaaaccactaccaccatgctttcgacgcctttctcgcagcccgaataggcacctacctcctaaaacgataccccaacctagagccgttcttcacgtacggcaagttcaagaaaaccgaagtcaagaaactaaaatcattcaacttcatccgggacatgacccacgcaaaagacaaaatcgtcgccaaagagactggcgaaatcgtgtgggacaatgcatcagatataaacgaactcgaccgtatatacaacttcaaacgaatgctgatcacgcatgaggtgcgattcgaaaccgcgtcccttttcaaacaaacactctacgctgccaaaaactccaagaaccgcgggggctcccgccagctcattcccaaaaagaaaggataccttgtagatatttacggcggctacacccaagaaacaggatcctatctctcagtagttcgcctaaccaagaaagcaatgtatgcagtagttaaagtgtctactcgcgatgcagccaaactagccgtcgcgaaatcaatttccgaacaaaaagagaatgaaacactcaagaaaataatagatggaaaactctctaagacaagcaagaaaggcaaaactacacaccaacttttcgaaatagtgctacctcgcgtcggacagaaaaccctcttcaaaaactccaagtataaccaattcctagtcaactccgacacctacatgcacaactaccaggaactctggatgccccgcgaataccaacgcatgtggaaggacatactcctctccaaccacggcgatgcgcaactcgaaggacaattagaccagatctttaaattcatagtatcccaggtaaactcctactttaacctatacgacataaaccaatttagaaagaaaatcgcagacgccaccgataaattcgctaaactaccaacgcacgacacagacaacgcccggggtaaaatcgccactatcggacaactccttatcggcctccaagcaaacgccatgagatccgacctccgcaatttagatataaaaactccattcggcctgctccagataggaaccggaattaccctagatctagacacaagcatcatctatcagtcaccaaccggtcttttcgaaagggaggtgcccctaaccgacctctga

SEQ ID NO: 6540 - RNA, 4083 nt, synthetic construct
  misc_feature 1..4083: note = Cas9 variant
  source 1..4083: mol_type = other RNA
atgacaaagctgaaccaaccctatggtataggcctagacataggcagcagttctatcggtttcgccgttgtcgacgccaatagccacctcctacgactcaagggtgaaaccgcaataggcgcacgactatttagagaaggcgagtccgcggccggccggcgcgcatctcgtaccacccgtcgcaggctttcacacaatcgctggcgacttcgatttctccaggacttcttcgacccacacatatcttccatagaccctgacttcttcctacgacaaaagtactccgaaatatcccccaaggataaagaaagattcaaatacgagaagagactgttcaacgaccgcacagacgcccagttctacaaacaatacccaaccatgtaccacctacgacttcacctaatgaacgacgcgtccaaagctgacccccgggaaatctttttcgccatacaccacatactaaagagccggggacacttcctcacgccaggcgacgcgaaaaacttcaacaccgacgacgtagatctgaagcatatcttcccagcactcacggaagcctacgcgcaagcatacccagacctcaccctctccttcgagccaagcaaagctgagaaattcaaaagcatattactcgacgaagacgccacaagcaatgacactcagaaagctctcgtaaaacttcttctctccgacgacggggacaaagaggtcctcaagcaacaaaagaaagttctaacggagttcgccaaagccgtcgccggactcaaagtcaagttcaacgtagcactaggcatagaagtaacagacgccgatgtagaaaaatggcacttcggaatggcccagctagaagataagtggtcagacattgaaccgtcattgactgaccaaggcatggagatctttgaacaaatccaagatctctatcgcgcgagactactgaacggcatcgtccccgcaggcaaaaccctctcccaagccaaagtggacgactacgaccaacactgtaaggacctaaagctgttcaaagagtatctaaaacaactcaatgaccacgacctcgcgaaacgcattcgacttctgtatgatcgatatatcgacggagatgacgcgaagccattcctccgcgacgacttcgtcaaggcccttaagaaggaagttactgcccacccgaccgaactagcagaatcgctcctagaacgaatggaacaagacaacttcatgctaaaacaacggaccaaagccaatggatcgataccggtccaaatgcaacaacgggaactggacaaaataatcgcgaaccaagccgagtattactcatggctggccgcagaaaacccagtaaaagagcaccgcgacagcaaaccctaccaactagacgaactcctgaacttccgtatcccatactacgtgggcccgatgatcacgaagaaacaacaagagaaatccgggcagaacgtattcgcatggatggtacgaaaagaccccagcggaaacatcactccatacaatttcgacgaaaaagtcgaccgagaagcctccgcaaacgctttcatccaaaggatgaaaaccacagatacctatctaatcggagaagacgtactgcccaaacaaagcctgctgtaccagaaatacgaagtacttaacgaactaaacaacgtacgcgtcaatggcgaatccctatcgacagaccagaaaaagcgcctgatccgagagctattcgagcgacactcatccgtcaccctaaagcaattcgtagaaaatctagtagcccacggcgatgtggccaaacgcccggacgtccgcggcctcgccgatgagaaaagattcctatcatctctatcaacctaccaccagcttcgaggcattctccacgacgcgattgacgacagaggcaagcaatccgacatcgaaaacatcatcacatggtccaccgtgttcgaggacgcctcgatattcaaatccaaacttggcgagataagctggttagactcgaagacccggacaacactgtctaacattcgataccgcggctggggacagttctccagaaaactgctggacggcttaaaacttgggaacggtcacacaattatacaggaactcatgctaagcagtagaaacctcatgcaaatactgaccgacgagacacttaagaaagagatggcgacccttaatcaagagcgactcaaacctgacagcataaacgaagctatcgacgccgcgtatacatcccccagtaacaagaaagcaatccgccaggtgcttaaggtcgtagatgacataaaacacgccgcaaatgaccaagccccctcctggctttacatagaaacagccgacgggggcggtcaccccggtaaaagaaccctcagccgccagaaacaaattcaggccatctacgaaaatacagcaaaggagctaatagacagcgcggtacgcggggaactcaaggacaagatagcagacaaaacgaacttctccgaccgcctagtgctctacttcatgcaagggggacacgacatctacacgggcaccgctctcaacatcgaccagctctctagctacgacatagaccacatcctaccccaaagcctaataaaagacgactccctcgataaccgggtcttagtccacgcgaagataaaccgcgagaagaacgccgagttcgcctcaacactgttcgccgctaaaatggcttctacctggcaccgctggagagacgcaggtctaataagtggccgaaagctcaagaacctcctaatgcgccccgacgaagtcgacaaatacgccaagggtttcgtcgccagacaacttgtcgaaacccgccaaataataaaactgaccgagcaaatcgttgccgcccaatatcccgacacaaaaattatcgcggtaaaggccggactcagccaccagctacgccaggagctcgacttccctaaaaaccgagacgtaaaccattatcaccacgccttcgacgcattcctagccgcgcgcattggtacctacctcctcaaaagatatcccaacctggcccccttcttcacgtacggcgaatttaccaaaaccaacctaaagaaactccagtccttcaatttcataggggcactcacccacaccgacggaaaaatcacatccaaggacaccggggaagtcctctgggacaaccaacgtgacatcgaggagctagaccaaatctacaacttcaaacgtatgttaatcacccacgaagtttatttcgaaaccgccggactatttaaacaaactgtatacgcggccaaagacagcaaagaacgtggcggctcgcgtcaactcataccgaaaaagaaaggctactccacgggcatatacggaggctatacccaagaaaccggcagctacaacgcactggtacgcctcacaaaagccggcaaagtcgtataccgggttttcaaaatatccacacaaaacgccgccgaaatagcagccgcacgaagcctctcagccgaagagggaaacgaacgcctatgccagatcctcgaacaatccctcctgaagaccaacaaagacaaaaagaacacagtcgatctcttcgacgttgttatcccacgactcggcaaggaagccctcttccacaattccaagtacggcctctttctagtcaactccgacacgtactaccacaactaccaagaattgtggctaagcagagagaaccagaagatactgaagaaactgttctccaccaaatacgaccaaagcgaaatggaccgcgacgcattgcacctcttcgaaacgatagctaagcaagttgaacaatttttcaaactttacgacatcaaccaattccgtacgaaaataagctctgccttcgacgcgttcgaaaaattgcccgtcgaaggcgaagaaggcaaagtcgaaacactaaaacagctcctgatcgggttgcatgcaaacccagtaaggtccgacctcaaaaaccttggcataaagacaccgttcggattcttgcaagccgggaagggcattcacctcgacgacgacactgagattatccaacaatccccagccggactattcaagcgacgggtacggctagcagacttatga

SEQ ID NO: 6541 - RNA, 4086 nt, synthetic construct
  misc_feature 1..4086: note = Cas9 variant
  source 1..4086: mol_type = other RNA
atgacaaaactcggcaaaccgtacggcatcggggtagacatcggctcgaacagtataggcttcgccgcagtagacgaaaactcacaccttatccgcctgaaaggaaaaacggtcatcggggccaggctgttcgaagaaggaaaggcggccgccgaccgcagggcctcccgaaccacacgtcgccgtctctcccgcaaccgatggagactgtccttcctcagagacttctttgaaagccacataacaccaaccggaccaaacttcttcatgagacagaaatactccgaaatatcacccaaagacaaggctcgctacaaatacgaaaaacggttattcaacgataggacagacgcggagttctaccaacaataccccaccatgtaccatctccggaacagactactaacggacccctccaaggcggacgtccgcgaaatctactttgccatccaccacatattaaaaagccgcggacacttcctcacctcgggctatgccaaggacttcaacacgaacaaagtagccctgaacgaaatttttccggccctgcaggacgcatacgcccaggtgtacccggacctagacataacgttcgacgaaaataaggtaaacgagttcaagaccgtacttctcaacgaaaaagcaaccccatccgacacacaacgggccctcgttaatctgctcctagccgaagacggcgacaaagacatactgaaacaacaaaaacaggtgctaacagagttcgcaaaagccgtcgttgggctaaagaccaagctcaacgtggcgctaggtaccgaagtagacagctcggaagccacagtatggaacttctcactaggccagcttgacgacaaatgggccggaatcgaaagcgcaatgaccgatgaaggaaccgaaattctggatcaaatccgcgatctctaccgagcccgactgctcaacggcatcgtgcccgccggcaaaactctctcacaagcaaaagtagacgattacgcccaacaccacgaagacctagaattgttcaaggactacctcaaacaactagaggatgacggcacggccaaagcgatccgccaactatacgatcgctacatcgatggtgacgacgccaaaccattcgtacgagaggacttcgtcaaagcactcaccaaagaagtcacagcacatccgaacgccaaaagccccgaactactagagagactcgcgcagccggactttatgctcaaacaacgaaacaaagcgaacggcgcaatcccggtccagatgcaacaacgtgaactagatcaaataatcaagaaccaaagtgtctactacgattggttagccgcacccaacccagtagaaaagcaccgcaagtcaatgccataccagctagacgaattgttaaacttccggataccctactacgtgggacccttagtcaccgcaaaagagcaaaaagcggcccaaggcggggtcttcgcctggatggtaaggaaagacccagacggaaacatcaccccttacaacttcgatgagaaagtagaccgagaagccagcgccaacacattcatacaacgaatgaaaacgaccgacacgtacctaatcggtgaagacgtcctgcccaaacaaagcctactctaccaacgttatgaagtgctaaatgaactcaacaacgttcgcgtgaacaacgaaaaattatcgatagaacaaaaacagcaagtaatacgcgaattattcgagagacacaacagcgtaaccataaagcaattcgcagaaaaccttcgggcccacggggactacgcgcacatcccagagatccgaggcctcgctgatgaaaagcgattcctgagctcactctccacctacagacaactcaagagtttactgccagacgccatcgacgaccctgcgaaacaggccgacatagaaaacatcatagcctggagcaccgtattcgaagacgcagcaatcttcaaaacaaaacttaaagaaataaactggctcgactcccaaaccataacaaagttaagcaacatccgataccggggatggggacaatttagccacaaattcctaaacggcctcacactcggaaacggtcacacgatcatacaagaactcttcctatcaaacaacaacctgatgcagattctgaccgatgaaaccctccagaagaaaatgaccgaactaaacgcggacaaactgaaagccgccaacattaacgacgctatagacgacgcgtacacaagtcccagcaacaagaaagccctacgtcaagtccttagggtaatagaagacattaaacgggcagccgacggacaagacccctcttggctctacgtagaaacggctgacgggggcggcactccaggaaagagaacccgcgcccgacaacaccagcttcaagagatctacgcgaacgctgcacacgaacttatcgacagcgccgtgcgcggtgaactggaagataagatagccgacaaagccgactttaacgacaggctagtattatacttcatgcaaggcggcagggacatttatacaggcacgccgctcaacatagaccaactctcaagctacgacatagaccacatcctaccccaatcactaataaaagacaactccctcgataacagagtcctagtacatgccataatcaaccgagaaaagaacgccaccttcgcaagcacaatatacgcccagaagatgaacgcaacgtggcgacagtggcacgaggccggcttaatatctggtcgaaaactacggaacctccaaatgcgcccagaccaaattgataagtacgccagtggattcgtcgcgcgccagcttgttgaaacccgtcaaattataaaacttacagaacagatcgtcgcagctcagtaccccgagaccaagataatagctgtaaaggccggcctctcccatcagctcagagaggaactagagtttccaaagaaccgggacgtaaaccactatcaccacgcattcgacgcattccttgcagccagaatcggcacgtacctgctaaagcgctttccaaacctacaagcctttttcacgtacggaaaattcaagaaagcagacgttaagaagctgcgaggcttcaacttcatccgagacattacacacgccgaagataaaatcgtagtaaaggacacaggagaagtaatctgggacaagaaacgtgacgtagacgagcttgacagaatttacaactttaaacgtatgctcataacacacgaagtgcacttcgaaaaggcggacctcttcaaacaaacggtctacggagcgaaggacagcaaagaggcaggcggcaaaaagcagctcatatccaaaaagaaaggatacccagtggacatctacggtggatacacccaggaaactggctcatacctaagcgttgtacgcctcacaaagaaagcaatgtatgcagtagtaaaagtaagcacacgagatgcagctaaactggcagtcgcaaaatcaataagcgagcaaaaagaaaacgaaaccctaaatgacataatagacgaaaaactctcgaagatctccaaaaacgggaagataacacacgagctgttcgaagtcgtactcccacgcgttggacagaaaacactattcaaaaactcgaaatacaacctcttccttgtgaacagcgacacctatatgcacaactaccaagagttgtggatgccccgagagtaccaaaagatgtggaaagacatttcgctctcaaaatacggcgatgcgcaaactgaagaccaactggaccaaatattcggcttcatcgtaagccaagttaacagctacttcaacctatacgatatcaaccaattccgcaagaaactcaacgacgcagcagacaaattcgccacactccccatgagagacacagacgatatgcaagggaaaatagccaccattggtcagctgctaattggactacaggccaacgctgccagatcagacctacgaaatttggacataaaaacacccctgggactgctccaaatcccaaacggtatctcactcgactccgataccagtgtcgtataccaatcccccacaggactcctcgagagggaagtccacctgtccgacctctga

SEQ ID NO: 6542 - RNA, 4086 nt, synthetic construct
  misc_feature 1..4086: note = Cas9 variant
  source 1..4086: mol_type = other RNA
atgaagaagccatacagcataggactggacatcggcaccaattcagtagggtggtcggtcgtcaccgacgactacaaagtccccgccaagaaaatgaaagtcctgggcaacacggacaaagaatacataaagaagaatctcataggggctctcctattcgactcaggcgaaaccgcggaagccactcgaatgaaacgtaccgcgagacgccgatacacccggaggcggaaccggatcctgtaccttcaggacatattctccccagagctcaaccaagtcgatgaatccttcctgcaccggctggacgacagcttcttagtagccgaagacaagcgcggagaacgccacgtcatattcggcaatatcgccgacgaggtaaaataccacaaagagttccctaccatctaccacctacggaaacacttagcggatagctcagaaaaggccgacctacgcctcgtctacctagcgctcgcgcacatcataaaataccgtggccacttcctcatagacgagcctatagacatcagaaacatgaacagccaaaacctcttcaaagagttcctactggccttcgacggcatccaagtcgactgctacctggcatccaaacacactgacatcagcggcatcatcacagcaaagatctccaagtccagaaaggtcgaagcagtacttgaacagttcccagaccaaaagaaaaacagcttcttcgggaatatggtgtcgctagtattcgggctgatgcccaactttaaatcaaacttcgaactcgacgaggatgctaagctgcaatttagccgcgactcgtacgacgaggacctagaaaatctcctgggaattattggtgacgaatatgccgacgtctttgtagctgcgaagaaagtctacgactcgatattgctcagcggcatcctcacaacaaacaaccatagcacgaaagcaccactgagcgcttcgatgattgaccgatacgatgaacacaattccgacaagaaactcctgcgggattttatacgaacgaacataggaaaagaagtgttcaaagaggtattctacgacaccagcaaaaacggatacgcaggctacatagacggaaaaacaaaccaagaggacttctacaaatacctgaaaaacttactacaaaaagtcgacggaggcgactacttcatagagaagattgaaagagaagactttctccggaaacaacgcacattcgacaatgggtctatcccacatcaggtgcatctcgacgaaatgaaggccatcctgcgacggcagggcgagttctaccccttcctcaaggaaaacgccgagaaaatacaacagatactgaccttcaaaatcccgtactatgttggtccacttgcccgaggcaactcccgctttgcctgggcctcatacaactcgaacgaaaagatgacgccttggaacttcgacaacgtcatagacaaaacgagctcagcccaagcattcatcgaacgcatgacaaacaacgacctatacctacccgaccaaaaagtcctccctaaacattcgcttctctaccagaaattcgccgtgtacaacgaactcaccaaaatcaaatacgtaaccgaaaccggcgaagctcgactattcgacgtattcctgaagaaagaaatattcgacggactcttcaagaaagaacgaaaagtaaccaagaagaaaatactcaacttcctcgacaaaaacttcgacgagttccgcataacagacatccaagggctagacaatgagacaggcaacttcaacgcgtcgtacggaacttatcacgatctgcttaaaataatcggcgataaagagttcatggattcatcagacaacgtcgatgtcttagaagatatcgtactatcactaaccctcttcgaagatcgcgaaatgatcaaacagcgcctcctcaaatacgaagacattttcagcaaaaaggtcatcgcgaatctaaccaggcgtcactacaccgggtggggccggctgagtgccaaattaatcaacggcataaaagacaagcacagccgaaaaaccattttggactacctaatcgacgacggccacagcaaccgcaacttcatgcaactcataaacgacgacaacctgtccttcaaagacgaaatcgcgaacagccaagtcatcggcgacggagacgacctacaccaggtagtacaggaactcgcaggctcgccggcgattaagaaggggatcctacagtcacttaagatagtcgatgaactggtcaaggtcatgggatacaacccagagcaaatagtggtcgagatggccagggaaaaccaaacgaccgcgcgcggacgcaacaactcacaacagcgcctaggctccctaacaaaggccatccaggactttgggagcgacatcctcaaacgttacccagtcgaaaacaaccagctccaaaacgaccaactttacctatactacctccagaacggaaaagacatgtacacaggcgacaccctcgacatacacaatctaagtcaatacgacatagaccacattatcccacaatccttcataaaggacaacagtctcgacaaccgcgtcttaaccaactcgaaatctaaccggggcaaatcagacaacgtcccgtccaacgaggttgtaaagcgcatgaaaggattctggctgaagcagctcgacgcaaaactcatctcgcagcggaaattcgataacctgacgaaagccgagcgcggaggactgtccgcagaggacaaagccggattcataaaacgccaactggtggaaaccagacaaataaccaagcacgtagctcgaattttggacgaacgcttcaaccgtgacttcgacaaaaacgacaaacgcataagaaatgtaaaaatcgtcaccctgaaaagcaacctcgtaagcaacttcaggaaagagttcggattctacaaggtgcgagaaataaataacttccaccacgcgcatgacgcatacctgaacgcggtcgtcgccaaggctctcctgataagatatcccaaacttgaaccagagtttgtctatggagaataccccaagtacaactcgtatagagagcgcaaatcagccacggagaaaatgttcttctattccaatattatgaacatgttcaaaacaaccataaaattagccgacgggagagtcgtggaaaaacccgtgatcgaagccaacgaagaaaccggcgagatcgcatgggacaagacaaaacacttcgctaatgttaaaaaggtcctctcatacccccaggtctccatagtcaagaaagtcgaggaacaaacaggcggattctcaaaagaaagcatcctcccaaaaggcggatccgacaaactaatagcgcggaaaaccaaaaacaactatttatcaacacaaaaatacggaggtttcgactcgccaaccgtagcctactccataatgtttgtcgcagacatagagaagggcaaaagcaagcgccttaagacagtaaaagaaatgataggcatcacaatcatggaaaggagccgattcgagtcaaacagcgtaacgttcctggaggaaaagggataccgcaacattcgggaaaatacgataatcaagttccctaaatactcactattcgaactcgagaacggacgaagaaggctccttgcaagtgcaatagaactgcaaaaaggaaatgagatgtttctaccgcaacagttcgtaaacctcctgtaccatgcgcagcacgccaacaaagaagactccgtcatctacctggagaaacatcggcacgaactatccgaactttttcatcacatcatcggcgtcagcgagaaaaccatactcaagcctaaagtcgaaatgactttaaacgaggctttcgaaaaacacttcgagttcgacgaagtcagtgaactcgcgcagagcttcatcagcttgctcaaatttaccgcgttcggggcacccggcggcttcaagttcctagacgcagacataaaacaatcaaacctcagataccagaccgtgacggaagtcctcagcagcaccctaatccatcaatccgtaacaggactctatgaaacccgtatagacctcagcaaactgggaggcgaatga

SEQ ID NO: 6543 - RNA, 4086 nt, synthetic construct
  misc_feature 1..4086: note = Cas9 variant
  source 1..4086: mol_type = other RNA
atggggaactattacctcggccttgacatcggcacaaacagcgtcggatgggcagtaacagacgaaaactacaatatcgagaggttcaaaaagaaaaatatgtggggtatacgactcttcgatgaagcaaaaacagctgaaagccgccggatccaccgccaggcccgacgcatgcggcagagaaagatccagaggctcaacctactaatggaactcttcgacgtcgagatcagcaaggtcgacgagagtttcttcatccgtaagaaagaaagcgatctacattatgaggacaagtcccaagactcacgctacgccctgttcaatgacaaagaatttaacgacaaggactaccacaacaaatacccaacaatcttccacctcattatggatctaatcgaaaacgacgaaaagaaggacatccgcctgctctatctggcctgccattacctaatcaaaaaccgcggccatttcatattcgagggacaaaagttcgacgtcaactcatcgctcaataacaacataaacaaactcaaatctcacttggaccaattctacaacatctgcctagacttcgacaacgacaaactaatcgaaatcttagtcaaccaaaacctcaatatctccgaaaagagcaagaaaatcaaagaactattacgaaaaaccaacttggaagtcggcatcgccaatctcatcgccggcggctccataaaacttagcaacatgttcgacgacgatgaactgaagaacctcgactacaactcactcagcttcaaaaattccaacttcgacgagggtcgcgaactgtttgaggaggtcctagaagatcgcttcgagctcgtcgaaatcctcaaagacatacatgatgcctcagtcctagaaaccatgctaagctccgcctccataagccccgacggagggaaatacattagctcctccatgatcaactcctacaacaaacacaaacgggacctgaagctcctaaagaaaatcatcaaaaagtacaagaaaagcgaatacgataatatattccgcgacgaaaacatcaaaaacaactaccttagctacacccgcacggggatcaacaaaaacaagaaagtccaagcagaagacaacacagactcagacggcttctacaaatacatagtgaaaatcctaaaggatattaaggaaaacgattccgatgaagacattaagtacatactcagcgagattgataagaaaaacttcgtcccgaaacaacgcaccaaagagaatagcgtgatcccctatcagctgcgagagatagaactaagaaaaatcatagacaatcagtcgaaatatcacaaattcctgaacgaagtagacgagaaagggatcagcgtgaaagaaaagataatctcgctactcacattccgaataccatactatataggcccactaaatccatcatataacgaggagaaaaacttcaccaccagctgggtcaaacgactcgccaaaggcaaagtgaccccctggaattttgaagacatggtagacatcgacgcctctcgcgaagccttcattgagaacaaactcaataaatgttcattcctcctagacgagaccgtgctgccaaaggactcccttctataccaagaatatatggtcctcaacgaactgaacaacctcaagatcaacggccagtccatcaacaccgacctgaaaaagtccatatatgaagaactgttcaagaaatataagaaagtcacccggaaacgactaataagctacataaaagagaaagaaaacatgagcggcgacatagtgataacagggatcgatggggacttcaaacagggcctaaaaagctacatcgccttcaaagatataatcggagagaaaatcgatgacgacatctaccgaaaggaagtagagaaaatcatccgagacattagcctatacggggacgacaaatcgttcatacaaaagaagatcaaaaacgaaaacaaactcgacctgagcgacgaccagataagcaaaattgccaaactcaaattcaaggattggggaaggttctcgaagaaactcctagtaggaatcaaagcctccgacaaaaacaccggcgaaatcgacaacattatcggattcatgcggaactacaactacaacatcatgcaactaatggcaaacgtgttcacgttcaaagacgaaattgaaaaactcaacagcaagtactacaccgacgagaaaatcaacatagactatctagacgacctttatctaagctcaccagcaaaacgaatgctctggcaatcatttcaaattgttgatgaaatcaaaaacatcaaaaactcggacccgaagaaaatattcatcgaaatggcccgttcaaaagaggacaagccgacacgcaaaatgtcgcgcaaatcccggctggaaaagttatacaccgacagcaaaaagcagttcatcaaactcttcggcccggatgagtatgacaaactaaacaacgaaataaagaacaaatcagaaagcgatttccgctgggataacctctacctgtactacacacaattcggccgctgtatgtattctctagaccccatagacctcgaagaacttagcaataaaaacctatacgaccaggaccatatatacccaaagtcgaagatctacgacgacagcatagaaaacagagtgctcgtaaagaaacaactgaacctcgataaatcaaatgagtaccccatcccagaccgcgtactcaacaaagacaaaaataaactactagcattctggaaaatgctcaacgaaaaagaactaatcggagacaagaaatacgcacgcctgatccgcaaatcccctttcaccgatgaagaactaggggactttatagcaaggcaactggtcgagacccgccaggcaaccaaagaaaccgcaaacatgctaaaacgactctgtcccgacagcaaaatcgtatacgtgaaagcgaagaatgtctccgacttccgccgcaagttcgacatcctcaaatgccgttccataaatgacctgcaccacgcccacgacgcgtacctaaacatcgttgtcggaaacgtcttcgacacgaaattcacctccaacccccttaacttcatcaaaaacaacagcaaaaaccgctcatacaacctagagaagatatacgactacgacgtaatccgaaacgagaaaatagcatggctcgccgaacggaaagaagaaaaccaagacggcagcatagcaaccgtcctgaaaaacctatcgaagaacgacatccgcgtaacgcgccgcacatacatcaagtgcgaggacctattcgacgagaacatagtgcgcaagggcaacggcaagttccccataaaagagaacaacaataagagtgacaccaataagtacggcgggtactcgggaatcaaaaacgcttacttcgtgctactcgaggacgaaaaacacaacagaatattagaggcaataccctcttttatatacaagaaagagaaaaacggagaaaaagggagcgtgatcaactaccttcagaacatcttaggcatcaaaagcgccaaaatactgcgcgataaaatcaagattgggtccctactaaagatcgacaaattcccatacaacctcgcgggaaaatccggcaatggaatcctgatctccggcggggtccaactgattcttgacaagaacacaagcaaatacatcaagaaaatcgaaaattacaaatataaactcgacgagaacaaagactaccaaataaacatcttcgacaagctaagtaaggaagagaacataaaactctttgacctttttgtcgacaaattcgaaaatagcatctacaagaatcgcgtcaacatcaaactcaaagaaatcaagctagcgagacccaaattcgagcacctctcgatcgaggaacaaataaaaacgctgacacagatgctcatactctttggacgagaaaacaacgccgtaaacctagaatacattggactccccaaaaacacaggtaaaacgaaaatcaacaagaaaataaacaacaaagatataaagataataaaccagtccataacaggtctgtacgagactgaagaggacctggcaaatatctga

SEQ ID NO: 6544 - RNA, 4086 nt, synthetic construct
  misc_feature 1..4086: note = Cas9 variant
  source 1..4086: mol_type = other RNA
atgacgaaactaaaccagccatacggcattggactcgacataggatcgaactccatcggcttcgcagtcgttgacgcaaacagccacctccttcgcctaaaaggggagaccgcaatcggtgcccgcctcttccgagaaggccaaagtgccgccgaacgacgcgagtcccgaacgaccagacgccgcctttcacgaactcgctggcgtctcagcttcctccgagacttctttgccccgcacataacgaaaatcgacccagatttcttccttcgtcaaaaatacagcgagatttctccaaaggacaaggacagattcaaatacgagaagcgtttgtttaacgacagaaccgacgccgaattttacgaggactaccccagcatgtatcatctcagactgcacctaatgacgcacacgcacaaagccgacccccgtgagatctttctagcaatacatcacatactgaaatctcgcggccatttcctcacacccggagccgccaaggatttcaacaccgacaaagtcgacctcgaggacatattcccagcgctaaccgaagcctacgcccaagtttaccctgatctcgagctcacctttgacttagccaaagccgacgacttcaaagcgaagctcctcgacgaacaagctaccccatcggacacccaaaaggccctcgttaacctactcctgtcgagcgacggagaaaaagaaattgtaaagaaaagaaaacaagtactaacagagttcgcaaaagcaattaccggcctcaaaactaaattcaacctagcgctagggacagaagtcgacgaagcagacgccagcaattggcagttctcgatggggcagctcgacgacaaatggagtaacatagaaacttcaatgacggaccaaggcacggaaatcttcgagcaaatccaggaactctaccgcgccaggctactaaacggcatcgtcccggcaggtatgtccctcagccaggcaaaggtagccgattatggccagcacaaggaagatctagaactcttcaagacctaccttaagaaactcaacgaccacgaactcgcaaaaaccattaggggcctctacgaccgttacatcaatggcgatgacgcaaaacccttcctccgcgaggacttcgtgaaggctctgacgaaggaggtcaccgcacatcccaacgaggtgtcggaacaactcctcaacagaatggggcaggcgaatttcatgctcaaacaacggaccaaagctaacggtgccattccagtccaactacaacagcgcgaactcgaccagattattgccaaccagagcaaatactacgactggctagcaaaaccaaacccagtcgagaaacatcgagcatcaaagccataccagctcgacgagcttctcacattccggataccatactacgtgggaccgctaatcaccccgaaagaacaagcagaatcccgagaaaacgtattcgcgtggatgatccggaaagacccgtccggaaacataacaccgtacaacttcgacgagaaagtcgactgtcccgcatcagctaacatgttcatccaacgcatgaagaacactgacacctacctcataggtgaagacgtccttccaaagcgctcactcctctatcaaaaatacgaagtcctcaatgaattaaacaacgttagcatagacggaagacgcctgggggccgaccaaaaacagagactaatacgcgaagtctttgagagacacagctcggtcacaataaaacaagtcgctgagaatctagtagcccatggggacttcgcaaagcgcccggaaatccgtggactagcagacgaaaaacgattcctgagttctctctccacatatcaccagctaaagaaaatcctccacgaagccatcgacgaccccacaaaagaacacgacatcgaaaacatcattacgtggtccaccgtcttcgaggacgcagcgatcttcaaaacggaactggccaaaataagctggctcgactccgacaccatcaaggccctcagcaacataagataccgggggtggggacaattcagtcgtaaactgctagatgggttaaaactcggcaacggacacacagtcatccaggaactaatgctatcaaatcacaacctcatgcagatactgacagacgaaacactgaaaaccacaatggccgaactcaaccaagacaaactcaaagccgatgacattgaagacgtaatcaacgacgcgtacaccagcccctcaaacaagaaagccctccgccaagtactgcgagtagtcgaagacatcaaacacgcggcgaacgggcaggacccctcatggctctacatcgagacagcagacggccccggaacagccggcaaaagaacccagtcaagacaaaaacaaatacagaccgtctacgccaatgcggcacaagaactcatcgattccgccgttagaggagaacttgaagacaaaattgcagacaaagcatcatttaccgaccgcctcgttttgtacttcatgcaagggggacgcgacatctacaccggtgcccctctcaacatagaccaattaagccactacgacatagaccacatcctgccacaatcgctcatcaaggacgatagcctagacaaccgagtcctagtaaacgcgaccataaacagagagaaaaacaatgtcttcgcctccaccctgttcgccagcaaaatggcggcgacatggcgtaaatggcacgaagcaggactaatatccggccgcaaactaaggaacctcatgttacggcctgacgaaatagataagtttgctcacggctttgtcgcaagacaactcgtcgaaacacggcagatcataaaactcaccgaacagatagcagcagcccaataccccaacaccaaaatcatagcagtaaaggccggactatcccaccaactacgagaggaactagacttccccaaaaaccgagacgtcaaccactaccaccacgcattcgacgccttcctcgccgcacgcatagggacttacttgctcaaacgctacccaaaactcgcaccattcttcacctacggcgagttcgccaaggtcgacgtcaagaagttccgagagttcaacttcattggagcactaacgcacgccaaaaagaacatcgtcgcaaaggacaccggcgaaatagtttgggacaaggaaagggacattcaagaactcgatcggatctacaactttaaacgcatgctcataacacatgaggtgtacttcgagacggcagatctctttaaacagaccatatacgcagcaaaagactccaaagaaagaggcggctccaaacaacttatccccaaaaagcagggttacccaacgcaagtctacgggggttacacacgtgaaaacacagcctacctagccgtagtcaaaacagttgaaaagaaagcagatgtctacagagtcgtccgcatagccacgtcccaagtggccgccttgaaagaagcgcgggcccagagcacagtcaaagaaagggaactcctcaaaaagtttctcaccaccaaattcacgaaaataggcaaaaacggaaagaaagcgatcacgccatttgacatagtaataccccgagtaccccgcgagcaactcttccataacaaacgctacggattctttatggtcaactctgacaccctaatgcacaactatcaggaactatggatgtccagaagtgaccaacagatcctctccaaattagtcaaatccgccaaaaccgtggagaatggacaggtgggccgtctatttgaaaacatagtcgagcaaatcaacaaatatttcccactctatgacatcaaccagttccgtaagaagctcgaccaaagcaaggatatcttctccaaactgccactagaaggcaacggtactacctcaggcaaacgagaaactatccaaaacatactcaccggcgcaggcaccggcgccaaaaacggagatctaaagaacctaggcataaaaacccccttcggcttcttgcaagttccatctggcatcgtcctagacgacgacaccacactcatataccaatcccccaccggtatgctcaaccgcatcgtccgcctgagtgaactctga

SEQ ID NO: 6545 - RNA, 4086 nt, synthetic construct
  misc_feature 1..4086: note = Cas9 variant
  source 1..4086: mol_type = other RNA
atgaaaaacgaagaaaacatctacctagggctagacatcggcaccgactcggtcgggtacgccgtgacggatgacaaatataaaataatgaaataccatgggaacgcggcctgggggagcaccatcttcgacgccggagcattaggtgcagaccgacgagtatttagatccgcacgccgccgcctcgatcgacgccaggagcgcatacagttactacaggagatctttgccaacgaaatagccaaagtagacgaacgcttcttcatacgactcctcgagagcggactctggcgcgccgacgccgaggaccgatacgtattcttcaacgacaaagagtacaccgatgttcagtacatgcgcgactaccccacgatccaccacctgatatgcgaactaatctacaaccccaacaagcacgacgtacgcctggtctacctcgcatgcgcgtggctggtaacgcatcgcggccacttcctgagcaacatcaacaccgagaatatagccgacctagttgacatacacaacgtctacaacggattcatgcgattcttcgaagagaacgagatcatatgtgactggagagaagtcaacgtagaggaactaggacgcgtcctcgcagcaaacatcggaataaacgaaaaataccgcaacctatccaccgtactcttcgccacacgcaaacccgacaagaaagccaaagaagggtttccctatagcgaagatgccatcgtccggctgcttgctggcggcacgtgcaaactaaaagacgtttacataaaagaagaatatgatgagttcggctcaatcacgctgggcatggacgacgagaaaatgacggaaatcatggccgacatcggcgacgacttcgatctcatcaaggccctgcggtccctctacgactggggtatactggccaacatactggtcaacgaaaacaacagccccctgatttcccagagtaaagtgaaggtctacgaacaacacagggaagacctcgccaacctgaagtacctagtccacaaatatatcccccacaaatacaacgaaatattcagagaaatccgcggcgacaattatgtagcatactcctaccactacgaattgaagaacgacgaaaagatgggaaagaaagccgacgttgaaaaattctcaaaattcctactgaaaatactagaaggcatcagcgtagacgagcaggataaagtagtctacgacaacatgattgaacggcttaccctacggctgtttctccccaaacagaaaaacaccgacaaccgagtaattccccaccaactctacgaatacgaactcaaatctatcctcaaaaacaccaagaactacctaccattccttaaggaaaaagacagtgacggcattagcaatgaggacaaaatcataagcatctttaaattcaaaatcccctacttcgtgggccctctaaactgtaacagccaattcgcgtggatacaacgtaaggcggatggcaaaatattcccttggaacttcgaagacaaagtggacttcgacgcatccgaacaggcgtttatccagcgcatgacaaaccagtgtacctacctgcctgaagaaagcgtgctaccaaaacaatcattatactaccagaaattcatggtactcaacgagatcaacaacatcaaaatcgacggacggaaaatctccgtggcaatgaaacaggaactatacaacgaaatctttgagaaaaagaaacgagtccgcaaaaaggacgtcatagactttttcgtctcgaacggctatcttgaaggaggcaaagaagctctaatcagcgggttggacgagcagattcacacgaatctgagctccttccacgcctttcgacgactgctgcagaaccacatcctctccgtcgaagacgtcgaatctataatcgagcgggcgagctactccgatgacaaacggcgcgtactcctcttcttaaagaacaaatactccttcctcaccgacgaagacatcaagtacatctgcaagatcaaaattaaagacttcggtagactcagcaagaaattcctcgtggacttcgaagggacatgcaaagagactggagagatcagtactgtcctgcggctcatgtgggaaaccaacaataatcttatggaactgctcagcgacaaatacacctttgccaacggcataaaagaaaacaggaagaaatactacacagaacagcagaaaaccctagatgacagactggacgaaatgtacatcagcaacagcgtaaagcgaaccatctatcgcaccctgagcgttgtcaaagacgtgaccaaagcattcggggtaccaaagaagatcttcgtagagatggcccggactaacaaccctgacctaaagggcaaacgaaccaggacccgccaacagcaagtgatagaactctacgcaaaatgcgacgaagaggacgttcgcgagctcaaacatcaaatggaatccctaggagaatatgtcgacaacaaactacagtcagacaaactattcctttacttcatacaattcggcaaatcagcttactcaggaaagatgattgacctggaaaaactcatgagcgggtccaaggtctacgatatcgaacacatatacccacaagcctacgtaaaagacgactcaattattaataacaaggtcctcgtgttcagcgaggaaaacggagcaaagcaggacatatacccaatcaaaaccgagatccgcaaacagatgtccgggatctggaccacttggcaccacgtgggagccatctccgatgaaaagtacaagcggcttacgcgcagcacccccttcaacgaagatgaaaaatacggatttataaaccgacaactaaccgaaacaagccagtcgacaaaagccatcgcccaaatcctaaacgaaaagtacccggagaccgagatcgtgtacgtaaaggcgggactcgttagcgacttccgacacgagttcggcctctgcaaatgccggtcgtacaacgacctgcaccatgccatcgacgcatatctcaacgtggtagttgggaacgtgtacaacatgaagttcaatcgaaagtggttcagtgtagactccaaatactcgataaaaactaaaactatattcagtcatagcctagtatgcaacggaaagatcatatgggacaaagagaaaatgctccctatggtcctcaaaaatgcaaagaagaacaacgcacacttcacgaaatatcagttcatgaagacgggtgggttcttcgaccaaatgccatgcaagaaagcctcagggctcgtaccccgcaagaaaggactggacacggaacgttacggagggtacaacaaatcaggaataatgttcctcacccccatgaggtataaaatagggaagaaatccgatatcattatcctaagcatcgaactcctatatggaaaactattcctcaaagacgaagtgttcgcaaagaaatacgccgaagagagactacagaaaataatcgggaagaaagcagacgaggtctccttccccatgggcatgaaaccatggaaaataaacaccgtattgagcctagacggtttcaacgtgtgtatcacgggaatcgggggcggcgggaaatgcctaagtgcacaaccaatcatgcaactatccctaccctacgagctcgcgaaataccttaagaaaatcgaaaagttcgtcgaaaagaacaaaaacaacgccaattatatatatgacgagcagtatgacagcgtctccgtagacgagaacatcaagttatacgacgtttacctggacaaactcgaaaactccatctacaacaaaagaatcaactcaccagaagcaatcctgaaaaacgggcgagagaaattctgtaaactcaacgtgctggaacaagccgtgactctcatcaacatccaaagcatattcggaagaatgacaggcggctgcgatctagaaaacattgggggaaagaaacacagcgcagccacggtcaacttcagctccaatgtatccaactggaagaaatactacaacgacgtgcgcgttgtgtaccagtcacccagcggaatctgggaacgcaggtcccaaaacatcctcgaactcctatga

SEQ ID NO: 6546 - RNA, 4086 nt, synthetic construct
  misc_feature 1..4086: note = Cas9 variant
  source 1..4086: mol_type = other RNA
atgaatgaaccctacggcgtcggacttgacataggaacgaatagcgtaggttggaccgtggtagacatgaacggtagagtaaggaaagtaaaaggaaaaacagccctcggcgcacgcctattcaaagaaggagccaccgcagaagaccgtcgcggctttcgtacgacccgccgaagacttaaaagggtgaagtggcgactcagactgctacgagagttcttcgaccagcccataagtaaaatagatcccaacttcttcgcccgccgcaaatactcagacattagcccacgggacccaaactacaacggcctcgcgaagacccttttcaacgaccgcaccgacaaagaattttacgacgactacgcaaccatctaccatctccgcgataaactaatgacctccaaccgaaaattcgatatccgcgaaatctacctcgcaatccatcacatagtaaagtaccgcggcaacttccttcgcaccggcccggcatcccaatacggctcggcctccctccacctggcaacgtccttccagaaactaaacgatctctttgcacaatctgaggaaaccctcaacctcaagctcgtgaccgacgaagcgctcctgcaacagatacagcaaatactcgtaagaaccgacctctcgagatcggaacaacaacgccagatatggccactaatggcggtcctaacgggggcatctgcagcagaaaagaaaagacagaaaaacgtggtcgtagagttaagcaaggcgctggtagggctcaaagcgaagatgaacgtcgtcaccctaaccgaggtcgacgcagccgtggtcaaagactggaccttcacgatggaggagtcccaagataaactacccgagatagaagaacaactctcagaggtgggccaacaaatcatggacgaagtgattcaactgtacgcatcggtaaacctcgcccaactaatcccagccggcaagcgcttcagccaacacatggtggagaaatacaaacaccacgagaagaacctagaactactcaaggcttacatacactcccaatccgacagcaaacgggggagagaaatacgggccacctacgatcggtacatcgatggcgtcgactccaaacccgtcacacaggaaatgttttacaaggacctcatgaagtacgtcgaagccgacgccactagcaaccacttagccgcagagatcaaagacgagatagactcagaacaattcatgcccaaacttcgcactaaacaaaacggctccataccctatcaagtgcagcaatacgagctcgatcaaataattagccaccagaaaaagtactacccatggctaggagaagaaaacccagtagcagaacgacgcggcaagttcccctacaaattggacgagttggtgggcttccgagtcccatactacgtcggcccactcatcaccaaagaagaccaacaagcaacgagcggcgccggattcgcttggatggtacgtaaagccgatggacccatcaccccgtggaacttcgaccaaaaagttgaccgcatagcctccgcgacagccttcatccagcgcatgcaaacgacagacacgtatctcatcggagaagatgtcctaccggcaagatcgctcatctaccagaggttcatggtcttgaacgaactaaataacatgcgcgtcgaagaccggaaactagcccctcagcaaaaacaacgcctctacaaccaagtcttcaaacagcaccaacacgtcagtgtcaaaaacatccagcagaacctaatggacgccggcgaatacagaaagaccccacaaataacaggcctggccgacccaaagggcttcaacagctcactctcaacttaccacgacttcaagaagatcctgctcgaagccatcgcagacgaacacaaacgagccgatattgagaaaataatcctatggtccacaacgttcgaagactcagctatttttaaacaaaaactcgaagaagtagcctggctcaccgacgcacaaagaaagcagctctcgggcctacggtacagaggttggggccaactctcacacaaactgctaaccgccttcaaggacgacaaagggagatccattatggacggcctgtgggaaacctcagacaacttcatgcaactacgaaaacagcccgccatcgaaacgcagattaaagaagccaatcaagcaaatctcacagacgccgacatccaagacaccataaacgaactctacaccagcccacagaacaaaaaggcaatccgcgaagtaatgctcgtcctcgacgacattaaaaacgccatgcacggacagacaccctcctggatcttcgtcgaagcagcccgaggcggcggcgtcgcaggccgacgcacacagtcacgctcgtcccagattgtagaggcttacaaaggtaccgctaaagaaatagtatcagaaaaagtccaacacgaactgaacgagaaaataaaagccaaagccgacttcaatacccgactcgttctgtactttctacagaacgggcgagacctctacaccaacgaagcaatcaacatagacagactcagtgaatacgatatagaccacatcctgccccagtcgcttgtaaaagacgactcactcgacaatcgtgtgctcacgtccgcacgtataaaccgcgagaaaaacgacaccttcgcgagcgaaaaattcggcagaaaaatgggagcacagtggcgcgaactacaccgaaatggactcatgacccagcgcaaacttaagcacctcctaatgcgaccagacgaaataagcaagcacgcaaccgacttcatcaacagacagctagtcgagactcgccaagttataaagctagtcgaagaactaattagcagcgagtaccccgcagcctcaatcgtcgctgtaaaagcgaatctgacccaccaatttcgccagaccttcaatttccccaaactgcgagaagttaacgactatcaccacgcatttgatgcatctctcaccgcattcatcggtatgtaccttttgaaacaataccccaagctcgaacgcttctttgtatatggaaagttcgcaaaacaacccatcaacctcacacgattcaacatcatccgaaaacttgccgtagcagaaaagccaatagcaaatatagaaaccggcgagatcctatgggacaaaaccgcagacataaaatacttcgagaaactctataactacaaacgcctgctcgtcacacacgaagttcgcgagaactacggcgccatgttcaaacagacgctgttcaaagcaagctacaataaaagcaaaacacttgtccccaagaaaaaccacatggagacgagcgtctacggagggtatagcaaccaagagacagcgtacttagccatcgtacgcatccccttcaaatcagggttcaaattcattgtcgtcggaatacccacgcgcatggtagccaaaatcaagcactaccaatccctcggcgcaacgctaaaccaggctacgcacaaggtcatagagcccaaattcaccaaaatctcccgcaaaacaaagcaaacggtaataagcgactatgaggtagtgctccccaaggtctacctcgaccaagtcgtgcgcgatcaagtcaaaggccagatgtaccgattctcactgggatccgacaaagaataccacaacgtccaagaactctacttacctctatccatccagcaggcattcgtagggcactacgacgaatccgacgaccaaagatccaacgacctcgttaaagtctacgacgccgcactcaagcaacttcaacgctacttccctctacacctctcccggaactttgatcaagttgcatcccaagcccaccaatccttcgaaggcctaaagaacaatgtccagacctccgacaaacaattaggcaagaaggaagtcctcaattccttattcgtcggactccacgccaacgcaactaggtcaaacttatccgtcctcggaatgtcgaaagacttcggccgaataaaatcgaacgggatcacactcacggatcaagccgaaatcatttaccaaagccctaccggccttttcgaacgcaaagtggccctaaaggatctctga

SEQ ID NO: 6547 - RNA, 4086 nt, synthetic construct
  misc_feature 1..4086: note = Cas9 variant
  source 1..4086: mol_type = other RNA
atggggaactattatctcggcctcgacatcggcaccaactctgttggctgggcagtgacagatgagaactacaacatagaacgcttcaaaaagaaaaacatgtggggcatccgactgttcgacgaggcgaaaacagcggagtcccgcagaatccaccggcaagcccgtcggatgcgccagcgcaaaatccagcgcctcaatctcctcatggagctgttcgacgtcgaaatttccaaggtcgacgagtcgttcttcattcgcaagaaagaatccgacctccactacgaggacaaatcccaagacagccggtacgccctgttcaacgacaaagagttcaacgataaagactatcacaacaaatatccaacgatattccaccttataatggacctcatagagaacgacgaaaagaaggacattcgactactgtaccttgcctgtcactacctcataaagaaccgcgggcatttcatattcgagggccaaaaattcgacgtaaacagcagcctcaacaacaacatcaacaaactgaaatcacacctagaccagttctacaatatctgtctcgactttgacaacgacaagctgattgagatcctagtcaaccaaaatctgaacatctccgagaaaagcaagaaaataaaagaactgctacgcaaaaccaatttagaagtcggcatcgctaacctcatcgcgggtgggtctataaaactcagcaacatgttcgacgacgacgaactcaaaaacttcgactacaactcactgtccttcaaaaactcgaacttcgacgaaggccgagaattgtttgaagaggtcctagaagaccgcttcgagctagtcgaaatcctgaaagacatacacgacgccagcgtcctggaaacaatgctctccagtgcctccatatccccagacggaggaaaatacatcagctccagtatgataaactcctacaacaaacacaaacgggacttaaagctgctaaagaagattatcaagaaatacaagaaaagcgaatacgataacatcttcagagacgaaaacatcaagaacaactacctctcgtacacacggacgggcattaacaagaacaagaaagtgcaggcaaaagacaataccgacagcgacggcttctacaaatatatcgtcaaaatactgaaagacatcaaagagaacgactcagacgaagacatcaaatatatactctcggagatcgacaagaaaaactttgttccaaaacaacgcaccaaagagaacagcgtgataccctaccaactccgcgagatcgaattacgaaaaatcattgacaaccagtcaaaataccacaaattcctgaacgaagttgacgaaaagggtatctcggttaaggaaaagatcatagccctcctcaccttcagaatcccatattacatcggcccacttaacccatcctacaacgaagaaaagaacttcacaacctcttgggtcaaacgcctcgcaaaaggcaaagtaaccccatggaacttcgaggacatggttgacatcgacgccagtcgcgaggccttcatagagaacaaactgaacaaatgcagcttcctactggacgagacagtcctcccaaaggacagcctactgtaccaagaatatatggtacttaatgagctcaacaacctcaagataaacgggcaatcgatcaatacagacctaaagaaatcgatctacgaggaactattcaaaaagtacaagaaagttacccgaaaacggctaatctcctatataaaagaaaaagagaacacatccggtgacatcgtaattacaggcatagatggggactttaaacaaggcctgaaatcatacatagcgttcaaagagataataggcgagaaaatcgataacgacatatacagaaaagaagtcgaaaagatcatacgcgacattagcctctacggcgatgacaagagctttattcaaaagaaaatcaaaaacgaaaacaaactagacctgagtgataaccagatcagcaaaatcgcaaaactcaaatttaaagactggggtcgctttagcaagaaactgctagtgggcataaaagcctccgacaaaaacacgggcgagattgataacatcatcggcttcatgaggaactacaactacaacataatgcaactaatggcaaacgtattcaccttcaaagacgaaatagaaaagctcaatagcaaatactacacctacgagaaaatcaacgtcgattacctagacgacctatacttgtccgcccccgcaaaacgcatgctttggcagagcttccaaatagtagatgagatcaaaaacattaaaaacagcgcccccaagaaaatattcatcgaaatggcacggagcaaggaagacaaaccaacgcgcaaaatgagccgcaagagtcggctagagaaattgtatacagacagcaagaaacaattcatcaagctatttgggcccgacgaatacgacaaactcaacaacgagatcaaaaacaaatcggaaagcgacttcagatgggacaatctttacctctactacacacagttcggccggtgcatgtactctcttgaccctatagacctagaggaactctccaacaaaaacctatatgaccaagaccacatttacccgaaatctaaaatatacgacgactcaatagagaaccgcgtcctggtcaaaaagcaactcaacctcgacaagtcaaacgagtaccccatccccgatcgggtgctaaacaaggacaagaacaaactcctcgcattctggaaaatgctgaacgaaaaggaactcatcggcgacaagaaatacgcccgcctaatccggaaaagtccgttcacggatgaggaactaggcgactttatagctcgtcagctcgtagaaacccgacaagccaccaaagaaactgcaaacatgctacgcagactgtgcccggacagcaaaatagtctacgtcaaggctaaaaatgtcagcgacttccgtcgcaaattcgacatcctaaaatgccgctccataaatgatctccaccacgctcatgacgcatacctcaacatcgtggtaggcaatgtctttgacacgaaattcaccagcaaccccctaaacttcattaaaaacaactcgaaaaaccggtcatacaatctcgagaaaatctacgattacgacgtgatccgtaacgagaaaatcgcgtggctcgcagaacgaaaagaagaaaaccaagacggatctatcgccaccgtactcaaaaacttaagcaagaatgacatcagggtgacacggagaacttacatcaaatgcgaagacctgttcgacgaaaacatcgtgcggaaaggaaacggaaagttcccgctgaaagaaaacaacaataaatccgacacgaacaaatacgggggatactccggcatcaaaaatgcctatttcgtactactagaagatgagaaacacaaccggataatcgaagcgatcccatccttcatatacaagaaagagaaaaacggagaaaaagggagcgtcataaactacctccaaaacatactggggatcaaatcagccaaaattctgcgtgacaaaattaaaatagggtcactactaaagatagacaagttcccatacaacctcgccggtaaatcgggcaacggaatcttgatctctggcggagtccagctgatattggacaaaaacacatcaaaatacatcaagaaaattgaaaactacaaatacaaactggacgaaaacaaagactaccaaattaacatatttgacaagctctccaaagaagagaacatcaagctattcgacctcttcgtggataaattcgagaactcgatatacaaaaacagagtaaacataaaactcaaagaaataaaactcgctagatccaaattcgaacaccttagcatcgaagaacagatcaagaccctgacccaaatgctcatcctcttcgggagagaaaacaacgcggtcaacctagaatacatcggcctcccgaaaaatactggcaagaccaagataaacaagaaaatcaataataaagatatcaaaatcatcaatcaaagcatcacgggcctatatgagaccgaagaagacctcgcaaacatatga

SEQ ID NO: 6548 - RNA, 4089 nt, synthetic construct
  misc_feature 1..4089: note = Cas9 variant
  source 1..4089: mol_type = other RNA
atgaagaaaccatacagcattggactggacatcggcacaaactctgttggatgggccgttatcaccgaggactacaaagtacccgcgaagaaaatgaaagtactgggaaacacatcgcgcgactttatcaagaaaaacctactcggagccctcctcttcgacagcggagaaaccgctgaagcacgtagacttaaacggacagccaggcgaaggtatactcgcagacgcaaccgccttcgatacctccaagagatcttcctagacgaaatgaacaaactggacagcggcttcttccaccgcctcgacgattccttcctagtacccgaggagaaacgcggctcacgctacccaatattcggaaccctgcaggaagaagtcaattaccacgagaacttcccaacgatataccacctccggaagaaactggccgactctaaagaaaaagcagatctccgcctaatatatctagcccttgcgcacatgatcaaataccgtggtcacttcctttatgaggagtccttcgacagcaacaacaacagcatacaagagatcttcaatgagtttaccgcggagtaccacaacaccatagaaggcagctgccttagtgggcagatagaacaggtcgaagccatcctaaccgacaaaatctccaagagcgccaaacgagagcgcatcctcaaacttttcccagcggagaaatcaactggcctcttcagcgagttcctaaagctcatcgttgggaaccaagccgacttcaaaaagcacttcgacctagaagagaaaaccccgctgcaattcagcaaagacacctacgaagaagacctcgaaaacctcctagaacagatcggggatgagttcgcggacctctttctactcgccaagaaactttatgatgcgacgctactggccggaatcctcaccgccacagacgtatcaactaaagcgccgctctcggcctccatgatcaaccgatacgaaactcaccagcaggacctagccgcactaaagcaattcatcaagaacaaactccctgaaaaatactccgaagtcttttccgacctctctaaagacggctacgctggctacatcaacggaaagacgactcaggaagccttctacaaatacatcaagaacttactgataaagttcgaaggcgccgtagacttcctcgagaagatcgagcgcgaagacttccttcgtaagcaaagaacattcgacaacggatccataccacaccaactacacctacaggaaatgaatgcaatactacgccgccaaggtgaccactaccctttcctcaaagaaaaccgggaaaagatcgaaaagatactcacgttccggatcccctactacgtcggcccgctagctagaggaaacagggacttcgcctggctcacgaggaactctgaccaagcaatacggccctggaatttcgaagaagtcgttgacaagacctcgagcgcggaggacttcatcaacaagatgactaactacgacctctacctcccagaagagaaagtactcccaaagcactcaatactctacgaaacattcgcggtctacaacgagctgacaaaagtaaagttcatagcagagggactcagggattaccaattcctcgactccggacagaagaaacagatcataaacctccttttcaaagataaacgcaaagtcaccgagaaagacatcatccattacctacacacggtcgacgggtacgacggtatcgaactcaaaggcatcgacaaacaattcaacgcaagcctgtccacctaccacgatctcttgaaaataataaaggacaaggacttcatggatgacgcggacaacgaggccatcctggagaatatcgttcacacactcacaatatttgaagaccaagaaatgatcaagcaatcgctggctcaatacgacgccatctttgaccggaaagtcatgaaggccctgaccaggcgacactacaccggctggggcgagctcagtgcaaaactcattaacgggatccgggacaaacaaaccggaaagatgatcctggaatacctcaaagacgacggcgaaataaatcgcaacttcatgcaactcatcaacgacgactccctcagcttcaaagaaactattcaaaaagctcaagttattggcgaaaccgagaatatcaaacaaatcgtacaagaactcccggggagtccagctattaagaaaggaatcctgcagtctatcaaaattgttgacgagctagtcgaaataatgggttacaacccggaatccatagtcgtagaaatggctcgagaaaatcaattcaccaaccaaggtcgccgaaacagccagcaacgcctaaagaaactcactgactccattaataagctcggctcgagcatcctcgaagaacacccagtcgacaactcacaacttcagaatgaccgcctcttcctctactaccttcagaacggcaaggacatgtacactggagaagccctcgagctctccaaactaagctcctatgacgtagaccacatcatcccacaagcattcatcaaagacgacagcctggacaacagggtccttgtgtcatacgcaaagaaccgagggaaatcggacgatgttccatctctcgaaatagtacaaaagagaaaagccttctggcgccaattgctcgactcccaactaatctccgagagaaaattcaacaacctgacaaaggcagaacgcggagggctaactgaagacgacaaggcgggcttcatcaaacgacaattagtagaaacccgccagatcacaaagcacgtagcccaaatcctagacgcgaggtttaacacggaggtgaccgaaaaaggaaagaagaaacgagcagtcaaaattattaccctcaaatcaaacttagtaagtaacttccgaaaagatttcgagctctacaaagtaagagagatcaacgactaccaccacgcacacgatgcctacctcaacgcggtagtgggaacggcacttctcaagaaataccctaaactagaacccgagttcgtgtacggagactaccccaaatacaattcataccgggaaagaaaaaccgccacagaaaaagtctacttctacagtaatatcatgaacttcttcaaaaccacagtaaaattggccgacggcagcgagaagaaaaggcaccaaattgagacaaacgaggaaacgggggaaatagtatgggacaaaactaaacacttcgagatcgtacgaaaagtcctcagctacccccaggtcaatatcgtgaagaaaacagaagaacaaactgtaggacagaacggagggcttttcgacaataatatcgtctccaaaaacaaagtagtagacgcttcaaaactgatccctatcaaaagcggactgtctccagaaaaatacggaggctacgcgcgtcccaccatagcctactccgtcctagtaatagcagacatcgaaaagggcaaggccaagaaactgaaacgaataaaagagatggtaggcatcacaatacaagacaaaaagaaattcgaggcaaacccgatcgcatacctagaagaatgcgggttcaaaaacataaactccaaccacataatcaaactgccgaaatattcactcttcgaatttgacgacggtcaaagacgcctactggctagctcgatagagctacaaaagggaaacgaactcatcctgccctaccacttaacagccctcctataccacgcgcaacgcatcaacaagatttccgaacccatccacaagcaatatgtcgaggctcaccaaaacgagttcgaagaactcctgacgaccattatttcactcagcaagaagtacattcaaaaaccaaacgtagaatcgctcctccagcaagccttcgaccaaaccgacgaagacatatatcaactatccgaatccttcatatcactcctcaaacttatctcctttggggcgccaggcgccttcaaattcctcggggtcgacatatcccaatccaacgtccgataccaatcggtcagctcctgcttcaacgccaccctaatacaccagtctatcaccggtctctacgaaaccagaatcgatctatcaaaactaggcgaggactga

SEQ ID NO: 6549 - RNA, 4089 nt, synthetic construct
  misc_feature 1..4089: note = Cas9 variant
  source 1..4089: mol_type = other RNA
atgaacgagccatacggtgtcggccttgacatcggcaccaactctgttggttggacagtcgtagacatgaacggtcgcgtaagaaaagtaaagggaaaaaccgcgctcggggcacggttattcaaagagggcgccaccgcagaagaccgccgaggctttagaaccaccagacgccgactaaaacgggtcaaatggcgactacgcctcctgcgcgaatttttcgaccagccaatctccaaaatagacccaaacttcttcgccagacgcaagtatagtgacatctcgccccgagaccccaactacaacggccttgcgaagacactcttcaacgatcgcacagacaaagagttctacgacgattacgctacgatctaccacttgcgagacaaactcatgacgtccaaccgcaaattcgacataagagagatataccttgcaatccaccatatcgttaaatacagaggcaacttccttcgaaccggccccgccagccaatatggctccgcatcactccacctcgcgaccagcttccagaaattaaatgatctcttcgcccaatccgaagaaaccctaaacctaaaactggtgacagacgaggcgttactccagcagatccaacaaatactcgttcgtaccgacctcagcagatccgaacagcaacgccagatatggccactcatggcagtactcaccggggcgagcgccgcggagaagaaaaggcagaaaaatgtagtcgttgaactctcaaaagcgctcgtcggactaaaagcaaaaatgaacgtcgtaacgttaacagaagtggacgcagcagtagtaaaagactggacattcacgatggaagaaagccaagacaaactgccggaaatcgaggaacagctcagcgaggtaggccagcaaatcatggacgaagtcattcaactctatgcctccgtaaacctcgctcaactcatccccgccggcaagagattcagccaacacatggtagagaaatacaaacaccacgagaaaaacctcgaactcctaaaaacatacatacacagccagtccgacagcaaacgcggaagagaaatccgcgccacctacgaccgatacatcgatggggtcgactcgaaaccggtgactcaggaaatgttctataaggacctcatgaagtacgtagaggcagacgccaccagcaaccacctcgcagccgagataaaagacgaaatcgactcggaacaattcatgcccaagctgcgtacgaaacaaaacggctcaataccgtaccaggtccagcaatacgagctagaccagataataagccatcaaaagaagtactacccctggctaggagaggaaaacccggtcgcagagcgacgaggcaaattcccctacaaactagacgagttggttggtttccgagtgccctactacgtaggaccactaatcaccaaagaagaccaacaagcaacatcgggagcaggcttcgcgtggatggtaagaaaagcagacggcccaatcacaccctggaacttcgaccaaaaagtcgatcgaatcgccagcgcaactgcattcattcagagaatgcaaacgaccgacacatacctgattggggaagacgtcctccccgcacgctcgctaatctaccagcgcttcatggtcctaaatgaactcaacaacatgagagtggaagaccgcaagctggccccacaacaaaaacaacgcctctacaatcaagtcttcaaacaacatcaacacgtctccgttaagaacatccaacaaaatctcatggacgcaggagagtaccgggaagcacccaagataactgggctcgcggatccaaaagggttcaactcttcgctaagcacgtaccacgacttcaagaaaatcttacccgaagccatagcggacgaacataagagggccgatatagagaaaatcatcctctggtccacaacgttcgaagacagcgccatcttcaaacaaaaacttgaggaggtcgcctggctcaccgacgcccaacggaaacaactcagcggcctaaggtaccgtggatgggggcaactcagccacaaactcttgatcgcctttaaagacgacaacggacgctccatcatggacggcctatgggaaacttcagacaattttatgcaactcagaaaacagcccgcaatagagacacaaataaaggaagcgaaccaagcaaacctaacggacgcagacatacaagatacaataaatgaactctacacctcaccccaaaacaaaaaggcgatccgagaagtaatgctagtcctcgacgacataaagaacgcaatgcacgggcaaaccccctcctggatcttcgtagaagcggccagagggggaggcgtcgctggccgtagaacccaatccagatccagccaaatagtcgaagcatacaaaggcacggcaaaggagatcgtgtcagagaaagtccagcacgaactaaacgagaaaatcaaagctaaggcggatttcaacacgcgcctggtactatacttcctacagaacgggagagacctctatacaaacgaagccataaacatcgacagactaagcgaatacgacatagaccacatcctgccgcaaagcctagtaaaagacgactcactagacaaccgagtcctaacatctgcacggatcaaccgagagaaaaacgatacctttgccagcgaaaaattcggccgcaagatgggagcacaatggcgagaattgcatagaaacggtcttatgacccaacgaaaactaaaacacctactcatgcgacccgacgaaatcagcaaacacgcgaccgacttcattaatagacagttagtagaaacacgccaagtgataaaactggtcgaggaactgatatcatccgaataccccgccgcatctatcgtcgccgtcaaagcaaacttaacacaccagttccgacagaccttcaacttcccaaaactccgcgaagtaaacgactaccaccacgcattcgacgcctccctaacagccttcattggcatgtacctcctcaagcaataccctaaactcgaacgattcttcgtctacggcaaatttgccaaacaaccaataaacctgacccgtttcaatatcataagaaagctcgcggtcgccgaaaagccgatcgccaacatcgaaactggagaaatcctatgggacaaaacagctgacattaagtacttcgaaaagttatacaactacaaacgacttctcgtcacacatgaggtccgagaaaactacggcgcaatgttcaagcaaacactcttcaaggcttcagacaacaaatctaaaacactcgtccccaaaaagaaccatatggaaacatccgtgtacggcggctactcaaaccaagaaacagcatacctagcgatcgtccgcatacccttcaaatccggctttaaatttatcgtcgtcggcatacccacgaggatggtcgcaaaaataaaacactaccagagccttggcgccaccctaaaacaagccacgcacaaagtcatcgaaccgaaattcaccaaaatcagccgcaagaccaaacaaaccgtgatcagcgactacgaggtcgtactgccgaaggtatacttagatcaagtcgtgagggatcaggtcaaaggccagatgtaccgcttctccttggggagcgacaaggaataccataacgtccaagaactctacctcccgctcagcatacagcaagcattcgtcggacattacgacgagtcagacgaccaaagatcaaacgacctagttaaagtatacgatgccgccctaaaacagctccagcgatacttcccactacacctatcccgtaacttcgaccaagtagcaaatcaagcgcaccagagtttcgagggactcaaaaacaacgtccagaaatcagacaagcaactgggcaagaaagaagtactcaacagtctcttcgtagggctacacgcaacggctacccgaagcaacctaagcgtactgggaatgtcaaaggacttcggaagactacagtcccgatcaggtatcaccctaacggaccaagcagaaatcatctatcaatcccccacaggattattcgaacgaaaagtggccctaaaagacctctga

SEQ ID NO: 6550 - RNA, 4089 nt, synthetic construct
  misc_feature 1..4089: note = Cas9 variant
  source 1..4089: mol_type = other RNA
atgaccaagctcggcaaaccatacggcataggggtcgacataggcagcaactcgataggattcgcggctgtcgacgaaaactcacacctcatacgactgaaaggcaaaactgtcatcggcgccaggctattcgaggaagggaaagctgccgccaaacgccgcgccggacgtaccacacgacgccgtctctcgcgcaaccggtggcgcctgtcattcctgagagacttctttgagtcacacataactccaaccgacccaaacttcttcatgaggcagaagtacagcgagatatctccgaaagacaaagcccgatataaatatgagaaacgccttttcaacgacagaacagacgcagagttctaccaacaatacagtaccatgtatcacctccgaaacagacttatgaccgatcccagcagagctgacgtgcgagaaatctacttcgctatccaccacatactcaagtcccgtgggcatttcctaacccccggcgacgccaaagacttcaatacaaacgacgtagccttggacgaaatattcccagcgctccaggacgcctacgcgcaagtatacccagacctcgggataacttttgacgaagacaaagcgaacgaatttaaaactatactactaaacgaaatcgcaaccagcatcgacacacaaagagccctagtaaaacttctgctagcggaagaagacgacaaagacatactcaaacaacaaaaacaagtcctcacggagttcgcaaaggccgtcgtcggactaaaaacaaaacttaacttagcgctgggcactgaagtcgacagctcagaagcaactgcatggaacttcagcttagggcaactagacgataaatgggcgggtatagaatccgctatgacagacgaaggcactgaaatacttgatcaaatcagggacctatacagagcccggttgctcaacggcatagtcccaaccggtaagacgctctcccaagcaaaagtggacgactatacccagcaccacgaagacctccaactattcaaagcatacctcaaacagctcgaagacgacggaaccgcaaaagccatccgccagctctacgataggtacatcgacggcgacgacgccgcgccgttcctccgggaaaacttcgtcaaagctctcaccaaggacgtcactgcccacccaaacacgaaatcacccgaactactagaacgcctagcccaaccggattttatgctgaaacaacgcaacaaagcgaacggcgccatccccgtccaaatgcaacaaagagagctcgaccagatcatcaaaaaccaagcggtatactacgactggctcgcagcaccaaacccagtcgaaaaacatagaaagtccatgccctaccaactggacgaattactcaacttccgaataccctactatgtcgggccgcttgtgacggcaaaagaacaaaaggctgcccaaggaggggtattcgcatggatggtcagaaaagatcccgaaggaaacatcaccccctacaactttgatgagaaagtcgaccgcgaagcctccgcgaacaccttcatccagcggatgaagaccaccgacacctatctaatcggggaggacgtcctacccaaacagtccctactctaccaacgatacgaagtgctcaacgaactaaataacgtacgggtcaacaacgaaaaacttagcatcgaacaaaagcaacaagtaatccgggagctgttcgaaagacacaattccgtgacaataaaacagttcgcagaaaatctccgcgcacacggtgactacgcccacatcccagaaatacgcggactcgccgacgaaaagaggtttctcagcagcctgtcgacataccgccaactcaaatccctactccccgaggccatcgacgatccggcaaaacaagccgacatagaaaacatcatagcctggtcaaccgtcttcgaagatgccgcgatattcaaaacgaaattaaaagaaatctcatggctcggctcagaagcgataaccaaactttccaacattcggtaccgcggctggggtcaattcagccgaaagttcctcaacggactcaccctcggcaacggccacactatcattcaagaactgctgttgtcgaccaacaacctaatgcagattctcactgacgaaacgctacaaaagaaaatgaccgaactcaacgcggacaagttaaaaactgccaacatcaatgacgcgatcgacaacgcatacacaagcccatccaacaagaaagcactccgccaagtactccgggtcgtagacgacatcaagcgcgcagccgacggccaggacccctcctggctatacgtggagacagccgatggcggcgggaccccaggaaagcgcactagagcacgacaacaccagctccaggaaatctatgcgaatgccgcacacgagctcatcgacaccgccgtccgtggagaactcgaagacaaaattagcgacaaggcggactttaatgatcgtctggtcctttacttcatgcaaggcgggcgcgacatctacacaggcgctccactaaatatagaccaactcagctcctacgacattgaccacatcctgccccaatccctaataaaagacaactcattagacaaccgtgtcctcgtccacgcaatcataaaccgggagaaaaacgcaacctttgcctccaccatctacgcccagaaaatgaacgctacgtggagacaatggcacgaagcgggactaatctcaggccgaaagctgcgcaatctccaaatgcgcccagaccaaatagacaaatacgcctccggattcgttgcccgccaactcgttgaaacccgccagatcatcaaattaacagagcaaatcgtcgccgcccaataccccgatacaaagataatagccgtgaaggccggactctcccatcagttgcgtgaagaactagagttcccaaagaacagggacgtcaaccactaccaccatgcctttgatgcgttcctggcagcacgcatcggaacatacctgctcaaacgttttccgaacctccaagcgtttttcacgtacggcaaatttaccaaagccgacgtaaagaagctaagaggattcaacttcatacgcgacatcacgcacgccgaagacaaaatagtggcaaaagacactggggaggtcgtatgggacaaacaaagagacgtcgatgaactcgaccgcatatacaactttaaaagaatgctaataactcacgaagtccgcttcgaaacagccgacctattcaagcaaaccgtctacggagcccgcgacagtaaagaagccggaggcagcaagcaactcataccaaagaaaaagggttatccagtcgacatctacggaggctatttccgggaaaataccgcgtacctcgcagttgtaaaggtcacaaagaaaaccgaaacaattttcaaagttgtaaagatagcgacctcacaagtcgcggccctcaacaaggcccgcagccggagcacagccgaagaactatcggtgctcaccgaactattaaagcctaaattttccaaggtcggcaaaaacggaaagatcacagacaccccattcgaagtcgtactcccacgagtgcctcgagaacaactgttctacaacgccaaatacggctttttcatggtaaactcagacacaatgttccataacttccaagagatatgggtatcccgcagcgaccagaaaatactccaacagattcgaaaagcaaaaatcgactacccaaacgtcgaccaggaccttgacaacctattccacaacctcgccgaccaaatagttaagtatttcgatctctactccatcgcaggcttcaaggagaaaataagccaatcccaaaacacattcaacgacttagccgttgacgataccgaccagtcggtaggcaaaatcacagtaataaacgaactactcaaaggagcccaggccaacgggatgactggctcccttaaggtcctcaaaatatccaccccattcgggtttacacaggacaaaagcggagtcctcaccaaggacagctccatcatctaccaatccccaactggcctattcgaacgttccgtcaggctcaccgacctatga

SEQ ID NO: 6551 - RNA, 4089 nt, synthetic construct
  misc_feature 1..4089: note = Cas9 variant
  source 1..4089: mol_type = other RNA
atgaccaagttaggaaaaccctacggtatcggggtcgacatcggcagcaactcaataggtttcgccgcagtcgacgaaaactcacacctcattcgcctcaaaggaaaaaccgtaatcggagcccgcctcttcgaagaagggaaagcagccgccaagcgccgggcggggcgtacgacgcgccgaagactatcccgaaacaggtggcgcctatccttcctccgcgacttcttcgaatcacacataactcccacggaccccaacttcttcatgcgtcaaaaatactcagaaatctccccgaaagacaaggcccgatacaagtatgagaaacggctctttaacgacagaacagacgccgaattttatcaacaatactcaaccatgtaccacctacgaaaccggctaatgacagacccatcacgcgccgacgtccgagaaatatatttcgcaatccaccacatcctcaaatcacgcggccatttcctgacccccggcgatgctaaagacttcaacacaaacgacgtagctttggatgaaatctttcccgccctccaagacgcctacgcacaagtctacccggacctcggcataaccttcgacgaagacaaggaaaatgagttcaagaccatcctcctgaacgagatagccacctccatcgacacccaaagggctctcgtaaaactactactggccgaggaggacgataaagacatactaaaacagcaaaaacaagtactaaccgagttcgcgaaagcagtcgtaggcctcaagaccaaactgaatctggccctaggcaccgaagtagacagttcagaagcaaccgcctggaacttcagcctcggccagctagacgacaaatgggccgggatcgaatcagccatgacagacgaaggtacagaaatcctcgaccaaatcagggacctatacagagcacgactccttaacggaatcgtcccaaccggcaaaacactatcacaagccaaagtagacgactacacgcaacaccacgaagatctccaactctttaaggcttacttaaaacaactagaagacgacggtaccgccaaagccatcagacaactttacgacaggtacatcgacggcgacgacgcggccccattcttacgagaaaatttcgtcaaggcactcactaaagacgtcaccgcacatccaaataccaagagcccagaactactcgaaaggctcgcgcaacccgatttcatgctcaaacagcgcaacaaagccaacggcgccattcccgtccaaatgcaacagcgagagctggatcaaatcatcaaaaaccaagcagtgtactacgactggctcgccgcccccaaccccgtagaaaaacacagaaaatcaatgccataccagcttgacgaactgctaaacttccgcatcccatactatgtaggtccccttgtcaccgcgaaagaacaaaaagccgctcaaggaggggtattcgcatggatggtcagaaaagatccagagggcaacatcaccccatataatttcgacgaaaaagtagacagagaggctagcgccaacacttttatccagagaatgaaaacaaccgacacctacttaatcggcgaggacgtgctgcccaagcaatcgttactgtatcagcggtacgaagtgctaaacgaactcaacaacgtcagggtaaacaacgaaaaactaagcatagaacaaaaacaacaggtaatcagagaactcttcgagcgacacaactccgtcactataaaacagttcgcggaaaatctccgtgcccacggcgattatgcgcacatacccgagataagaggacttgccgacgagaaacggttcctcagctcacttagcacataccgtcaactgaaaagccttctacccgaagccatcgacgaccccgccaaacaagctgacatcgaaaacatcatcgcctggtcaacagtattcgaggacgccgccatcttcaaaacaaaactaaaggagatctcctggctaggatccgaagccatcacgaaactaagcaatatacgctaccgtggctggggccaattctcgcgaaagttcctgaacgggctaactctcggcaacgggcatactataatccaagaactcctcctgtcaaccaacaacctcatgcaaatcctcacagacgaaacgctccagaagaaaatgaccgagctcaatgccgacaaactaaagacagccaacataaacgacgcgatcgataacgcctacaccagtccatcaaacaagaaagccctacgccaggtcctcagagtggtagacgacattaagcgcgcggccgacggacaggacccctcatggctatacgttgaaactgcagatggaggcggcacgccgggcaaacgcacccgtgcccgtcaacaccaactccaggaaatctacgcaaacgcagctcatgaattaatcgacaccgcggtcagaggtgaactcgaagacaaaatcagcgacaaagcggatttcaacgacaggctggtattatacttcatgcaaggcggacgggacatctatacaggagcgcccctcaacatcgaccaactctccagctacgatatcgaccacatcctcccccaaagcctaataaaagacaactccctggacaacagggtcctcgtgcacgcgatcatcaaccgcgagaaaaacgcgacgttcgcaagtaccatatacgcgcagaaaatgaatgccacttggcgccagtggcacgaagccggtctcatatccggtaggaaactccgcaacctccaaatgcgcccggaccaaatagacaaatacgcaagtggcttcgtagcacgacaacttgtagaaacccgccaaattatcaaactcacagaacagatcgtagctgcccagtacccggacacaaagataatagcagtcaaagctgggctatcccaccagctccgcgaagaactcgagtttcccaagaatagggatgtgaaccactaccaccacgcattcgacgcgttcctcgccgcccgcattggcacatacctcttaaaacgatttccgaacctccaagcgttcttcacgtatggcaaattcacaaaggccgacgtcaaaaagctacgcggattcaacttcatccgagacatcacccacgcggaggacaagatagttgcaaaagacaccggcgaggtcgtctgggacaaacaacgcgatgtcgacgagctagaccgaatttacaacttcaaacggatgctaataacgcatgaagtacgatttgagaccgctgatctatttaaacagaccgtctacggagcacgggacagcaaggaagctggcggttcaaagcagctaattcccaagaaaaagggctaccccgtagacatctacggaggctacttccgcgagaacacggcctacctggcagtagtcaaagtaacaaagaagacagagacaatatttaaggtagtaaagatagcaacgtcccaagtagccgccttaaacaaagcgagatcaagatcaaccgccgaggaactttcagtgctgacagaactcctgaaacccaaattttccaaagtcggaaagaacggaaaaatcaccgacaccccttttgaagtggtgctcccacgagtcccccgcgaacaactgttctacaacgccaagtacggcttcttcatggtaaactcagacacaatgtttcataacttccaggaaatatgggtaagccgctccgaccagaaaattctccaacagatccgcaaagccaaaatagactacccaaacgtcgaccaagaccttgacaacctcttccacaacctcgccgaccagatcgtgaaatactttgatctgtacagcatcgcaggattcaaagagaagatatcccaatcacaaaacaccttcaacgacctagcggtagacgacacagaccagtctgtgggaaaaataaccgtgatcaacgaactactcaaaggcgcccaagcaaacggaatgacgggatctctcaaagtcttgaagatcagcacaccattcggattcacacaagataagtccggagtccttacaaaagactcctccatcatctaccaaagcccaacaggcctatttgaacgatccgtacgcctcacagacctctga

SEQ ID NO: 6552 - RNA, 4089 nt, synthetic construct
  misc_feature 1..4089: note = Cas9 variant
  source 1..4089: mol_type = other RNA
atgacaaaactcgggaaaccatatggcataggcgtcgacatagggtcaaattccataggcttcgccgctgtagacgaaaacagccacctcatacgccttaaaggaaagacagtcatcggagcgcgattatttgaagaaggaaaagcagccgctgaccggagagcaagccgaaccacaagacgcagacttagccggaataggtggcgcctctccttcctcagagacttcttcgaatcacacatcacccccacagacccgaacttctttatgcgacaaaaatacagcgagataagccctaaagacaaaagccgatacaaatacgaaaagcgactcttcaacgaccgtactgacgccgagttctataaatacgaaaactgccctacgatgtaccacctccgcaaccgattaatgacagatccctcaaaagccgatgtacgcgaaatatacttcgctatacatcatatactaaaatcccgcggccacttccttacacccggcgacgcaaaagacttcaacacaaataaagttgccgtcaacaaaatatttcccgcgctgcaagacgcctatgcccaagtctaccccgatctagatataacctttgacgaaaacaaggtaaacgaatttaaaacagtacttctaaacgaaaaagccaccccatcggacacacaacgcgccttagtaaaccttctcctagccaaggaaggtgaccgtgatatactgaaacaacaaaaacaagccctcacagagttcgcaaaggccgtagttggactgaaaacaaagctaaacgtcgcccttgggaccgaagtggactcctccgaagccaccgcctggaacttctcattagggcaactcgacgataaatggaccggcatagaatccgctatgacggacgagggaacagaaatacttgaccagatccgggacctataccgagcacgactactcaacggcatcgtaccggcaggcaaaacactatcccaagcgaaagtcgatgactacgcgcagcaccacgaagacctcgaactcttcaaagactacctcaaacagctggaagacgacggcacagccaaggccattaggcaattgtacgaccggtatatcgacggggacgacgccaaacccttcgtacgagaagacttcgtcaaggcgctcacaaaagaagtcacggcacatcccaacgcgaaaagccctgaattactagaaagactagcccaacccgactttatgctgaagcaacggaacaaagcaaacggcgccatacccgtacaaatgcaacagcgcgaattagaccagattatcaaaaaccaaagcgtatactacgactggctcgcggccccgaacccggtagagaaacaccgcaagtcaatgccctaccaactagacgaacttctaaatttcagaataccatactacgtcggcccccttgtaaccgccaaagagcagaaggccgcccaaggtggagtattcgcctggatggtcagaaaagaccccgacggcaacatcacgccgtacaatttcgacgaaaaagtcgatcgcgaggcctccgctaacacatttattcagcgaatgaaaacgaccgacacatacctcatcggagaagacgtgctgcccaaacaatcactactttaccaatcttacgaagtactcaacgagcttaacaatgttcgagtaaacgacaacaaattatccttcgaccaaaaacagcaagtcctgggtgaactcttcgagaggcacaacactgttaccatcaagcaattcgtcgacaacctccttgcccacggtgactatgaccgcatcccagaagtacgaggcctagcggatgagaaaaggttcctctccagcctaagcacatacaaccagctcaaaggcatcctacacgaagcaatagacgacagcgacaaacaaacagacatagaaaacattatcgcgtggagcacaatattcgaagacaaggctatcttcaaaacgaaactcaacgagatctcgtggctaaacgccgggatgataaacagcctagccaacatacggtacagaggctggggacagttttcccacaaactactcaacgaactaacactctcaacgggaagaaccgtcttcgaggaactgcttatctcatctcacaacctaatgcaaatcctcacagacgaagtactcaaacagaaaatagcagagctcaacgcccacgaactcaaagcctccggaatctacgccgcaatagacgacgcttacacatccccctcgaacaagaaggccctacgccaagtactatccgtaatagacgacatcacgaatgccgcgggacaagcaccgaactggctctacatcgagacggcagacggcgatggcgtccccggcaagagaaccaatagccgtcagcgcaaaattcaagaaatctacgccaacgctgcccaagagctgatcacaggctcggtacgcggggaactagaggacaaaatagcatcaagagcagacttcaccgaccgactggttctctactttatgcagggcggacgggacatctacaccggaaaacccctaaacatagacaacctctcatcctacgacattgatcacattctcccccagtcactaatcaaagacaattcgctggacaaccgcgtcctcgtacaccccctggtaaatcgagaaaaagacactatattcgcaagcacacgcttcgccaaacaaatgaatggaatgtggagacaatggcacgcggcagggctcatatcttcccgcaaactccgcaacctccaaatgagacccgacgaaatcgacaaatacgccagcgggttcgtggcgcgtcaactggtagaaacaagacagataatcaagctaacagaacaaatcgtggcggaccaatatccagacaccaagataatcgcagtcaaagcaggactgagctcccaactaagaaaagagctggacttccccaagaaccgagaagtgaaccactatcaccacgccttcgacgcattcctggcagcacgcataggcacttacctcctgaaaaggtacccaaacctcgaacccttcttcacctatggaaaattcaagaaaactgaagtcaagaaactaaagagcttcaacttcatccgagacatgacccatgctaaagacaaaattgtcgccaaagagacaggcgagatcgtctgggacaacgcgtccgatataaacgagctagaccggatatacaactttaagaggatgctcatcacacacgaagtccgattcgaaacagcctcactcttcaaacaaacgctctacgcggcgaaaaactccaaaaacaggggcgggagccgacagctcatccccaaaaagaaggggtacctcgttgacatatacgggggctacacacaggagaccgggagctacctctcggtagtacgcctgacgaagaaagcaatgtacgccgttgtcaaagtctcgacccgtgacgcggcaaaactcgccgtagcgaaatcaataagcgaacaaaaggaaaatgagacactaaagaaaattattgacggaaaactctcaaaaacctccaagaaaggcaaaaccacgcaccaactcttcgaaatcgtcctcccacgagtaggccagaaaacccttttcaaaaattctaaatacaaccagttcctcgtaaactcagacacatacatgcacaactatcaagaactctggatgccacgtgaataccagcgcatgtggaaagacatccttctatccaaccacggcgacgcacaattagaaggacaactagaccaaatcttcaaattcatcgtcagccaggtcaactcctatttcaacctatacgacatcaaccagttccgaaagaaaatagccgacgcgacagacaaattcgcaaaactcccaacacacgatacggacaacgcacgagggaaaattgccacaatcggccagctgctcatcggcttgcaagcaaatgccatgcgttccgacctacgcaatctcgacatcaaaacaccattcggactactccagatcggaaccggaatcacattagacctagacacctctataatatatcaaagccccactggactatttgaacgcgaggttccacttacagatctatga

SEQ ID NO: 6553 - RNA, 4089 nt, synthetic construct
  misc_feature 1..4089: note = Cas9 variant
  source 1..4089: mol_type = other RNA
atgaaccaagaaccctacgcaatagggctcgatatagggacatcctccctggggtgggccaacgctgacatggacggctacatcgccagagtcaaaggccagacaggacttggggtccgactcttcgaagaaggacaacctgccgcagaccggcgcagctttcggaccacacgtagacgcctatcacgcaggcggtggcgcctccgattgctgagagaaatattcgacgaacccatctctagcatcgaccctaacttcttcgcccgacaaaaagcatcgtcaatcagcccaaaggacgaccggtttgaaaccacctaccaactattcaacgacaaaaccgatcaagagttctacagcaaatacccgaccatataccacttaagatgggctctaatgaccgaacaccgcaaattcgatttgcgagaaatatacctggcggtgcaccacatagtaaagtacagaggaaacttcctccggtcaggcaaccctaaatcgttcaaacctagcgaactagacttctcccagcgcttcaaggaggtcaacgggctatggcatctcatattcgacgaagtcgcaccccagctccccaccgacaacctggaggagattactaaacttgtcctcgacacgacccgcacccgagccgaccgccaacgcgaatccgtaaaattgctaatggcagcaacagataaccacaaagattggaaaccatatctaacagaatttaccaaagctatcctaggcctcaaaacgaagttatacctgctgacgggggtagatgtcgcgaaagccgaccagaaaacatggacattctcgctggaagacatagaagaccaccgggccgacctcgagacagcctttgacgaccgctcactcgaacttatcgaaaagctcgtagatctccaagccgccatacagctgaccgagataatgccatcaggacagtacttctcacaaagtatgatttacagatatgaccaacacaaagaacacctacgatggctcaaagattacgccgagcaacaaacagacgcaaataagaggaaagccgtgcggctggcgtacgaccactacattgaaggagacgccaaaggtaaacccgaaatagccgatgacttctacaaagagctcaacagaatcctaaaaggcgatacaagcgaattagccaagaaaattaaccacgaaatcgccctagaacatttcatgccaaagcaaaggaccaaagagaacggcgtcattccctaccaaatccaccaacaagaactcgactcgatcatcgacaaccagaaaaagtactaccaattccttggcgaggacaacccggtcgtctcccaccatgggagccaaccgtacaagatcgacgaactcgtctcattccgcgtaccctactacgtgggccccatgatcacagcagaccaacaaaagaaaaccgcggccggtcaattcgcatggatggtgagaaaagactccggcgacatcaccccctggaacttcgacgacaaagtagatcgaacagcctccgctaccaacttcattcaacgaatgaagacaaccgacacctaccttatcggggaagacgttctaccgctccaatcgctcacctaccaaaaattcatggtgctaaacgagttaaacaacattcgtataaacggcgaactcctcacccgagaacaaaaacaacgcacttataatgacgtgttcaaaggtcatggaaccgtcaatgtcaagagtctaatcaaaagccttgagtgccactccgaagtaacgggcgcgattaaagtcgaaggtctagcagacccaaaaagattcaacagcgctctcacaacctaccgtgacttcaaaaagatccttcccgtagccatcgaccaaccccaacgccaagccgacatcgaacgcattattaactggtccacgatcttcgaagacgcggacatattcaaagccaaactccaagaaatagactggctaactgacacacagagagatagactcagtactaaacggtaccgaggctgggggagactatccgccaagctccttctcaatataaaggacacccaaggactatccatcatggaccaactctggaacacacaacacaacttcatgcaaatagtccacgaacccgattacgcagagaaaatcgaaaagactaacgcaaagggactaaaacaacaagatattttcgaaaccatcaatgaaatgtacacctccccacaaaacaagaaagccttacgccagatacttgctgtagtccgtgacatacagaaagcgcaccacggccaagccccatcgagaatattcatcgaagcagcgagaggagccgaacaaaacccccagaggacacgacaacgccagaaacaactagcagatctcttcgctgatcaagcgaaagaaatagtaaacgaaacagtcgcacaggagctaaatgacgaaaccgacaacaaagcacgatttacagaccggctcatgctatacttcctacaaaacgggcaagacatgtacacgggcgagaaacttaacatagataaactctcaacctacgatatcgaccacatcttgccccaatcattagtcaaggacgactcccttgataaccgagtgctagtatcaaaagtagaaaacctaaagaaaaacgaccacttcgcctcagaactttacgcacgcaaaatgcaaggcacatgggagctctggcgctcggcagggctaatatcggcacggaaactaaaacatctgctcatgcgccccgacgaaatcaacaaatacgccacaggtttcatccgccgccaactggtagaaacccgtcaggtcatcaaactggtcacagatgttctatcgaacgagtacgactcagataaaacgaaaataatctccgtcaaggcaggcctttcccaccagctacgcatggagcttgatttgccaaaggttcgggaactcaacgactaccaccatgccttcgacgccttcctagccgtccgaatcggaacatacttacttaaaagatatccaaaactcgaacggttcttcgtctatggccaataccaagtggccccacagctagatctaagacgcttcaacttcatccacgatctagtcagcggcaagcaagagaagatagtagccgaagagaccggcgaaatcgtgtggaaccgagaaaaagacgtaagctacatgaaacatctgctctcactcaaacacctcctagtcactcacgaggtcaaagaggaccacggggccctcttcaaccagaccatatacaaggcaaagaaagataacggcaacgttggcggcaaaatgaaactcctaccaacaaaaagcaaccgcccaactgaaatctacggcggacacagttcccaagcgatcgcctatctggcgattgtccgagtgaacggcaaagaaccgtcctacagggtcatgggagtaccaatacggatcttagaccagttaaagcaagcaaagaaacagggagagtacgccgaaagactggcccttaaacaattcttcaccccggacttcactaaaggcaaaggcaaaatcgtctccgacttcgatgtagtcatacctcacatcccactgctacaacccgtcatagacgaaatctccggccagtcacaccgattcgcgttaggaacaaacacatactacaggaacctacaacaactgatcctcaccctcgccgaccagaaagtactcatcagcaaggaaacgggcgtcgacgaagaaaagaaacttgtcgaagtttacagtcacatctgccaacaagtcatgaaatttttcccgctctacgaccgcaacaaattccgcgaactattagtagactcacgctcccacttcgaacaactcccaatcgttaacaggtactcagacgctggcaaactagaaatagcaggaaaacgcggaatcctacaacagatcatggtcggcctccacgccaacgccacgcctggcgatctaaaagagctcggcgtcaaaacccctttcggcaagctccaagttccgggcgggatcaaacttaccgagaacgcaaaactaatatacgaaagcccaactggcctcttcaaacgggaagtgaaaatcacaaccgaatga

SEQ ID NO: 6554 - RNA, 4089 nt, synthetic construct
  misc_feature 1..4089: note = Cas9 variant
  source 1..4089: mol_type = other RNA
atgaagaagaaagcagagaagatatacctgggactcaacgtaggaaccaactcaatcggatacgcagtcacagacgagcagtaccgcctcctaaaattcaacggcaacgatgcctggggctcgatagtattcgacgcagcctcttccaacgaagaccgccgcaaccaccggctcgccaggcggaaccttgaccgccgccaacaacgcatcgtatggctccaggagatcttcgcgaaggagatctcaaaagtcgacgacagattcttcatcagactgtcggaatccttccgctggcgcgaggacgtccaagaccgatacgtgttcttcaacgacaaagagtacaccgatgtacaatacatgaaagaatacccgaccatccatcacctaatctgcgagctgatggacaacaaaacaccacacgatgtccgcctcgtctacctagcctgtgcttggctcataacgcaccggggccatttcctcaacaatctgaacgtcgagaaactcgacgagataatggacttcagtagcgtatatcagaacttcataaactacttcacagagaacggctacaaacgcccatggggcgaaatcgacgtatccgccctgagtgaagtcctaaaacaaaagaccggtatcacggtgaaaaataaagaactacagaacatccttcttgagggtaagaaacccgagaaatcgggcacagaggagttcccattctcacaagattcaataatccggttactggcaggaggacaatgcaagctaaaagacgtattctgcaaagaagaatacctggacttagggtccgtcagcctcggcatggacgaggagaaatttgacgaaataagcggatccatcggcgaagactacgacctcctcatcgctctgcgagggttatacgactggagcgtgctagcaaacctcctcaacggccatagtgaaaccatatccatggcaaaggtccagatgtacgaacaacacggaaaagacctccaaatactaaaatacttcgtccgcaaatacgtcccagacaaatacaacgaagtattccgcaaagccaaagccgacaactatgttgcctacacgggccacatggacaaagataccgcgtcccaaatcaaaaagaaagcaaaagctgaagagttctcgaaatacgtcctcaaactcatgagccccatcaagcccgaaaagacggatctgcagtcctacgaagacatgtgcgaacgcttaaagctaaaccgcttcctgcccaagcaaaagaacacagacaaccgagtaatcccccaccagctctacgaatacgaacttattcaaatcctgaaaaacgcgtccgtctacctaccattcctaaacgacacaaataacggcatatcggaagcagacaaagtactcagcgtcttccggtacaaaataccctactacgtcggcccactgaacgaggaaagcagcttcgcctggatatcgcgaaaacagggtaaaatcacgccgtggaacttcaaggaaatggtcgatgaagacgcatcggagaacgcgttcattaggcggatgacaaacaaatgcacgtacttgcctaccgaagacgtcctccccaaagacagcctttgctaccaaaagtttatggtcctcaacgaaatcaacaacctccagatcgacggcctcaagattccagtaaaggcaaaacaagggatataccacgaactattcgagaaaaataagaaagtgaaacgaaaagacatcgaagaatatctcatccgcaacaactacctagacaaagactccaccgaattaatctcagggatagacgagcagatccattcaggtctcagcagctactgcgcctttttcaacctcctaaataagaaaattctcagcgaagacgacgttgagcgtataatcgagcgcgcctcctacgccgaggacaaatctagagtcattaaatggctacgcaaagagtatcccggactctcggaagacgatatacgctacatcgcacgaataaaaatacgcgatttcgggcggctatcaaaaactttcctcactggcctcaaagggtgcgacgtcagcaaaggcttcgatggacaggacgtcgaaatgatctcaatactacaaacaatgtgggaaacaaacgacaacctcatggagatcctctcagacaaatacacatttctcgaagcgctcgaagcgttcacccaggagtactatacagggaaaaagaaaagcctcaaagagcgactggacgaaatgcgtgtatcaaactctgtgcgccgaccagtttaccgcacactcgcagtcgtcaaagacatagaaaaagcattcgggaaacccaacaaaatcttcgtcgaaatgactaggggcggccaagcggatcagaaaggcaaacgaatcaaatcgcgcaaacaacaaattctggacctatacgacaaatgcaaagacgacgtacacgacctgatgtggcaactcgaatccctgggcgagtacgccgacagcagactccagagcgatcgcctgtacctctacttcatgcaattcggcaaatgcgcatacagtggagcacacataggcttcgagcaactaatggcagggtccgtagaatacgacatcgaccatatctacccgcaaagttatgtcaaagacgatagccttaacaacaaagtcctggtactatccgacctaaatggcaccaaagacaacatatatcccgtctcccccgaaatcaggggcaaaatgcaaggactatggtcgtggtggaaccatgtgggcgccatatccgacgaaaaatataaacgacttatcaggagcgccccgttcacggatgaggagaaaatgggtttcataaatcgccaactcaccgaaacctcacagtccacgaaattcatagccgacctgctcaaagaacggttcccggacgcggaagtagtctatgtcaaagctggcctcgtaagcgacttccgtcacgagttcgacctccccaaatctcgatcgtacaacgacctacacaacgctgccgacgccttcctaagcgtagtcgcgggcaacgtctacgacatgcgctttagcaagaaatggttccgaatagacgaaaaatactcagtcaaagtaaaaaccatcttcacgcacgaagtgaaatgccgcggagatataatatgggacggtatgcctatgctcgaaaaagtcgaggataccgctcgcaaaaacactgcacatttcgtcaaatacgcagctttcaaaacgggcggcctcttcgaccagaacccggtcaagaaaggaacaggcctaatcccgctgaaagcagggctacccaccgaaaaatatggcggctacaacaaggccgggatcatgttcctcatacccgtaagatacaacataggaaagaaaagcgaaatattaatcctaccggtcgaactaatgcacggaaaacacttcctagaagacaaagtttttgcacgcaactatacattcacacgcctagaaaatattctaggcaagaaagtgggcgaagtgtcatttcccatgggaatgcgaccctggaaaataaacaccatgctctccttcgacggattccgcgtgtgcctcacgggcacctcaggccgaggcaaatgcctagtagcgcaaccggtcatgcaattcagcgcggacgagcactggagattctatgtcaaacgcctggagagattcgtagagaaaatcggcataaatccagacttactctacgacaaggaccacgacaaagtctccaaagacgaaaacctgaaactttacgaactctacgtagacaaactacaaaacaccatatacaagaagagagtcaactcacccgtccaaaccctgctaaaaggcaaggaagagttcaagaagctcagtatcgaagaacagtgccaagtcctcctcaacatccaaagcgtattcggcaggatgacaggcggctgcgacctaaccctgataggtggcagcgcccacagcgcggcgaccggaagcctttcgactacaatcagcaattggaagaagaagtactcaaccgttcgtatcatcgaccagagcccgagcgggatgtgggagaaatcgtcagaaaatctgctcgacttcttatga

SEQ ID NO: 6555 - RNA, 4092 nt, synthetic construct
  misc_feature 1..4092: note = Cas9 variant
  source 1..4092: mol_type = other RNA
atgaccaaactcggtaaaccatacggcataggcgttgacatcggcagcaactccataggcttcgcggccgttgacgagaactcccatttgatccggctcaaagggaaaacagtcatcggggcccgattgttcgaagaggggaaagccgctgccgatcggagagcatcccgcaccacgcgccgcagactgagccgaaaccgctggcggctttccttcctcagggactttttcgaatcccacatcacacccaccgaccctaacttcttcatgcgccaaaaatactcagaaatctccccaaaagataaagcaaggtacaaatacgaaaagcgcctcttcaacgacaggaccgacgccgagttctaccaacagtacccaaccatgtaccacctccgaaacagactcctcaccgacccatcaaaggccgacgtaagagaaatctacttcgcaattcaccacatactaaaatcccgcggccacttcctcaccagcgggtacgccaaagatttcaacactaacaaagtcgcactcaatgaaatcttcccagccctccaggacgcatacgctcaagtgtatcccgacctcgacatcacattcgacgaaaataaagtcaacgaatttaagaccgtgcttctcgatgaaaaagccacaccttccgacacacaacgagccctagtcaatctcctactggcagaagacggcgacaaagacatcctcaaacaacaaaaacaggtcctcaccgagttcgcaaaagccgtcgtcggacttaagatgaagctgaacgtcgccctcggcacagaagtcgactcgtcagaagccacggcatggaacttctcactcggacagcttgatgacaagtgggcaggtatagaatctgccatgaccgacgaaggtaccgaaatccttgaccaaatacgcgacctgtaccgcgcccgactcctcaacggaatcgttcccgcaggcaagacgctctcgcaagcaaaagtagacgactacgaacaacaccatgaagacctcgaactcttcaaagattacttgaaacagctcgaagacgacggcatggcaaaggtaatccgtcaattatatgaccggtatatcgacggagacgacgcgaaacccttcgtccgcgaagacttcgtgaaagcactaactaaagaagtgacggcgcaccccaatgccaaatcccctgaactcctagaacgcctagtccaacccgacttcatgctaaaacagcgaaacaaagcgaacggcgccattcccgtgcaaatgcagcagcgagaactagaccaaataatcaagaaccagagcgtttattatgactggctggccgcacccaaccccgtcgaaaaacacaggcagagcatgccataccaactggacgaactactaaacttccgcattccatattacgtcggcccactcgtcaccgccaaggaacaaaaggcagcgcaaggcggagttttcgcctggatggttcgaaaagacccagacggaaacattacgccgtacaacttcgatgaaaaagttgaccgcgaagcatccgcaaatacctttatccaaaggatgaaaacaacggacacctatctaattggggaagacgtgctgcccaagcaatccctcctctaccaaagctacgaagtcctaaacgagctcaacaacgtccgcgtcaacgacaacaaactatccttcgaccagaagcagcaggtcctaggggaactcttcgaacggcacaatacggtcacaataaaacagttcgtagacaacctactcgcacacggagactatgacagaatccccgaagtacgcggtctcgccgatgagaaaaggttcctttcctctctctccacgtacaaccaactcaaaggaatactacacgaagccatagacgactccgacaaacaaaccgacatcgagaaaataatcgcctggagcacaatctttgaagacaaagccatattcaaaacgaaactgaacgaaatatcttggctaaccgcaggaatgatcaactccctcgccaacatcagatatcgcggctggggacaattctcccacaaattactaaacgaactcaccctgtccaccggacgcaccgtctttgaggaactcctgatatcctcgcacaacctcatgcaaatcctcacagacgaagtactgaaacaaaagatcgcagaactcaacgcgcacgagttaaaggcctcaggcatctacgccgccattgacgacgcctacacatcaccgtcgaataagaaggcactacgtcaagtactatctgtaatcgacgacattacaaatgccgccggccaagccccgaattggctctacatcgaaacagcagacggcgacggcgtccccggcaaacgcaccaacagccgccaaagaaaaatccaggaaatatacgcaaacgctgcccaagagctcatcaccgggtcagtgcgtggggaactagaggacaaaattgccagcagggcagacttcacagaccgcttagtactatatttcatgcaaggcgggcgagatatctacacaggtgaaccactcaatatagacaatctctcaagctacgatatagaccacatcctcccccagtccctgatcaaagacaattcgctagacaacagagtcctggtacacccattagtgaaccgagagaaagacactatcttcgcgagcacacgattcgccaaacaaatgaatgggatgtggagacagtggcacgcggcaggactgataagcagccgcaaactccgcaatctacaaatgcgccccgacgaaatcgataaatacgccagtggatttgtcgcccgccagctagtggagacgcgccaaataataaaactcaccgaacaaattgtagcagatcaataccccgacgccaagataatcgcagtcaaggcaggactcagctctcaactacgcaaagaactcgacttcccgaaaaatcgcgaggtcaaccattaccatcacgcattcgacgccttcctcgcagcacgcatcggcacctacctcctcaagcgttaccccaacctggaaccattcttcacctacggaaagttcaagaaaaccgaggtaaagaaacttaaatctctgaaatctttcaacttcatccgggacatgacacacgccaaagacaaaattgtggccaaagagacaggcgaaattgtatgggacaatgcgagcgacatcaacgaactagaccgaatatacaacttcaaacgtatgttaatcacgcacgaagtgcgattcgaaacagcgtcactattcaaacaaacactatacgcagccaaaaactctaaaaaccgcggaggaagtagacaactaattcccaaaaagaaaggctaccttgtagacatatacggaggttacacccaagaaacaggatcatacctaagtgtcgtacgacttactaagaaagccatgtacgccgtagtcaaagtcagtacccgcgacgcagcaaaattagctgtagctaaatccatcagtgaacagaaagaaaatgagaccctgaagaaaataatcgacggaaaactctcaaaaacctccaagaaaggtaaaaccacacaccaactgttcgagatcgttctgccccgagtaggccagaaaactctgttcaaaaactccaaatacaaccagttcctggtcaactcagacacctacatgcataactaccaagaactatggatgccaagggaatatcaaaggatgtggaaagacattctactctcaaaccacggcgatgcacagctagaaggacagctcgaccagatcttcaaatttatagtctcccaagttaattcatacttcaacctctatgacatcaatcaattcagaaagaaaatagccgacgccaccgacaaattcgccaaactccccactcacgacaccgataacgcccgaggcaaaatcgctaccataggtcaactcctcatcggattgcaagcaaatgcaatgcgatccgacctccgcaaccttgacatcaaaacccccttcggtctgctccaaatcggaacaggcatcaccctggatcttgacacctcgatcatataccaatcccccacaggacttttcgaaagagaggtgccactaaccgacctctga

SEQ ID NO: 6556 - RNA, 4092 nt, synthetic construct
  misc_feature 1..4092: note = Cas9 variant
  source 1..4092: mol_type = other RNA
atgcggggcaactaccatataggcctggacatcggaaccagtagcataggatgggccgtgatagacgacaacgcgaaagtgatgcgcgcgaaaggcaagactgcaatcggcgcaaggctttacaacgaaggccagacagccgcagaccggcgactattccgcacgactcggaggcgcctgaaccgacgcaaatggaggctcaaacttcttgatgaaatcttcgacccatacataacaccggttgacgcagctttcttcgcgcgcctaaagcagagcaacctcagtcccaaagaccagaacagagactggaccggatccatgcttttccccgaccgaaccgataggaagttccacaaagactacccgacgatataccacctccgacacaaactcatgacggaagaccaccaattcgacatccgcgaaatatatctagccatacatcacatcgtcaaataccgcgggaacttccttaacaccacaccagtcagctcattttcagtatcggacgtgaaatttgacgaacaattcgacagactcaatgaactctacgccgccgtatctcccgatgaaccattcgcaatcaacggcgacaactccaaggccattgagactttactcctgagcgatgaaacgaagaaattcgacaagcaaaaacagtcagcaaagctcatcctaagcgagacaggggacaaggcactagacaaggaaaacacaaaagtagcgacgcagatatcgaaagcgatactgggctacaagacccaactagacgtcctactaaaatacgacgcaataaattcctccgcctggaaaatcgaattagatgacgaaaacatcgatgacaccctaccgggtctgctgagtcaactagacgaaaacaggcaagaaatggtctcgataattcaaaacctatacgcccaagtaaccctgaaccaaattgtgccaaacggtatgtccctaagcgaaagcatgatcgagaaatataatgcacacagagaccacctaaagctactaaaacagctagaagacaaaatagacgacccaaagaaaaagaagggcctagaggccgcatacgacgcatacgtaggcaagaacatgaaagtagccaaccaagacgtgttctatgcctccgttaagaagaacctcgacgacagcgaccttgctaaacagatagcagacctcatagaagcccaaaaattcatgcccaaacaacgaacctcgcaaaacggcgtaattccgcatcaactacatcaactggaactcgaccaaataatcgaaaatcaaagcaaatactacccatggctaacagctgcaaaccctaacccaaaacgcatacaccaggcgaagtacaaactcgacgagctagtggcgttccgaataccttactacgttggccccctcgtaacacccgaagaacaggaaaaatccgcaaaccaagtattcgcctggatgaaacgaaagcagccaggaacgataacgccgtggaactttgatcagaaagtagaccgaatggcatcagccaatcgcttcatacgccggatgactacaaaagacacctacctcattggagaagacgtcttacccgacgcgagcctcatatacgaacgcttcaaggtgttaaacgaactaaacctagtgaaagcgaactaccaccgcctggcgcctgcccaaaaacaagccgcctatcgcgacctcttcgaaaaccaaaaatccatcagcacaaagaaactccaaaactaccttgtcgaccagggctatttcacagcaaaacctaaaatcacaggattgtcagaccctgaaagattcaactccagcttaggaacatacatagacttcaaagaaatattcggagaccaagtggacaacccagaccgccaagacgactacgagaaaataatcgaatggagcaccgtcttcgaagaccgccaaatctacgaagccaagctacggacactggactggctgaccgaagaccaaatacaagcactgaaaacaaaaagatacaacgggtgggggcgactatccaagaaactactcacgggcatcgtagatgaaaacggcgaacgcatcatagacgttctttggaataccaatcagaacttcatgcaagtccaaagccaagagagcttcgccaaacgaatccacgaagccaacgcaaaacagatgaaagtaacaggggtcgaggatatcttagcagacgcctacacatcgccgcaaaacaagaaagcaataagacaggtaatacgggttgtggacgacatccaaaaagccatgggcggagtcgccccaacatccgtctccatcgagttcacccgaagcgaagatcaaaacccacgaagaacacaaagccgtgaatcacaacttcaaaacacattcaaagtagacgcaaaggaaatcgtcgactcagatctggtcaccgaactggaaaccgtgtcgaaatcgaagaaaggcctcaccgaccgcctgtacctatacttcacccaattgggcaaagacatgtacacgggcgatcccctgaacattgatgaactctccacctatgacattgaccacattctaccacaagcgttcatcaaagatgactctctcgacaaccgcgtacttgtcagcaaagccgtcaacaacggcaaaagcaacaacgtccccgtcaaactcttcggcggcaaaatgggcggattctggaaggaactagcggaccaccgactcatctcaaagcgcaaactcaagcaccttctaacagatcctgacaccatagacaaatacacaatgagaggattcatccgccgccaactggttgaaacgagtcaggtaataaaactcgtcgcccaaatacttggagacaaataccaaaacgacgatactaaaatcatcgaggtcacagccaagatgaaccatcagatgcgcgaaaacttcaagctaatcaaaaatcgcgaagtgaacgattaccaccacgccgtcgacgcttacctaaccgccttcgtaggccaatacctctacaaacgataccccaaactacgaccttacttcgtatacggcaatttcaagaaattcaacgaggaccatgtatcattccgctatttcaacttcctccacgaactcatggacgagaacaataaacgtatcgtagagccagaaacgggcgaagtcgtactcgaacgagaacccgccatagcctacatgaaaagggtctaccacttcaaattcatgctcatctcccaagaagtatacacacgacgcgacgccatgttcaaccaaaccatctatccagcaaaagaagcaaacagaagaaaactaatcgcgatcaagcatggcaaacccgttgacgtatacgggggctactccggctccgtcgatgcctacatggcgatagtgaggatacacgacaagaagggcgacaaatataaggtcgtcggagtaccaatgagagcactagaaatactcaacgcgacacacgataagaaggactacgacgcgaaactcaaacaaatattagtaccgaaatttaccaaagtcaagaaaagccgcaagacaggagaaatcacgaagaaagtagaggacttcgaaatagtactcggaaaagtaatgtaccggcagctagtcatagatggcgacaagaaatttatggtagggagcagcacctacctatacaacgcccgtcagctagtgttatccgacagcagccttgacacactagcaagtaaaggcaccctagactcagacgcagatagcaaaaggctagtcgcggtatacgacgaaatagtcgagaaggtcgacaaatactttcccctctacgacaagaacgcattcagaagcggcctccacaaaggacgagacaagtacctgctgctgcccaatagaagcacgttcaacggagcgaaaaaggtccactccggaaaacgcgaaatactaaacgagatcctcaacgggctccacgctaacgcgaccctgggcggactcaaagacctgaaaatatccacgcccttcggcaagatgcaaggccaaagcggcatacctctctccagcaacacgatcatctgctaccaatcaccaacaggcctcttcgaacatagagtcagcctaaaagatctctga

SEQ ID NO: 6557 - RNA, 4092 nt, synthetic construct
  misc_feature 1..4092: note = Cas9 variant
  source 1..4092: mol_type = other RNA
atggaaaacaaccgctacaacgtaggacttgacataggcacaagtagcatagggttcgccgtaacagacgagcaagatgaactcgtccaggttaaggggaaaaactatataggagtccgactattcaaagagggacaaacagcttccgagcgacgatcgttccgcacaacgcgccgtcgcctgaaacgtcgcaaatggcgattgggattgctcgaggagatattcgccccctaccttgcccaaggcgacccgtacttcctcgcgcgcatgaaagaatcaaatatctccccacgcgacgaacgtaagaaatactacggcagcctcctcttctccgacgacaccgtcttctatgacaaataccccacagtataccacctccgccacgctctaatgaccgaagaccgcaaattcgacatcagagaaatctacttagctgtacaccatatcataaagtacagaggaaacttccttatcaacaccctaatcaacgagttcagctcgaaagccgtcgacttcaagaaagacgcagacatcctaaacgatctcttcgaacaattctacatcagcgacataaatgactcgttccagctcaacaccgccgacatgaacgagatttcagaacttctgctcgacaactcaaaaacgcggctcgacagacaaagagaatctctaaagaaactagcaaagaaagttgacgacatatccgtggcaaagaaacaccagaaaatcgccaccgaattttccaaagcaatcctaggaaacaaagctaaattcgacgtcatattaaacgtaacaaccgactcatccaacgactggtcgtttaaactcgaagacgaggacgcggacgagaaaatagtcgtgctcctcgaagagttaaataccccgcaacaagaagccctcaacataatccaccaatggtacagccaaataagccttaacggaatcgtaccagatggcaaatcaatcagcgaggccatgataagctcttacgaactacacaaagagcacctggccctgctaaaacaacaaattaacaacacaaaagacaagaagaaggcgcatggtctccacgaagcctacaacgaatacgttcatggaaacaacaacaagaaactcaaccaagcagatttctactccaaagtcaaacaaaacctcgagagcagcctaatcaccgacgaaatcctcgaactaatcaacgcggaaaatttcatgcccaaacagcgaacaagcgcaaacggggtgataccccaccaactccatcaacaagagctcgaccgaatcatccaaaaccaggctaaatactacccattcttggcggaaaccaacccaaacgaaaaacgcagcaaagtagccaaatacaagttggacgaacttgtggccttccgcgtcccgtactacgtcggcccccttattaccgcaacggaccagaagaaaacctccgggaaagagttcgcctggatggtccgcaaacaaccaggacgaattacaccttggaacttcgacgaaaaagtaaacaagatggaaagcgcgaataccttcattagacggatgacgacgaaagactcatacctgatagcggaggatgttctacccgacgaaagcctcctgtaccagaaattcaaagtactcaacgaactaaacaatctgcgcgccgacggtcgcaagctaaaggtaagcgttaagcaaaaagtgttcaaagaactcttccaacaacagaagactatcaccatagtaaagctccaaaactacctaaaagcggaatgctccttcctaacaacacctgagatcagcggtctcagcaaaccagaacacttcgtgtcaagcctcgccacatacattgacctaaagaaaatcttcggagaagacatcgacaacccagcccgccaaaacgacttcgagcggatgatagaatgggctaccatcttcgaggacaaaaacatatactcggagaaattaaacgaaataaagtggctgaatgaccgccaaaagaaagagttgaaaaacaagaactaccatggttggggtaagctatccgccaagctcctcaaaggcctgagggactccgacgaatgctccataatcgaacacatgtggaacacccagcaaaacttcatgcaagtacaggccgaggaagacttcgcccaaagaatccaagaagagaacaaccaacacctcaaaggcaacacactagaagaagtccttgcagatgcatacacaagcccccaaaacaagaaggcaatacgccaagtagtaaaggtcattgaagacatccaaaaagcaatgggcggcatagcaccccagaaaatctccatcgagttcacccgagccccggaagaaaaaccacgaagatccgtcgagcgccaacaacaaatcgagaaaatctacaagtccgtcgccaatgaagtcgaaaacgccggtgtcaaagacgaactccaaaggttcagcgaccgcaaacaaaccctaacggataaatacttcctctacttcacacaactcggcaaagacatgtacaccggaaaatcgatcaatatcgatcaaataggcaactaccaaatagaccatatacttccgcaagcattcataaaggacgatagcttagacaatagagtcctcgtaagcgccgccgtaaataacggtaagagcgacaacgttcccacgaaaaacgaccgatacaaggtccgcgagcacgggcaacgactctacgaccagggcctaatcagtaagagaaaattcaacaatctaataacagaccccgattcaatcaacaaattcaccgcccgaggatttgtcaaacgacaactcgtcgagacctcccaagtaatcaggctggtcgcggagttcctgtacaataaataccagtccaaaagcgaaatcattgaagtgcgagccaagatgaactcccaattgcgcaaagacttcgggctcatcaaaaatcgtaacgtaaacgactaccaccacgccctcgacgcgtacctcactaccttcatcggcaactacctataccgaagataccccaaactccgcgcctacttcacctacggctgcttcaagaaagtggacgacagccaactaaaatacttcaacttcctgcacgacatagaagacgacaagaagaaaataataaaggacaacgacaccggcgaaatcctctggcacagggacgaaggcatcgcgcgtttcaaacgtatttacaacttcaaatacatgctagttacacacgaggtcctcacgcgccagggtgccatgttcaaacagacggtatactccgccgcagttgcgggcagcaagaaactcatccccgtaaaagaagaccgacccatcgacatctacggaggatacaccaacaacaacgacgcgttcctagctatagtaaaagtcaccaagaagaaacaatacatggtagtcggaatccctcaacgtgccgtcgtcaaactcaacgacgcggcgaagcagggaagcaaagcatatcaaaaggtgctatataacgtcatcaaaccccaattcataaagaagaagaaggaccgaaaaaccggaaaaattacacaaaagctcgaaaacttcgaaattgtcgtatcgaaaaccctatatcgacaactcattatcgacggggaccaaaaatacatgttaggctcctcagcttacaagtacaacgcgaagcaactggtcctatccgaatacgccttggaagtgctagatcgctccatattcgagaaaaaggaatacacgacggtcgacctagacaacgtgtacgatgaaatactcgcccaggtagacaaatacttctccctctacgacaaaaacaaattccgacaaaaactacacgaatcccgcaagatcttcaccgagctcccgatcaacaacctcttctccggtacgaaattgctcaaatccggaaagagggaaacactcaacgaaatcctcgaaggcctccacgccaacgcgacgaagaaagatctaaaatcactgaaattcagcacacccctgggcatgatccagtacccgtcgggcattatactatcagaaaatgcaattctctgctaccaatctccaaccggaattttcgagcgccgagtcacccttaaagacctctga

SEQ ID NO: 6558 - RNA, 4092 nt, synthetic construct
  misc_feature 1..4092: note = Cas9 variant
  source 1..4092: mol_type = other RNA
atgaccaaattagggaaaccttacggcataggcgttgacatcggatccaattccataggtttcgccgccgtagacgagaactcacaccttatcaggcttaaagggaaaacagtcatcggggccaggttattcgaagaaggcaaagcagcagctgaccggagagcctcccgaacaacccgaagacgactaagcagaaaccgttggcgactcagcttcctccgagatttctttgaatcacacatcacgccaaccgaccctaacttctttatgagacaaaagtactccgaaatatctcccaaggacaagagccgatacaaatacgaaaagcgcctatttaacgaccgcaccgatgccgagttctacaaatacgaaaactgccccaccatgtaccaccttcgaaaccgactcatgaccgacccaagcaaggcagacgtccgcgaaatctacttcgccatccaccacatactgaaatcccgcgggcacttcctcacaccaggcgacgccaaagatttcaataccaacaaagtcgccgtcaacaaaatcttccccgcattacaggatgcatacgcacaagtgtatcccgacctcgacatcacattcgacgaaaacaaagttaacgagttcaaaaccgtccttctaaatgaaaaagcaactccctcggacacacaacgcgccctcgtaaacctactcctagcaaaagagggagaccgtgacatcctcaagcaacaaaaacaggccctaaccgagttcgcaaaagcagtcgtcggcctgaaaaccaaactcaacgtcgctctaggaactgaagtagactcgtctgaagccaccgcctggaacttcagcctcggccagctggacgacaaatggacggggatagagtccgccatgaccgacgaggggacggaaatcctcgaccagatacgagatttataccgagcccggcttctgaatggcatcgtcccagccggaaaaaccctcagccaagccaaggtcgacgactacgcccaacatcacgaagatctagagctctttaaagactacctcaagcaactagaggacgacggtaccgcaaaagcgatccgccaactctacgaccgctacattgatggcgacgacgccaagccattcgtaagagaagacttcgtcaaagcactaacaaaagaagtgacggctcaccccaacgcgaaaagtcctgagctcctcgaaagactcgcccaaccagacttcatgcttaaacaacgaaacaaggccaacggggctatcccagtacaaatgcaacaacgggaactcgaccaaatcattaaaaaccagtccgtgtactacgactggctagccgcccccaacccggtcgagaaacaccgaaaatccatgccataccaattggacgaactccttaacttccgaatcccctattacgtgggccctctcgtaacggctaaagagcaaaaggccgcccaaggtggagtgttcgcctggatggtaagaaaggacccagatggtaacatcaccccatacaacttcgacgaaaaggtcgacagagaagcatccgccaataccttcatacaacgaatgaagaccacagacacctacctcatcggcgaagacgtcctccccaaacaaagcctcctataccaacgatacgaagtgttaaacgaacttaacaatgttcgcgttaataacgaaaagctgtccatagagcagaaacaacaagtcatccgagaactgttcgagagacacaactcagtaacaattaagcaattcgccgagaacctccgcgcacacggagactacgcccacatgccagaaatacgggggctcgcagacgaaaaacgcttcctctcctccctatcaacttatcgccaactcaagtcactactacccgaggcaatagacgacccggccaagcaagccgacatcgaaaacatcatcgcctggagtacggtctttgaagatgccgccattttcaagaccaaacttaaagaaatcaactggctcgactcacaaacaataaccaaactctccaacattagatacagaggatggggacaattctcacacaaattcctcaacggcctaaccctcggcaacggccacactatcatccaagaactatttctctcaaacaacaaccttatgcaaatactaaccgacgagactctccagaaaaagatgaccgagcttaacgctgataaactgaaagcggcgaacataaacgacgccatcgacgacgtatacacctcaccctcgaacaaaaaggcccttcgccaagtcctccgggtaatcgaagacataaagcgtgccgctgacggccaagacccatcctggctttacgtagagaccgcagatggaggcggaacgccaggaaagaggacccgcgcgcgtcaacatcaactccaagaaatatatgcaaatgcggcgcacgaactgatcgacagcgccgtccggggagaactagaagacaagatagccgacaaagccgacttcaatgaccggctcgttctatacttcatgcaagggggcagagatatctacacgggcactccattaaacatagaccagctatctagctacgatatcgaccacatactccctcagtcgttgataaaagacaattcactcgacaaccgggtacttgtacacgcgatcatcaaccgggagaaaaatgcaaccttcgcctcgaccatatacgcgcagaaaatgaatgccacctggcgccaatggcatgaagctggcctaatttccggccgcaaactccgcaacctacaaatgagacccgaccaaatcgacaagtatgcatcgggattcgtcgcacgccagctcgtggaaacacgacaaatcatcaaattaaccgaacaaatcgtagcagcccagtaccctgaaacgaagataatcgcagtgaaagcaggcctctctcaccaactccgggaggagcttgagttcccaaagaacagagacgtaaaccattaccaccacgccttcgacgcattcctcgcagcccgaataggcacctatctgctaaaacgctttcccaacctacaagcgttcttcacatacggaaagttcaaaaaggctgacgtaaagaaactcagaggattcaactttatacgagacatcacccacgcggaagacaaaatcgtagtcaaagacaccggagaagtaatctgggacaagaaacgcgacgtagacgaactggaccgaatctacaacttcaaacggatgttaatcacccacgaggtccacttcgaaaaagccgatctgttcaaacagaccgtatacggagcgaaagactccaaagaagcaggcggcaagaaacaactcatcagcaaaaagaaaggctatccagtggacatctacggaggctacacgcaagagaccggcagttacctgtccgtagtcagactcacgaagaaagctatgtacgcggtcgtaaaagtctcaacccgcgacgccgcaaaacttgctgtggctaaatccataagtgaacaaaaggagaacgaaacgctaaacgatatcatagacgagaaactcagcaagatatctaaaaacggaaaaatcacgcacgaactcttcgaggtcgtcctccccagagtcggacaaaagactctcttcaaaaactccaagtataacctctttctagtgaacagcgacacttacatgcacaactaccaagaactctggatgccacgcgaatatcagaaaatgtggaaagacatcagcctatcaaaatacggcgacgcccaaaccgaagatcaactcgaccaaatctttgggtttatcgtctcccaagtcaactcgtacttcaacctatatgacatcaaccaatttcgcaagaaattaaacgacgcagccgataaattcgcaactctacctatgcgcgacactgacgacatgcaaggaaaaatcgcaaccataggacaacttctcataggtctccaagcaaacgcagctcgaagcgatctcagaaacctcgatataaaaactcccctaggcctactccaaatccccaacggtatctccctagactctgatacatcagtggtctaccagtccccaactgggctcctagaaagagaagtacacctatcagacctgtga

SEQ ID NO: 6559 - RNA, 4092 nt, synthetic construct
  misc_feature 1..4092: note = Cas9 variant
  source 1..4092: mol_type = other RNA
atgactaaactcaaccagccatacggaataggactagacataggctccaactccatcggctttgctgttgtggacgccaacagccacctcctccgattaaaaggggaaactgccattggagcaagactattcagggaaggccagtcggccgccgaccgacgggagtcccgtaccacccgacggcgactatcacgaactcgatggcgtctctcattcctgcgtgacttcttcgcaccccatattaccaaaatagacccagacttcttcctcaggcaaaaatactcagaaatctcacccaaagacaaggacagattcaaatacgaaaaacgcctcttcaacgatcgcacagacgcagagttctacgaagcgtaccccagcatgtaccaccttaggctgcgattaatgaccgacgccagccaggcagatccccgagaaatatttctggcaatacaccacatcctcaagagccgaggccactttctcaccccaggcgcagccaaagacttcaacaccgatgaagtagatctgaaacatatttttcccgcactcgccgaagcatatgcacaagtttacccagacctcgaactaaacttcgactcagccctagcggatgacttcaaagccaaacttctcgacgaagacgccaagccctcagatatacaaaaagccctcgtcaacctcctgctctcatctgacggagaaaaagaaatcgtaaagaaacgaaaacaagttctaaccgagttcgccaaagccatcacaggcctcaaaactaagttcaacctggccctcggcaccgaagtcgacgaagccgacgcgtccaactggcaattctcgatgggccaactagatgacaaatggagtaatatcgaaacctccatgactgaccagggtacagaaatcttcgaacaaatccaggagctataccgcgcccgactgctaaacggcatcgtcccggcagggatgtccctatcccaggcgaaagtcgccgactacggccaacacaaagaggacctcgagctgttcaaaacctacatcaagaagctaaatgaccatgaactagcaaaaaccattcgaggactctacgaccgatacatcaatggcgacgacgcgaaaccattcctgcgcgaggactttgttaaggccctcacaaaggaggtgaccgcacacccaaacgaggtatcggagcagctcctgaacagaatgggacaagcaaacttcatgctaaagcaacggacaaaagccaacggggccataccagtccaacttcaacaacgagaactcgaccaaataatcgcaaaccagtcaaagtactatgactggttagctaaaccgaaccccgtggaaaagcaccgcgcaagtaaaccctaccaactagacgaactcctaacattccggataccctactacgtcggcccactcatcacacctaaacagcaagccgagtccggtgagaatgtcttcgcatggatggttcgaaagaacccttcaggaaacatcacaccctataattttgacgaaaaggtcgaccgagaagcctcagcaaacactttcatccagcgtatgaaaacaactgatacctacctgatcgacgaagacgtactccctaaacagtcgctattataccagaaatacgaagtactcaacgaactcaacaacgtccgcataaacaacgaggccctctccacagatcagaagcaacgcctcatccgtgaagtattcgagaggcacagctccgtcacaatcaagcaagtcgccgacaatctcgtagcacacggagacttcgctcaacgccccgaaatccgaggcctagccgacgagaaaaggttcctctcgagcctatcaacataccaccaacttaaagaaatcctccacggagcaattgacgatcctaccaagctacacgacatagaaaatataatcacctggtctacggttttcgaagacgccgcaatctttaagacgaaactagccgaaatcgactggctcgaccccgccacaatcaagaaactttcgaacatacgctaccgcgggtggggtcaattctcccgcaaactcctcgacggcctcaaacttggaaacggccacaccgtaatacaggaactcatgctttccaaccacaacctaatgcaaatactggcggacgaaacactcaaggaaaccatgaccgagctcaaccaagacaaactcaaaactgacgacatcgaagacgtaatcaacgacgcctacaccagtccctccaacaaaaaggcactcagacaagtactccgcgtagtcgaagacataaaacacgcagctaatggccaagatccaagctggctctacatcgagaccgccgacggacccggcacagccggcaaacgaacccagtcgaggcaaaagcagattcaaaccgtctatgcaaatgccgcacaagaactaatagactccgcagtccgcggggagctggaagacaaaatagctgacaaagcctcctttacggatcgtctcgtcctctacttcatgcaaggcggccgtgacatctacactggcgcacccctgaacatagatcaactcagccactatgacatcgaccacatcttgccacaatcactgatcaaagacgactcactcgacaaccgtgtgctagtaaacgccacgataaatagggagaaaaataacgtattcgcttccacactcttcgcaggcaaaatgaaggcaacgtggcgtaagtggcatgaagcagggctaataagcggccggaaacttcgcaacttaatgctgcggccagacgaaatagacaagtttgccaaaggattcgttgcacgccagctcgtagaaacacgccaaatcataaaattgaccgaacaaattgccgcggcccaataccccaacacaaaaataatcgccgtcaaggcgggactcagccaccagctacgggaagaactcgacttccccaaaaatcgcgacgtaaaccactaccaccatgcctttgacgccttcctggccgctcgcatcggcacctaccttctcaaacgatacccaaaactaacgccattcttcacatacggtgagttcgccaaagtggacgtcaaaaagttccgagagttcaacttcataggcgcattgacacacgccaaaaagaatataatagccaaagacaccggtgaaatagtatgggacaaagaacgagacatccaagaactagaccgaatctacaacttcaagcggatgctcataacacacgaagtacactttgacatggcagacctcttcgaccaaaccatctacgcagcaaaagattcaaaggagagaggcggcagtaaaaacctcatacaaaagaagcaaggatacctcactggcatttacggtggttactccactgagagaggatcgtacgtctccataatacgcacgttcaaaaagggagcaccaatttacaatatagtcaacataagcacagctgacgtcagcctattgagcgacaaacaacgagtctcagaagcctcagccgacgtactactcaaagaactgatcaagaagaaactcgccaaacggaaatctggagaaaacaccaaatcgggcgctttcgaaattgtgctcccgcgagtagggaaaaacaccctcttcaagaacaagaagtacggcctcttcctcgtggaatccacgaccgaatttcataactaccaggaactatggctgccccgcaacgatcagatgctcatcaaatccatacaatcgcacaaaattgaagagagcaaagccgactacgaactaacacgaatgtaccgcaacatcgcatcacaagtcgaccactacttcggactgtacacaatccggaaatttagcgagaaactcaccgctagcataaacgattatggcgccctaccagtctacaaaagcgaaaccactgacgggaaatacgaagtactctccaatctgttcgaaggtctcggctccggcaccagtacagggaacctcaccgccgtcaaactgcaacccaacttcggccgtgtatacctaacttcgggaatcgtcctggaagacgacacatccatcatctaccagtccccgacgggactcttcgagcgctcggtaaagctagctgacctatga

SEQ ID NO: 6560 - RNA, 4092 nt, synthetic construct
  misc_feature 1..4092: note = Cas9 variant
  source 1..4092: mol_type = other RNA
atgacaaagctaaatcagccctacggcatcggcctagacataggctcaaactccattggatttgccgtcgtggatgccaatagccacctactgcgcttgaaaggggagaccgccatcggagccagattattccgagaaggacaatcagcagccgaccgccgagggtcccggaccacgagacgccgcctgtctcgaaccagatggaggctgagtttcctccgcgacttcttcgcaccccacataacgaaaatagaccccgacttctttctacgccagaaatactcggaaatctcaccgaaagataaagacaggttcaaatatgaaaagcgattgttcaacgacagaaccgacgccgaattttacgaagattaccccagcatgtaccacctccgcctgcacctgatgacccacacccacaaagccgacccacgggaaatcttcctcgccatacatcacatcctaaaaagtcgaggacacttcctgacgcccggcgctgcaaaagacttcaacacagacaaggtcgacctagaagacatctttccagcactaaccgaagcctacgcacaagtgtaccccgacctcgaactcacattcgatctcgccaaagcagacgactttaaagccaaacttctcgacgagcaagcaaccccaagcgacacgcagaaagctctggttaacctactactatcctccgacggagaaaaagagatcgtgaagaagagaaaacaagtgctcacggagttcgccaaggctatcacaggactcaagaccaaattcaacctcgcgctaggaacagaagtagacgaggcagacgcctccaattggcaattctccatgggacaactcgacgataaatggagcaatatcgaaaccagcatgacagatcaaggcaccgaaatctttgaacaaattcaagaactataccgcgcacgtcttcttaacggcatagttcccgcaggcatgtccctttcacaggccaaagtagcagattacggacaacacaaagaggacctggaactcttcaaaacctatctaaagaaactcaacgaccacgagctggcgaaaacgatacggggactctacgaccgctatattaatggcgacgacgccaagcctttcctacgagaagacttcgtcaaggccctgaccaaagaggtcactgcccacccaaacgaagtgtcggaacagctactaaaccgaatgggccaggccaacttcatgctcaagcagagaaccaaagccaacggcgcaatccctatacaactacaacagcgcgaacttgaccagatcatcgccaatcagtcgaaatattacgactggctggctgcacctaacccagtcgaggcccacagatggaaaatgccataccagctagacgaactactgaacttccacataccatactacgtcggccccctcataacgcccaagcagcaagccgaatccggcgaaaacgtcttcgcttggatggtcagaaaagacccgagcggaaacataaccccatacaacttcgacgaaaaagtcgaccgcgaagcctcagccaacacttttatacagcgcatgaagacaacagacacctacctaatcggtgaggacgtcctacccaaacagagcctcctatatcaaaaatacgaagtcctcaatgaacttaacaacgtgcggataaacaacgaatgcctcggaaccgaccaaaagcaaagactgatccgagaagtattcgaaagacacagctccgttactatcaagcaagtcgccgataacctagtcgcacatggcgacttcgccagacggcccgaaatccgcggactagccgacgagaaacggttcctgtcctccctcagcacctaccaccaactgaaagaaatcctgcatgaggcaatcgacgaccccacaaaattacttgacattgagaacataatcacatggagcaccgtgttcgaagaccataccatctttgaaaccaaactagcagagatagaatggctcgaccccaagaaaatcaacgaactctccggcatccgctaccgcggatggggacaatttagccgaaaactgctagacggactcaaacttggaaacggacacaccgtcatccaagagctgatgctctcaaaccacaaccttatgcaaattctcgcagacgaaacactcaaggagacaatgaccgaactcaaccaagacaaactcaaaaccgacgacatagaagacgtgatcaacgacgcgtacacctccccatcgaacaagaaagcgcttcgccaagtgctaagggtcgtggaagacattaaacacgctgcaaacggccaggacccctcatggcttttcatagagacagcagacggcaccggcacagccgggaaacggacacagtcaagacagaaacagatacaaacagtatatgccaacgcggcccaggaactcatcgactcggccgtccgcggcgaactagaagacaaaatcgcagacaaagctagcttcaccgaccgattagttctctacttcatgcaaggcggccgagacatctacacaggggcacccctgaacatcgaccaactgtcccactatgacatagatcacatattgccccaatcactaataaaggacgactcactcgataatcgagtcctcgtcaacgccacaatcaatcgcgaaaagaacaacgtcttcgccagcaccctcttcgcaggtaaaatgaaagcgacgtggcggaagtggcatgaggctggactcataagcggccgtaagctccgcaacttgatgttacgtccagacgaaatagacaagtttgccaaaggcttcgttgcacgccagctagttgaaacaagacaaatcatcaaacttacagagcaaatagccgccgcacaataccccaacacaaaaatcatagccgtaaaagccggcctatcccatcaacttcgcgaagaactagactttcctaaaaaccgcgacgtcaaccactaccaccatgcattcgacgccttcctggccgcccgcatcggaacctatttactcaaacggtacccaaaacttgctccattcttcacctacggagagttcgcaaaggtagacgtcaagaagttcagagagttcaactttatcggcgccctcacccacgcgaagaaaaacataattgctaaagacaccggagaaatcgtatgggataaagaacgcgacatccgagaactcgatcgaatctataacttcaaacgaatgttaatcacgcacgaagtctactttgagacagccgatctcttcaagcaaacaatctacgccgcaaaagacagtaaagaaaggggcggtagcaagcaactcatccccaagaaacaaggctacccgacccaggtatatggcggctacacccaagagtcggggtcctacaacgccctcgtgcgagtagcagaggccgacaccaccgcataccaagtcatcaaaatcagcgcccagaacgcaagtaaaatcgccagcgcaaacctaaaaagccgtgaaaaaggcaaacaattattaaacgagatcgtggtcaaacaactagcaaaacgacgcaaaaactggaaaccatccgccaacagtttcaaaattgtcataccaagatttggaatgggcacgctattccaaaatgcaaaatatggcctcttcatggtgaactctgacacctactacaggaactatcaggagctgtggctcagccgggaaaaccagaaactgctcaagaaactcttctccatcaaatacgagaaaacgcaaatgaaccatgacgcactccaagtctacaaagccatcatagaccaagtcgaaaaatttttcaaactgtacgacataaatcaattccgcgcgaaactgtccgatgcaatagaacgcttcgaaaaactccccatcaacacagacgggaacaagatcggcaaaaccgaaactctccgtcaaatactcattggtctccaagcaaatggcacccgctccaatgtgaaaaacctcggcataaaaaccgacctaggactcctacaggtaggctccggcataaaactcgacaaagacacgcaaatcgtctaccaatccccctcgggacttttcaagcgacgcatcccactagcggacctatga

SEQ ID NO: 6561 - RNA, 4095 nt, synthetic construct
  misc_feature 1..4095: note = Cas9 variant
  source 1..4095: mol_type = other RNA
atgggcgaccgcaaatacaaccttggcctcgacatcggcacatctagcataggcttcgcggcagtggacgaaaacaaccagccaatacgcgtaaaaggcaaaacagcgattggagttagactttttgaggagggcaaaaccgccgccgatcgccgcggctttcgcaccacacgccgtcggttaagcagacgccgatggcgcatcaacttactcaacgaaatcttcgacgcccacttagcagaagtggaccccacgttcctcgcgcgcctcaaggagtccaaccgctcgaacctagaccccaagaaatcctttcagggcagtctactcttcccagaacgcaaagactaccaattctatgaggaatatccgaccatataccacctccgcaaggcgctcatggaaaaagatcgcaaattcgacttccgagagatatatttagccgtccaccatatcatcaaataccgcggaaactttttaaacggaacgccaatgcgatcgttcaaggtcgaaaacatagagctcgataccctgttcgaccaactaaaccaactttatgccgaaatagtacccgacaacgaactcgcattcgacctcgcccaggtcgccgacgtaaaagacgtcctaagctcaaccacaatatacaaaatggataagaaaaagcagttagtaaaaatgatgctactaccagctagcaacaaggctctccagtcggaaaacaaaaagattgtcacgcaatttgtaaacgccatactcaactataagttcaagctagatgtcctcctacaggtggaaacagacgcagattggtccctgaaactcaacgacgaaggcgccgacgacaaactcgaggagttcacaggagacctcgacgaaaatagactagaaatcatcgatctcctccagcgtctccacaactggttctcccttaacgaaatcacaaaagacggcaacagtctaagcgcggcaatggtagaaaaatacgaaaaccaccaccaccacctgggcctcctcaagaaagtcatcgaaaaccatcctgacgcgaagaaagccaaagccttgaaagaaacgtacactgcatacgtaggtaaaactgacgacaaaacgcaaaaccaagacgacttttacaaagccgtcgagaaaaacctggacgactctccagacgccaaagagatcaaacggcttattcaactagaccaattcatgccgaagcagcgcacaggacaaaacggtgctatcccccaccagctccaccagcaagagcttgaccaaataatcgaaaaacagtctaaatattacccgttcctcgccgagccaaaccccaacgtcaaacgccgcaaagacgccccatacaaactggacgaactaatcgcattcaaaataccctactacgtcggtccgctggtcacccccgaagaacaagcacaaaacggcgaaaacgtcttcgcgtggatgaagcggaaggcagctggtccgatcacaccctggaactttgacgaaaaggtagaccgcatggaatccgccaaccggttcataaggcgcatgaccacaaaagatacatatctcttcggagaggacgtcctcccggccgagtcaatgatctaccagaaatttgtagtcctaaatgaactcaacaacctcaagataaatggacgacacctatcactaaaggacaaacaggacgtttacaacgacctcttcaagcaacagaagacggtgtcaattaaggcgctccagaactactacgtcaccaaaaagaaagcagctacggcacctaccgtcgggggcctcgccgaccccaagaaattcctatcctcgctatctacctacatagatttcaaaaacatgtttggagaaagagtcaatgatccccagttccaagaggacctcgaacaaatagtcgagtggtccaccatcttcgaggatcggggcatcttcaaagccaaactccaggccctggggtggctatccgaaaaacaaatacaacaactcgtcgccaagcgctacaaagggtggggtcgactatccaagaaattactaacaggcctcaaaaacgctgagggctacagcattttagacgagatgtggcgttccacgggcaacttcatgcaaatacaaagtcgtccagagtttgccgcacttatacagcaggccaacgaaaaacagttcgaagggaacgaccccgacaacgtctgggagaacattgaaaacatcctcggcgatgcctacacctcgcctcaaaacaaaaaggcaatcagacaagtcgtaaaggtcgtccaagacatcgaaaaagcagtcggaaacccgccggagaaaatagcaatcgagttcacaagagaagcggccgccaatccccaaagaacccaatctcgcctccgcaccctggaaaaactctacgaatccgccgaagaagtcgtcgacgcgggcctaaccgccgaactcgccgagttcaaagaaaacaaacacgtactatccgacaaatactacctgtacttcactcagctaggcagggacgtgtatacaggcgataccatatcattggacaaactaaacgactacgacgtagaccacatacttccccaatccttcataaaggatgactccctagacaatcgagtgctgaccatacgcgcagtcaataacggcaaaagcgacaatgttcctgcaaagatgttcggcaaaaagatgggctccttctggcgatacctactcgacaacggaatgatcagcaagcgcaaatataacaaccttatcacagaccccgacaacatctccaagtacgcccaaaaaggcttcatcaaccgtcagctagtcgaaacctcgcaggtaattaaactaacggccaacatcctgaacggcatatacgacaaagacacggagatcatcgaagtaccagccaaaatgaacagccaaatgcggaaaatgttcgacttagtcaaagtgcgagaagtgaatgactaccaccacgccttcgatgcctatctgacgatcttcattggcaactatctgtacaagtgctaccccaagctccagccctacttcgtatacgacaacttcaagaaattcgggaacaaagaagacatcggacacaaacgcttcaacttcctcggaaaaatcgaacgcgaaaagaaagtagtagccccagagaccggagaaatcctctggtctaacgtcgcccccaatgagacaataaaacagatcaagaaagtatacgactataaattcatgatcgtctcacgtgaaattacaactcgacgcgcagaactgttcaaccagaccgtataccctaaaaactaccacggaaaactgataccaatcaaagaagacagaccaaccgacctgtatggcggctacagcggaaacacagacgcttacctcgcgatcgtcgcgcttgaggacaaaaagaaaggaaaatactttaaagtcgtaggaatccccaccagagttgcagccaagctagaaaaactaaagcagcaggacagtcaacaatacctccaagccctccataaagtgattgcgccacagttcaccaagagcaccaagaaagggatcaagaaaacagagttcgaaatcgtgttagacaaggtacactaccgacagctggtgcaggatggacccgtcaaaatgatgctaggatcgagcacctacaaatacaacgccaaacagctagtacttagcgaaaaagctctccaagtcatagccgacgaccggaaattcgatgaaacacaaaaggacgacaatctcatcgccgtatacgacgaaatcctctcgattgtgaaccagtcattcgacctgtacgacataaacggattccgaaagaaacttaacgacaaccgagaccaattcattgacctccccgccgagacgaaatacgagggccgaaaagttgtggcgcacggcaaacgcgaaatgatactagaaatactcaaaggactccacgcaaacgccgcattcggaaacctcaaacccatcggtttctccacggcatttggacaactccaagtccccaacggcatcatcctgtccaaaaacgcaatcctaatccaccaatccccatcaggcctcttcgaacgcaaaataaaactctccgacctatga

SEQ ID NO: 6562 - RNA, 4095 nt, synthetic construct
  misc_feature 1..4095: note = Cas9 variant
  source 1..4095: mol_type = other RNA
atggaaaaacaagagtactacctaggcctagacatggggatcagcagtgtggggtgggccgtgacgaacgacaagtacgagttgttacgaaagaaagggaaagacatgtggggcattcgcgaatttgaagaggcagacagctcggcagaacggaggacgcaccgggtgaaccgacgacgacgacaaagacaggtggcacgcatgggcctgctcaaagagtacttttccgacgcaatagaaaaagttgactccaactttttcatacgcatcgaaaattcgaaatatttcttcgaggacaaggacggccgtctctcatccaaaaacggaattttcgacgacgctgactacaaagacgtcgactactacaccgagtaccccacgatattccacctccgcaaagccctactagacatcgaagacacaggcaaagagtacgatgtccgcctagtatacttggccctggtaaacatgttcaagcatcgcgggcacttcctgctcaacaccgagggggacgccttatcaagcgaacaggtaaataccacataccaagaactcctcgagatcctagaaaacaactacgacatttccctcgaatcccgagacataaaggacgtaatcgacataatatcatccagtgacaacggacgtaaaaagaagcacgagcagatattagaactattcggggtaaagaaatccgacaaaagagcgaacgaactactcaaatgcctctgtgggctctccgttaacgcaaaactgatattcgacgaaaactacgaggaaaaggtcgacctatgcttccacgacttcagctacacagataaaatcccagacctaatggagaaactatcagaggaagaatactatgtagttgaacaactcaagtccatctacgactactcaatcctcgcaggcaccctgaagggctatgactacttatcatgcgcccgtgtcgaactgtacgaaaaacacagggaagacctcaaactgctcaaggcgctctaccgccgttataaaacaaacgaggagtacaacgacatgttcaagtcggacaaagagggaacatacagcgcctacgtaaactctttcaactccagcgacagctccgtaaagattaagaaatatcgctggaacatgaaggggcgaaccatagacaacctttacggcacaattaagaaagcattcaaagacaacacagacgacaaggacgtgcaatcaatgatggagtcaatagacaaggagcagttcctgcccaaacaactaacaggcgcaaatggggtaattccaaaccaggtgcacaagaaagaaatggaacggatactcaaaaaggcacaaaactacctccccttccttaaagaaaaagacgagtccgagctaaccgtcagcgaacgaatcctacgccttttcacattccagatcccgtactacgtcgggcccctgggcgagaacagcaagaccggctgggtcgtccgacgggaagggggacgagtcctcccctggaacatcgacgaaaagatcgacatgtctgctacgtcggaggcattcatcggcaacctcatccgcaaatgcacgtacttatcagacgaaaaagtaatgcctaaagcaagcctctcctacgaacgctactgcgtcctgaacgaaatcaacaacatatgtatagacggagagagactagacaccgaattgaaacagaaaatctacacagaatgcttcatgaagggcaaacgcgtcacacgcaaacaaatatgcaactacctggtcgcccaaggatgtatcaaaagtgacgaacaagtcactggcattgacatcaacgtaaactctagcctcagcagctatggtaaaatgttcgcaattttcggagagcacctcaaggaggacgccataagaaaagtcgcagaggagataatatactggggcacaattttctccgactcaaagaagatgttccggaaacacctgacgaaatacgtcgaacaaggtatactcggcgaaagccaggtcaaaagaatccttggatacaaattcaaggactgggggaggttcagtaaggccctcctaaccctgcaaggaatcgacaaaagtaccggggaactcctcagtctcgaaaatgccatgtgggaatatagcttaaacttcatggaactcataaacagtgacgacttcacattcaaagatgagctagccaatcgccgaacctccgcgatcaagtccctcagcgagttcacctacgaagacctcgaggacacgtacttcagcgtaccagtcaaacgaatgatttggcaaacaattctcgtagtacgagaaatcgaacaaatcatgggatacgcccccaagaaggtcttcgtcgagatggcccgatccgaggaagaaaaaggcgacaagggcaggaaagacagtcgcggcacccaactcctcgaactctacaagaatatcaaaaacacggaaaaccacgactggaagaaagagataagcgaggcgaacgagagcggaaagctacgaagcaagaaactctacctgtactacactcaaatgggacgagatatgtacaccggcgaagagataaacatcgacatgctctacgacgactctatgtacgacatcgaccacatctatcccagacactacgtcaaggacgacagcatagtcaacaacctcgtgctcgtcaaccggcgcgccaaccaagacatcaaaaaggacctctaccccatccccgacaaaatcataagcaacccgaaggtgcaagaactctggaaaatgctccacaaacagaacctcataacagacgaaaaatacaagcgtctcatgtcacgcagccccttcaccgagaaacaacttggagatttcatagcccgacaactcgtagaaacccggcaaggcactaaaggcatagccgagcttctcgggcaactgttcaaagacacggagatcgtctacgccaaggccaccaacgtgtctgacttccgccgtgacaacggtttcgttaaatccaggctcgtcaacgacttccaccacgcacaagacgcctacctaaatatagtggtcggaaacgtctactacacaaaattcaccaaaaacccctggaacttcatcaagaaagacttcgacaaagatcggaataaaaacggctacaacctcgcaaagatgttcgaccgagacgtcgtccggggcgacgacacagcgtggatcgccagcaaaaaggacacccaaggcacgatagagacagtcagaaagatgatgaggaaaaacaccccactcatgacccgaatgtcattcgagcaacacggaggcatcgccaacgccaccctttattccgcaaagaaagcaaaggttgaaaactacatacccctcaaaagttcagacattagactgtcggacgtcaaaaagtacggcggctttacgagcgccaccgtagcctactacttcatcgtgcaccacaaggaaggcaaaaaggaaaacacgactatagaagctctccctctatactgcaaacggaaagttgaaaacgaagaaaacgggctcctaaaatattgcgaagaggtactaggctacggcgatgtcaaaatcctctttaataaactaaagatccaatcccttctagacatcaacggctaccaagcgcacctgagcgggaaaaccggaaaccagctgaccctccgaaacgcaatgaacctctgcgtccccgaaaaatggaccgcgtacatcaaaaagctagaaaaactcgtggtaggccatgtaaaggaacaagaaatatcctccgaggccaacattgaactatacgaccttctcacagacaaacatctcaacagcgtttacgccaaacgaccaaatgcttacgggcaaaaactaatcgacaacagaagtcgcttcgtaaacctcaagcccgagtcacaatgcgaagcaatcttacagatccttaagctgacaaaaatcggcaacaacgaaaccaacctaaaactcattggagaaagcgagcacagcggcaagatgctgataagcaaaaatctcaaagacacggacaagcccgccatcatctgccagtcagtgacaggcctctacgaacgtaaaatatatatcttcgacgagcaattagacaagtga

SEQ ID NO: 6563 - RNA, 4095 nt, synthetic construct
  misc_feature 1..4095: note = Cas9 variant
  source 1..4095: mol_type = other RNA
atgaacaagcgctacaacatcggcctggatattgggaccaactccatcggatggtcggtagttaacgaccaatctcagctggtccgaatcaaaggaaagctaggctatggagtacgactgtacgacgaaggacagacagcagaggaccgacgactcttccgcacgacgcgccgacgactaaaacgacgaaaatggcgattggggctactacgagaaatattcgaaccctacatcacaccccaagacgccacattctttctccgccaaaagcaaagcaacctatcgcccaaagacctacagaagcaacaaccgcaaattggactattcaacgaccgactcgacagcgacttccactatcagtaccctacaatctaccacctaagatacgcactaatgaccgagaaacgacagtttgacctccgcgaaatctacctcgcaatgcaccatatcgtcaaataccggggccactttctcaacgctgccgccgcaagctcattcaaaagcggagaaattgacctagcaaaggattttgcggcgctaaaccagattttcggcacgatatttagcgaagtcggcttcagcctttccgaaagcaacctagacgaaatcaaatcaatcttattagacaacaacctgtccgcgtccgtaagacagagaaaagccttaccactcatttaccagactgcagcctcgaaagactccgagaaacagtacaaagcaatcgccaccgaactactaaaggccatcttgggactcaaagcaaaatttaacctcatcacaggcatcgaggtggaggacgtcaaggcgtggaccctatcatttaacgccgaagatttcgacgccaaactatccgatctaaatatagccgacaacgacgacgccgtgcaaatcatcgaaatactacgggcgctatacagcggggtgctcctaacgggtatcgtcccagagggacaaagcatctcccaagcgatgatcgacaaatatgaggcacacaaagcccacctcatcatgctccgctcgataagggaacagctaagcgacaaagagaacaaggcccttgagaaagcctatgacgattacatcgaccacccggaagacaaacaacacggatctcgtgaagacttctacgccgccataaccaaagtcctaaagaaagactcagaagacacaaatatcatcgagattctgaaactaatagaactcgaccaattcatgcccaaacaacgaaccaaagacaacggcgccataccacaccaactccaccagcaggagctcgatcagataatcgaaaatcaaaagcaatactacccctggctcgccgacatcaaccccaacgaacagcgccagaagatggctccctataaactcgatgaactcgtcaccttcagagtgccctactacgtcggccccatgattaccgcagaagaacaatttcaaacgagcaacaagaaattcgcatggatgatccgtaaagaacctggcgccattacgccatggaacttcgatcaaaaagtcgaccggcaagcatccgccaacgagttcatcaaacgaatgacgacaaccgacacgtacctattagcagaagatgtactcccaaaacaatccctcctctaccagcgcttcgaagtcctcaacgaattgaacgggataaaaatcgacgaccaaccaataacagtggaacaaaaacaggcgatattcaacgacaaattcatgcaacaggcccacgtgacagtcaaaaacattcaagcatacctagtcagcgagggacaatacgcctcgcgcccaaacatcacagggctctccgacggagaaaagttcaacagctccctctccacatatcacgatctcaaaaagatcttcggcgacatgatcgacgaccccaacaaacaaacagacttcgaaaagatgatcgagtggagcacgatattcgaagacggcaaaatcttcgccgacaaacttagggaaataaactggctaaccgacgaacaacgtcagaggctctccaacaaacgatacagaggctggggccagctaagcacaaaattactaacaaagatcgtagaccagaacggtcaacgcataatagacattctctggaacacgaacgataacttcatgcgtatcatccactccgatgacttcgatcaagctgtaactcaagccaaccagatgctactagcagacaatgacacccaggacgtaatcaacgaactctacaccagcccctcaaataagaaagcactccgtcaaatcttactcgtggtagcggacatacaaaaagccatgaaaggccaagcaccggcacgcatactcatcgagttcgccagggaaaaacaagcaaacccccgactttccacacaacgccgaaggcaagtggaacaagtctaccaagagctcaacaacgaccaactgaacaaggaactggccgacccccaatacgcaaatctctccaaggaccggctctttttatactttatgcaaggagggagagacatgtacacgggcgaatccctaaacatcgaccgtctctcagaatacgatatcgaccacatactcccccaagccttcatcaaagacaactctttagacaaccgcgtcctggtctcggccaaaatgaatcgttccaaatcggaccacgtcccactagatttcacagaggaacgctttggccagaaaatgcgatcgcaatgggaacaaatgctcagagccggcctcctcacgcgacgaaaatacaacaatctgacactcaatcccgactccctaaacaagtatacaatgagcggctttataaacagacaactcgtggagacaagacaggtaatcaaactcgccacaaacctactcgtagaccaatacgcagacgaagacgtccaactcgtaacagtaaaatccgggctgacacaccagatgcgcgaggacttcgacttccccaaaaaccgcaacctcaataactaccaccacgccttcgacgcatacctgacagcattcgtcggactttaccttctaaagaaataccccaaactagcccactatttcgtctacggtcagtaccaacaaggcttcaaagccaacgaccaatggcgcaacttcaacttcctgaacggcctaagacaagaacagcaagtagacgccgaaacgggcgaactcatatggcagaaagaccacgacctggcctacatgaataaaatctacgattttaagaaaatcctagttacgcgagaagtacacactaaccacggagcgctctacaaccaaaccctttacaaagcaaaagacgacaaagcaagcgggcaaggaggtcggcaactcatcgcggccaaagaaaacagacccaccgccatatacgggggctattctggaaaaaccgtcgcctacatgtgcctcgtaagaataaccgagaagaaaggagacttctaccgcatctgcggagtccaaaccgcctgggtagacgaactcgaacacatagaagatgccacaataaaactccaacgcctcaccgcactcctcacaccccagttcagtgcgaccaagaaacaaaaagacgaagtcgtcaccgtagttaaaccattcgaagtactactgccgaaaatccttataaaccaacgattctatgatggaggacaagaactcaccctcgcatccgccacgtacaaaaacaacgcacaagaattagtcctagacaagaaagccgtgcaggtactcaacggacaactaccgaaagccgagctcgaagcacaagcgacagtagtatatgaccaaatacttgaacgcgttcaaaaatatttccccctctacgacatgaatagcttccgtgagaaactcttcgtaggccgggacaaattcaacgaactgccctggcaagatcagtgggaaaaccataaactcatccaagtcggccagaaaaccatcttagaccggattctaatcggactacacgccaacgcagcaatgggggatctcaaagcactaaatatgagcacgccattcggcaaactccagaaaagcaacggaatctcactctccccagaaacccaaataatataccaatcacccaccggactgttcgagcgcagggtggcactaaaagacctatga

SEQ ID NO: 6564 - RNA, 4095 nt, synthetic construct
  misc_feature 1..4095: note = Cas9 variant
  source 1..4095: mol_type = other RNA
atgaaaaacctaaaagagtattatatcggcctcgacatcggaacggcatcggtagggtgggccgttaccgacgaatcctacaacatccccaagtttaacggaaaaaagatgtggggcgtacgcctcttcgacgacgcgaaaacagctgaagagcgcaggacccagcgcggctcgcgccgccgcctcaatagacgaaaagaacgaatcaacctgctccaagacctatttgcaacggaaataagcaaggtagacccgaacttctttctccgactcgataactcagacctgtaccgcgaagacaaagacgagaagctcaaaagcaaatacaccctatttaacgacaaggacttcaaggaccgcgattaccacaagaaatacccaacaatacaccacctaatcatggacctcatcgaagacgagggcaagaaagacatccgacttctctacctggcgtgccattacctcctcaaaaatcggggccatttcatcttcgaggggcaaaagttcgacacaaaaaacagcttcgacaaatcaataaatgacctcaaaatacacctacgcgacgagtacaacatagacctggagttcaataacgaggacctcatcgaaatcataacggacacaaccctcaacaaaaccaataaaaaaaaagaactcaaaaacatcgtcggcgacaccaaattcttgaaggctatatccgcaattatgataggcagtagccagaaactagtcgacctgttcgaggacggggaattcgaagaaaccactgtgaaaagtgtagacttctcgaccacagcattcgacgacaagtacagcgaatacgaagaggcgctgggcgacaccataagcctgctaaatatcctaaaatccatatacgactcaagcatactcgaaaacctgctgaaagacgcggacaaaagcaaagacggcaacaaatacataagcaaagccttcgtaaagaaattcaacaagcatggcaaagacctcaagacactgaagcgcataattaaaaagtacctgccctccgaatacgcaaacatcttccgaaacaaatccatcaacgacaactacgtcgcctacacaaaatccaacattacaagcaataagcgcaccaaagccagcaaattcaccaagcaagaggacttctacaagttcatcaagaagcaccttgacaccataaaggaaacaaagctgaacagcagtgaaaatgaggacctcaaactgatcgacgaaatgctgacagacatagaatttaaaacattcatcccgaaactcaagtcctcagacaatggcgtgattccgtaccagctgaaactaatggagctgaaaaaaatcctggataatcagtcaaagtactacgacttcctcaatgagtcagacgagtacggcaccgtgaaagacaaagttgagtccataatggagttcagaataccctattatgtcggtcccctcaaccccgactccaaatacgcatggatcaagcgagagaacaccaagataaccccatggaatttcaaagacatcgtagacctagactcgtcacgtgaggaattcatcgatcgcctcataggacgatgcacatacctcaaagaggagaaagtcctccccaaagcatcactaatatacaacgaattcatggttctaaatgagctcaacaacctgaaactcaacgaattcctcataacagaagagatgaagaaggcgatcttcgaggagctattcaaaacgaagaagaaagtaaccctaaaagcagtctcaaatctactaaaaaaagagttcaaccttacgggcgacatcctcctatccggcactgacggcgacttcaaacaggggctcaattcctacatcgacttcaaaaatataatcggtgacaaagtcgaccgagacgactacaggatcaaaatagaggaaataatcaaacttatcgtactatacgaagacgacaaaacatacctaaaaaagaaaataaaatcggcgtacaaaaacgacttcacagacgacgaaatcaagaagatagccgcactgaattacaaggactggggaaggctgagcaaacgattcctaaccggtatcgaaggcgtggataaaaccacaggcgagaaaggaagcataatatacttcatgagagaatacaacctcaaccttatggagctgatgagcggtcattacaccttcacagaggaggtagagaaactcaacccggtcgaaaaccgcgagctctgctatgagatggtagacgagctgtacttgtctccgagcgtgaaaaggatgctttggcaaagtttgcgcgttgtcgacgaaatcaagcgtatcatcggcaaagacccaaaaaaaatattcatcgaaatggccagagcgaaagaagcaaagaatagccgcaaggaaagccgaaaaaataaactactagagttctacaaattcggaaagaaggcgttcataaacgaaatcggcgaggaaagatataattatctgctcaacgaaataaacagtgaggaggaatccaagttccgatgggataacctatacctctactacacgcagctaggccggtgcatgtacagccttgaacctatagacctcgccgacctcaaatccaacaacatctatgaccaggatcatatctaccccaagagcaagatttacgacgactcgttagaaaatcgagtcctagtcaaaaagaacctcaaccacgaaaaaggcaaccaatatccgatacccgagaaggttctgaacaaaaacgcatacggattctggaaaatcctcttcgacaagggccttatcggccaaaaaaaatacacccgactgacaagacggacaccctttgaagagagagagctcgcggaattcatcgaacgccagattgtagaaaccaggcaagcaaccaaagagaccgccaacctcctgaaaaacatatgccaagacagcgaaatcgtgtactcgaaagccgaaaacgcgagccgattcagacaagagtttgacataataaagtgccgcaccgtcaacgacctacaccacatgcacgacgcctacctaaacatagtcgtaggcaacgtgtacaacaccaagttcacgaagaatcccctgaacttcattaaagacaaggacaacgtacgaagttacaacctcgagaatatgtttaaatacgacgtcgtaagaggcagctatacggcgtggatcgctgacgactccgagggcaacgtaaaggcggccaccatcaaaaaagtaaaacgcgaactagaaggcaagaattaccgcttcacgcgaatgtcgtacataggaacgggagggctgtacgaccagaacctgatgcgcaagggtaaaggccaaataccacagaaagaaaacacaaacaaatcaaatatcgaaaaatacgggggttataacaaggcctcgagcgcgtacttcgccctaatagaatcagacgggaaggctggccgagaacgaaccctggagacaataccgatcatggtctacaaccaggagaagtacggtaatacagaggcagtcgacaaatacctcaaagataacctcgagctacaggacccaaaaatcctaaaagataagatcaaaataaacagcctaattaagctagacggcttcctgtacaacatcaagggtaaaaccggcgatagccttagtatcgcgggcagcgtgcagctcatagtaaacaaggaggagcagaagctcataaagaaaatggacaaatttctggtaaagaagaaagacaacaaagacataaaagtaacaagcttcgacaacatcaaagaggaggaactaattaaactgtataagaccctaagcgataagctgaacaacgggatatactccaacaaacgaaacaaccaggccaaaaacatatccgaagcccttgacaaattcaaagagatcagtatagaggaaaagatcgacgttctcaaccaaataatcctactgttccaaagttacaacaacgggtgcaaccttaaatcgatcggattatccgccaaaacgggggtagtcttcatacccaaaaaactcaactacaaagaatgcaagcttatcaaccagagtataacaggccttttcgaaaacgaagtagacctcctaaacctgtga

SEQ ID NO: 6565 - RNA, 4098 nt, synthetic construct
  misc_feature 1..4098: note = Cas9 variant
  source 1..4098: mol_type = other RNA
atgtacaagaaagattacaccgtcggcctagacatcggatccacttccgtgggatttgctgctatcgacgacgactaccaaccaatacgacttaaaggaaaacgtgtgatcggagttcgactcttcgaagagggcaaaacagccgcagagagacgcaacttcagaaccacacgccgccgccttaaccgtcgaaagtggcgtctaagcctcctggaggaaatcttcgatccgtacatggccaaagtcgatccgacattcttcgcccgactgaaacagagcaacctcttccccaaagacaaaaataagaaattcacaggttcactcctgttccccaaaacaaccgactcgaaattctacgacgaatacccaaccatataccatctcagataccacctcatgaacgactcccgtaagttcgacctccgcgaaatattcctggcgatccaccacattgtcaaataccggggcaactttctcaactccgctcccatagcatctttcagcaccgacaaaataaaccttgtagacgacttcgagaccgtgaacgcagcctaccttcagatcaatagcagcaaccccgtccaactcgacacagaccaagccgatcaagtatcgcgaatactcctcgacaacaaactcagcaacctcgacaaacaaaaacaagccgccaaggccctagcacagaaaagcggagacaagaaacaagacaaaataaacaacacgacaataaaacaaatctgtaaagcgctattaggctacaagttcgatctagctgtcgtactgaacattgactcggacgaccataacaaatggaagctacagctatccgacgaaaacatcgacagccgcctcgcagagctgaccggagaactaaatgaagcacaactagacatcctaaacgtcctcagccgattatactcgcaaataaccctaaacgacatcgtcccctccggtatgaccctttccgaagcaatgatagaaaagtataaagcacacaagaaacacctgaaaatgctaaaagacttcgcccgctctctatcgaagaaagactacggacaagttatggaggcgtacgccgaatacatagggaacataccagaatccgccagcagcaaagcccaaaagaagatctcccaggacgacttctataaaaagataaaacgctacctcgatgactcgaaactaggccagaaaatcgcagagctaatagccaagaacgagttcatgcccaaacaacgcaccaatcaaaacggtgtaataccatatcagctgcacctcaaggagctgaaccagataattgagaaccaatcaaagtattacccatggctggccgaactcaaccccaacgagaaacgcagaggaaaggccaaatacaaactctccgaactggtcgcttttcggatcccttactacgtcggccccctcataactcaggaggaacaacagaaaacctcaaacgctaacttcgcctggatgatacgcaaatctgaaggcaggataacgccctggaacttcgatgaaaaagtcgaccgcatcgcgaccgccaaccgattcatcaagcggatgacaaccaaggacacatacctaatcggagaagacgtactgcccgcccactcactcctatacgagcgattcaaggtactaaacgaactcaacatgatccgggtcaacaaccaccgcctctccgtaggccaaaagcaagacgtattcgagaaactcttccaaaaacacaagacggtgaagacccgcgaactgatcaagcaattaatggcaagcggcctacctacacaaccacgaatcacaggcctgtccgaccccgcaaaattcaacactagcctcggcacctacaacaacttcgccaaaatcttaggggacgaaatcaatcagccagatagacaggaagacttcgagaaaataattgaatggatcaccattttcgatgacaaggacatcctgaaaacgaaactatccgaattaagctggctcgacgagaagcaaatcaacgccttaatcaacaagaactattccggatggggacgcctcagcagaaagctcctaactgagctgaccaacaagaaaggacaaagcatcatcgaccgaatgtggaacacccaaaaatcctttatagaaatcatcaacgagcccgtattcgcagagcaaatcaaagacgcaaaccaagaccaactagacgaagacgattatgaaacggttctacacgacgcatacacctcaccacagaacaagaaagccatacggcaggtaatcaaagtagtcgacgacatagtacgcgcagccggacgggcccctaaattcatatctctggagtttgcccgcgaagaccaagaatcccggagaacccaaagccggctatcgcgaattaagaaaatctacgaaaccacaacaaaagaactcgtagcaaatgaccaaatacgagaggagctgggcaacgtcaaagacctaaacgacagattatttctatacttcacacaactcggccgagacgcctacacgggagaaaggatcaacatcgacgacatctcaacaaaatacgacatcgaccacatcttccctagagccttcataaaggacgatagcctcgacaacaaagtcctagtaaaacgcgcggtcaacaatggaaaatccaacaatgtcccccttaaacttttcggagcaaagatgaaaccaatctggaaaatgtggaaagaccaccaactaatctcaaaaagaaaatacgaacaccttatgacaaaccccgatgcaatagataaatacaaggccaacggattcataaaccgccagcttatagaaacccgccaaataatcaaactcgcagcgaatatcttagctaaccgttacagcaccgaggacacaaagataatcgaggtcaaagccaacctgaaccaccagctacgacagtcactacatctgtataaaaatcggcaagtcaacgactaccatcacgccgtcgacggatatctctccgcattcgtaggccagtacctgtaccaccgctacccatcgctccagtcatacttcgtctacggccaataccaacgtttcttcgacaagcaagtacaagaaaacatgaaattcaaccgcttcaactttctctacgatctcaccgaccgcgacaacgaccagattgtcgtaaagagtacgggcgagatcgtaggggaaaaatccaaactaatcgagcagataaaatgggtctacaggtacaaattcatgctggttagccaagaggtattcaccaaaactggcccactcttcgaccaaacgatctaccccgcgggaagcaataaaagccgtctcatccctatcaagaaagaccggcccacagacatatacggcggatactcttcctccacagacgcgtacatgtcactaatccgagtacccgacaagaaagaagacaaatacaaagtggtaggcgtgccgtcccgctcactcgcgagcttaaaccgagcagagaaacgaggccacgatgcatacctcgatcaactcagacaagtcatcgccaagagtcaaaagaaggagttccaaatcatcattcccaaattaagatatcgacagctcatcatcgatgggggtctaaagtacaccctcgggtcgtcagcctaccaatacaacgcacgacagctagtacttagcgaaaagagcatggaagttctcgtaacagatttttccaaggtaacgacagacctcgacaaacagaaccagaaactaatcgccgtttacgacgacatcctagacaaagtgaatcgttgcctcccactatacgacaagaaccaattccgcaaagctctgaatggagcacgggacaaattcgtccaactccccatcctaccgaaattcaacggtaataaaaaggaagaagcgggcaaggtcgagatactcaacgagatcctgttaggactccatgacgacgcaagcacaggaaatctaaaaccactgggaatcaagacgcccttcggcatgttacaaacccaatccggcatcaccatgtcctccaatgcagtcatcgtaaaccaaagccccaccggcctattcgaacaccgcatttacctaaaagcattactaaacaaactcaataaatga

SEQ ID NO: 6566 - RNA, 4098 nt, synthetic construct
  misc_feature 1..4098: note = Cas9 variant
  source 1..4098: mol_type = other RNA
atgaccaaattgaaccagccctacggcataggcctagacatcgggagtaactctatcggcttcgcagtagtcgatgctaactcacacctcctcagactcaagggggaaacggcaataggtgccagactcttccgcgaaggtcaatccgccgccgaccgtcgcggttcacgaactacaaggcgccgcttgagccgaacacgctggcgtctatctttcctacgcgactttttcgccccacacataactaaaatagaccccgactttttcctgcggcaaaaatattctgaaatcagcccaaaggacaaggaccgcttcaaatacgaaaaacggcttttcaacgaccgaaccgacgcagagttctacgaggactaccctagtatgtaccacctccgacttcacctcatgacacacacccacaaagcagatccccgcgagatattcctcgctatccaccatatcctcaagtccagaggacacttccttacccccggggcagcaaaggacttcaacacggacaaagtggacctcgaagacattttccccgcactcacggaagcctatgcccaagtttatccagacctagaactgaccttcgacctagcaaaagccgacgacttcaaagcgaaactgttggatgagcaagcgaccccctccgacacacaaaaggccctagtaaagctactcctatcatcagatggcgaaaaagagatagtaaagaaacgcaaacaggtcctaacggagttcgcaaaggctataaccggcctaaaaaccaagtttaacctcgcactcggaaccgaggtcgacgaagcagatgcgtccaactggcaattctcgatgggccagcttgacgacaagtggtcaaatatagaaacgtccatgacagaccaaggaacggaaatcttcgaacaaatacaagaactgtaccgcgcccgactactcaacggcatagtccccgccggtatgtccctatcccaagcaaaagtagccgactatggccaacacaaagaagacctcgaactcttcaaaacataccttaagaaacttaacgaccacgaattagccaaaaccattagaggcctatatgatcgctacatcaatggggatgacgcaaagcccttcctccgcgaagactttgtgaaagccctaacaaaggaagtgacagcccaccctaacgaagtatccgaacaactcctcaaccgcatgggccaagccaactttatgctaaagcagcgcacaaaagccaatggagcaataccggtgcagctccaacaacgggaactcgaccaaatcatagcaaaccaatcgaaatactatgattggttagcaaaaccaaacccggtagaaaaacatcgcgccagtaaaccgtaccaactagatgagctcctcactttcagaatcccctactacgtcggccccctaatcactcccaaacaacaagccgagagcggagagaacgtcttcgcatggatggtacgcaagaacccaagtggcaacattaccccgtacaacttcgacgaaaaagtagacagggaagcgagcgccaacaccttcatacagcgtatgaaaacaacagacacctacctaatcgacgaagacgtccttccaaaacagagcctgctctaccaaaaatatgaagtcctgaacgaactcaacaacgttcgcataaacaacgaagccctctcgacggatcaaaaacaacggctcattcacgaagtattcgaacgacactccagcgttaccattaaacaagtagtcgataacctcgttgcacacggcgacttcgcccaacgccccgagatacgcggcctcgccgacgaaaaacgcttcctaagctccctctccacgtaccaccaactcaaggaaatactccatggcgcaatagatgactccacaaaactccatgacatcgagaacatcatcacatggtcaactgtctttgaagacgctgccatctttaaaaccaaattagcagagatcgactggctagaccctgccacgatcaagaaacttagcaacattcgctatcgtggctggggccaattttcccgcaaactcctcgacggcctaaaactcggaaacggccataccgtgatacaggaactaatgctatctaaccacaatctcatgcaaatcctagcagacgaaacgttgaaagaaaccatgactgaactgaaccaagataagctcaaaaccgacgacatagaggacgtcatcaacgacgcctacacaagcccctcaaacaaaaaggccctacgccaagtactacgcgtcgtcgaagacataaaacatgccgccaacggacaagacccaagctggctgtacatcgaaactgcagacggaacgggcactgcgggcaagagaactcaatccagacagaaacaaatccaaaccgtatacgccaatgccgcccaagaactaatagatagtgccgtacggggagagctcgaagacaaaatcgccgacaaagcctcatttacagatcgactcgtcctttactttatgcaagggggaagagatatttacacgggcgcgcccttgaacatagatcaactttcacactacgacatcgaccacattctccctcagtccctcataaaggacgactccttggacaaccgcgtccttgtaaatgcaacgatcaaccgcgagaaaaacaacgtctttgcaagcaccctgtttgcaagcaaaatggccgcaacctggcggaaatggcacgaagccggactaatatccggccgaaaactccgaaacctaatgcttagaccggacgaaaccgacaaattcgcccacggattcgtagccaggcaacttgttgaaacaaggcaaattatcaagctcacagaacaaatagccgcggctcaataccccaacacaaaaatcatcgccgtcaaggcgggtctcagccaccagctacgcgaggaactggacttccccaagaacagagacgtcaatcactaccaccacgccttcgacgcgttcctcgccgcccgcataggaacctacctactaaaacgctatcctaaactagcgcccttcttcacgtacggagagttcgccaaagtcgacgtaaagaaattccgggagttcaacttcataggcgcactcacccatgccaagaaaaacatcatcgcgaaggacactggggaaatcgtttgggacaaggaacgcgacatacaagaactcgacaggatctataactttaaacggatgctaataacccacgaagtccatttcgaaacagccgacctcttcgaccagaccatctacgctgcaaaagactcgaaagaacgcggaggaagaatgtccctaatacctaagaaactaggatacctaacaggcatctatggcggttaccaaaccgaacgggggtcctacgtatcaataatccgcacattcaagaaaggcgagacaatctataaagtagtaaacatactcactgccgacgtgtcactcctttctgaaaaggaaaaggtgtccaaaacactcgccgacatctacctaaaagagctcatcgccaagaaactctcaaaaggaaagagcggtaaaaacatcgcttccgaaccgtttgaaatcgtcctaccccgagttgggaaggatagcctgtttaagaacaagaaatacgggctctttctaatagagtcagccaccgaactccacaactatcaagaactctggctaccgcgcaatgatcaactacttatcaaacgtatacaagcgcgccagatagaagagagcaaagcagactatgaacttactcggatgtaccgtaacatcgcctggcaggtagaccactacttccgtctctacaagatacgtaaattcgctgaaaaactgcaggcttcggtcgaagacttcgcgggactcccagtctacaaaaacgaaaccagcgacggaaaagtcgaagttctggcgtccgtcctaaaacgcctcaacggagccgccgacaaaggcagaaccaatcccaccaccgtcaaactccaatccgacttcggccggacactcctaactaacggaattgtcctcgaagacgactcaagtatcgtctaccaatcccctacaggcctattcaaacgatcagtcaaacttgtcgacctatga

SEQ ID NO: 6567 - RNA, 4098 nt, synthetic construct
  misc_feature 1..4098: note = Cas9 variant
  source 1..4098: mol_type = other RNA
atgaccaaagagtactacctgggccttgacgtaggaacgaactccgtgggatgggcggtcacggactcgcagtacaacctgtgcaaattcaagaagaaagacatgtgggggataagactcttcgaatccgctaacacagcaaaagaccggaggctgcagcgcgggaaccggagacgcctagagcgtaaaaagcaacgaatagacctcctacaagaaatctttagcccagaaatctgcaaaatagaccccacattctttataaggctcaatgagtcgcgactccacctggaagacaaatcgaacgacttcaaatacccgctattcatcgagaaagactacagcgacatcgaatactataaggagttcccaacgatctttcacctccgaaagcacctaatagagtccgaggaaaaacaagacatccgcctaatatacctcgccctgcataacattattaagacccgcggccacttcctcatcgacggagatctacagtcagcgaagcagctccgcccgatactggatacattcctgcttagcttgcaagaggagcaaaaccttagcgtcagcttaagcgaaaatcagaaagacgaatacgaggagatcctcaagaacagatcgatcgccaagtcagagaaagtgaagaaactcaaaaacttattcgaaatctccgacgagttagaaaaggaggaaaagaaagcccagtcggccgtcatagaaaacttctgcaagttcatcgtcgggaacaagggcgacgtgtgcaagtttctacgggtatcaaaagaggaactggaaatcgacagtttcagcttctccgaggggaagtacgaggacgacatagtcaaaaacttggaggaaaaagtacccgagaaagtctacctgttcgaacaaatgaaggcaatgtacgactggaacatcctagtcgacatcctcgaaacagaagaatacatcagcttcgcgaaagtcaagcaatacgagaaacacaagaccaacctacggctcctccgagatataatactaaagtactgcacaaaagacgagtacaaccgaatgttcaacgacgaaaaggaagctggatcatacaccgcatatgtagggaaacttaaaaagaacaacaagaaatattggatagaaaagaaacgcaacccagaagagttctacaagagcttggggaagctcctggacaagatcgaacccctgaaggaggatctggaagtcttaaccatgatgatagaagagtgcaaaaaccacacgctcctacccatacagaaaaacaaagataacggggtcatcccacaccaagtacatgaagtagaactcaagaaaatcctggagaacgccaagaaatattacagttttctaacggagaccgacaaggacggctactcggtggtccagaagatcgagtcaattttccggttccgaataccatactatgtgggcccattaagcacgcgccaccaggaaaagggcagcaacgtgtggatggtaagaaagcccggtcgtgaagacagaatttacccatggaacatggaggaaataatcgacttcgaaaagtccaacgaaaacttcatcacccgcatgaccaacaaatgcacatacctaatcggagaggacgttctgcccaaacacagcctcctctatagcaagtacatggtcctcaacgaattaaataacgtaaaggtacgaggcaagaaactacccacttctctgaaacaaaaagtcttcgaggatcttttcgagaacaaatcgaaagtcaccggcaaaaacctcctcgaatacttgcagatccaagacaaggacattcagatagacgacctgagcgggttcgacaaggacttcaaaaccagtctaaaatcctacctggacttcaagaaacagatttttggcgaggaaatcgagaaagagtcaatacagaacatgatcgaagacattatcaaatggataaccatttacggcaacgacaaggaaatgcttaagcgagtaatccgagcgaattactccaaccagctgacagaggaacaaatgaaaaagatcacagggttccagtatagcggctggggaaactttagcaaaatgttcctcaaaggcatatcgggctccgacgtctcaacgggcgagaccttcgacataataaccgccatgtgggagacagataacaacctaatgcaaatactctcgaaaaagttcaccttcatggacaacgtcgaagacttcaactcaggaaaagttggaaaaatagacaaaataacttacgacagcacagtcaaagagatgttcctcagcccagaaaacaaacgggcagtatggcaaaccatccaagtagccgaagagataaagaaagttatgggatgcgaaccgaaaaagatcttcatcgaaatggcacgaggcggagaaaaggtcaagaaaaggacaaaaagccgcaaagcccaactactcgaactatatgcagcatgcgaggaagattgccgagaacttatcaaagaaatagaagaccgcgacgaacgcgattttaactccatgaaactcttcctctactacacccagtttggcaagtgcatgtactcgggcgacgacatcgacataaacgagctaataagagggaactcaaagtgggacagagaccatatctacccacaatccaagataaaggacgactcaattgacaaccttgtcctagtaaacaaaacatacaacgcaaagaaaagcaacgaactcctgagcgaggacattcagaagaaaatgcattcattctggctgagccttcttaacaaaaagttaatcaccaagtccaaatatgaccgcctgacgcggaaaggcgacttcaccgacgaggaactatcaggcttcatcgctcgccagctggttgagacacgccagtccacaaaggcgatagcggacatattcaaacagatctacagcagcgaggtggtctatgtgaagagttccctggtcagcgactttcgcaagaaaccgctaaactacctgaaatcacggagagtaaacgactaccaccacgccaaagacgcttacctcaacattgtagtagggaacgtttacaacaagaaattcacctcgaacccgatacagtggatgaagaaaaacagggacacgaactattcactcaacaaagtcttcgagcacgacgtcgtcataaacggcgaagtgatctgggaaaagtgcacctaccacgaagataccaacacatacgacggcggcacgctcgaccggatccgaaaaatcgtagaaagggacaacatcttatacaccgagtacgcatactgcgaaaaaggagaactgttcaacgcaacaatacaaaacaagaacgggaacagcaccgtctcacttaagaagggcttagacgtgaagaaatacggaggctacttttcagcaaacaccagctacttcagcctgatcgagttcgaagataagaaaggcgatcgggcccgacacatcataggtgtaccgatctacatcgccaacatgctagaacactccccgagcgctttcctggagtactgcgaacagaaaggataccagaatgtcaggatcctggtggagaaaatcaagaaaaacagcctactcataatcaacggctacccgctccgcataaggggcgaaaatgaagtcgatactagcttcaaacgggcgatacagctgaagctcgaccagaaaaattacgagctagtacggaacatagaaaaattcttggaaaaatatgtcgaaaagaaagggaattaccccatcgacgaaaaccgcgaccacatcacacacgaaaagatgaatcagctctacgaagtacttctcagcaaaatgaaaaagttcaacaaaaagggcatggcggacccatcggataggatcgaaaaatccaaaccgaagttcatcaaactcgaggacctaatcgacaaaataaacgtcataaacaaaatgctgaacttactgcgatgcgataatgatacgaaagcggacctctccctaatagaactgcccaagaacgcaggatcattcgtcgtcaagaaaaacacaataggcaaatcaaaaatcatactcgtcaaccaaagcgtaacaggactctacgaaaatcgccgggagctctga

SEQ ID NO: 6568 - RNA, 4098 nt, synthetic construct
  misc_feature 1..4098: note = Cas9 variant
  source 1..4098: mol_type = other RNA
atggacaccgcaaaaacaaacaaacagccctactacataggcctggacatgggaaccagcagtgtgggctgggccgtcacagacgcctcctataacgtcgtcaagaaacacggcaaagccttgtggggcgtcaggttatttgaagaggcgcagaccgccgcagaccggagactacaccggaccgccagaagacgcattcagcgaagaaaacagcgcctggccctactccaggagctattcgccaaagaaatctgcaaggttgacccgggcttcttcatacggctacatgaatcgcggctctggcaagaggacaaatctatcgaccaaccgaacaccctgttcaacgacgaggatttcgacgacaaagcctaccacaaagcctatccaacgatctaccatctgcgctacgccctcatgacggaaaacaaatccttcgacgtccgtctagtatacctcgccattcaccacatcatcaagcaccgcggccacttccttctggagaactacgacctcagcaaccaagagacaagcggcttcgatgaatcttatatagcactgacgaatgcaatcaaagaactcctccagaaagaaatccccgttgggcacgtcgaaaagatacagataatcctaaaggacaaatccctcagcaaacgagaaaagacagagaaaatactccaagtttgggacgttataaaagataaacagctcaaagaagtagttcagctgatatgcgggggaacagcaaacctctcaaccctcttcatggacgaatccctcaaagaagcactcaaagttttcgaaataaaagactcaaaaatcagcttcagtacagcagtatacgaagaaaaagaatctgacctccagagtgtcctagagcaacggttcgatttagtttacgccgcaaagatgctttacgactggagcctcctagcggaactcatgggcgacagaaaaacgctcagcgaggcaaagatcgcaatttacgaaacccacaagaaagacctcgaagtccttaaacggctaacccgacaagacaaatccctatatcgcaaactcttccgagggaccgataaagactcgtattccgcatacgtaggcagctgcatgatacacggcgagaaactcgtcatcgagaaaagagggagcaccgaagagttctacaaattcctaaagaaagaaatcagcaaactccctgactgcgaagacaaaatatacgtcctctcaaagatcgaagcagaaaactttctaccgaaagcagtcagtacgattaacggaataatcccataccagctccaagagcaagaactagacatcatcctcaaaaaggccgaacaatacctaccgtttttaatggaaaaggacgcatatggaaccatatccgagaaaatcaaacaactcctcacttttcgaatccccttctacgtaggcccgctcaaccgacactcagataagagctgggcagtgcacaccgacaaagaaggcaggatcctaccctggaacttcaacgaaagaataaacgaagaaaagagtgccgaaaagttcatcaccaggatgacaaacaaatgcacgtacttacttggcaaagacgtcctacccaagaactccctactctacaccgaatacatgctgttcaacgaactcaacaacgtaaagataggcaaggctggaacctacctaacagaagaacagaaggaaaaactctggaaggaactatttctaaccacgaagaaagtaaccctgagcaaattctctaaattcctaatcaaagaagggatagacaaggaagaagcggtcgaaataaaaggactagatggtgggttcaagtcctcgcttgcaccctggatcgatctcaaaaacatactcggagaagacttcactcgcgacaaagcagaagagataatcaaggccataactctattcagcatggacaagaaaatactaaagaaatatttaatgcgaatcgtctcagaacccgttgcgaaacaactgtccaaacttagatacacaggctggggccgcttcagtaaagagttcctgaccgaaatcaccccgagggtaaccgacgacgtccaggtgctcgtagacacctccacaggagaaatcatgaatatcattacagcactcaagaaaacatccctgaacctaatggaaatcctttcctcaacctacggctacagtgccgcaatctcagaagccaataaagaactcgtaggcaacacggtcctatcatacgaaactgtgaaagaactcaccgtcagcccagccgtaaaacgccctatttggcaaactctgaagataatcaaagaaataacccacatcatgggcgccgagcccgcgcgcatcttcatcgaaatggcaagagacaagcagccagacaaaggaaggactgactctcggaagaaacagttgattgaactctacaagaaatgcaaagaagacgtccgcagctggtcaaaccgtgaaagcaaagactgggtggaagagatagagagcaaatccgattcccagctccggtcaaacaaactattcctgtactacactcaaatgggcaaatgcatgtacaccggtaaaccaatcgacctcggtgccctactaaaagggcaactatacgaccgcgaccacatctacccacaaagccagacgaaagatgacagcctcgacaaccttgtaatagtcgacaaccgtgaaaaccgggacaaatccaacacgtaccccctatctaagaacatacgagaacggcaaataggcttctggaaactattgcgcgacaaagggtttatctcgaaggaaaaatacttccgtctcaccagaaacacacccttctcagacgccgaaaaagccgagttcatcgcgcgccagttggtagaaacgagacagagcacaaaagccgtcgcggaaatactgaaacgagtactcccaaagagcataatcgtatacgtgaaagcaggcctgaccagtcgattccgccaatacggcgagttcatcaaagtacgagatctgaacgactaccaccacgccaaggacgcctacctcaacatcgtgaccggcaacgtccactacacgaagttcacaagcaacccaatacggtttgtgaaggattgtcaaatatattccctcaacgaacacgcgctatacaaatacaccgtagaacgcaacggcgtcgtcgcctgggcgccaaacgaagaagggatgatgccatccgtgactaggtggatgaacaagaacaacatcctcgtgacaagaatgtcgtacgtgggacagggcgaactcttcgaccagttgcccctcaaaaagggaaagggtcaagtaagtctgaagaaagaaggagcaatatcggacatctcgaaatacgggggctacaacagtgccagtaccgcctacttcatgtacgtagaaggagaagacaacaaaggcaaaccagtatacgtaatcgaaaccatgccgctccacttagccgcgcgactgacaaccctagaagaaaaacagaaatactgcgaggaactctggatgtccacgggcggaaaactcaaaaaccccaaagttcttattgagcagatacccatacaatcactgttcagtgtcgacggctttagggtcacaatagccggaaaaaccggcaagcagtacggctgccgcctcgccgaggagctagttctgaataacgggtacgcgatgactcttaaggcggtgctcaaatttgtaaaccgacgcaaaatgaacaaagaagcactaataacttcgtacgaccacctggaagagtcacaactccttgccctatacgacgtcttcctcgacaaactggaacactcgtgcttcagcaaacgattttccacccagcgcgacgtcctgaagaacggccgagaaagctacatcgcactctcactggaagacaagtgccaaattctctccgagatactccacctcttccaatgcaacgcaaccctgtcgaacctaagcctcctcggcagcagtaaacagagcggtcgactctacatgtcgaaaaacttatcagataaagactcatggtacatcatccaccagtccgtgaccggcttctacgaacaacacatcccgctagcaccgtacaagaaaagctga

SEQ ID NO: 6569 - RNA, 4098 nt, synthetic construct
  misc_feature 1..4098: note = Cas9 variant
  source 1..4098: mol_type = other RNA
atggtaaagaagaaatatgcaataggtatagatataggtacgaactcagtaggctggtccgtcgtgacggacgactacaaagtaccctcgaagaaaatgaaagtcttcggcaacactgaaaaacgctatataaagaaaaacctgctgggaacactcctgtttgacgagggaaatacagcggaaaaccgacgactaaaacgcacagccagaagaagatacactcgacgacgtaaccgcatcctatacctacaagaaatcttcgctgaagaaataaacaagatcgacgactcattcttccagcggctcgacgattcatttctcatagtcgaagacaagcaaggcagcaagcaccccatattcggcactttacaggaggagaagaaataccacaaacagttccccaccatctaccacctcaggaaacaactcgcagactcatcacaaaaagctgacatacgtcttatctacttagccctagcgcacatcatcaaataccgagggcattttctattcgaaggcgacctcaaaagcgaaaacaaggacgtccaacacctgtttaatgacttcgtcgaaatgttcgacaaaaccgtcgaaggctcatacctcagtgaaaaccttccaaacgtagccgacgtcctggtcgaaaaggtatccaaaagccgccggctagagaacatcttacactacttcccaaacgaaaagaaaaacggccttttcggcaactttctggccctcgctttaggcctgcagccgaacttcaaaacaaatttcgaactcgcggaagatgcaaaaatccaattctccaaagagacatacgaagaagatctcgaggagttactaggaaaaatcggcgacgactacgcggacctgttcatagcaacaaaatccctgtatgatgggatccttctagcaggcatcctatctaccaccgatagcactaccaaggcgcccctgtcctccagcatggtcaaccgctacgaagaacacaagaaagacctagccctgctcaaaaacttcatccaccaaaacctatccgacagctataaagaagtattcaacgataaactcaaggatggatacgcaggctacatcgagggaaaaaccactcaagagaatttctaccgcttcatcaaaaaggcaatcgagaaaatcgaaggctcggactacttcatcgacaaaatcgacagggaggacttcctaagaaagcaacgcacattcgacaacgggagcatcccacaccagatccaccttcaggaaatgcatgctatcatcagaagacaagccgagttctacccgttcctagtagagaaccaagataaaatcgagaagatcctaaccttccgcataccctactacgtgggccccttggcccgaggaaaatccgagttcgcctggctcaaccgcaagtccgacgaaaagatccgcccttggaacttcgacgaaatggtagacaaggagacctccgccgaaaatttcataaccaggatgactaattacgaccagtacctaccggaccaaaaggtcctacccaagcactcgctactctacgaaaagttcgcggtatataacgagctcactaaagtgaagttcatagccgagggcatgcgcgattatcaattcctcgacagcggacaaaagaaagacatcgtcaagaccctcttcaagaccaaacgcaaggtaacagcaaaagacataaaagcatatctagaaaactcgaacgggtacgcaggcgtagaactaaaggggctcgaagaacagttcaatgccagcctaccgacataccacgacctgttgaagatcctaagggacaaagcgttcatagacgccgaagaaaaccaagaaatcctagaagacattgtcttaacgctcaccctgttcgaagaccgggaaatgattcgtaaacgcctggaaaagtacaaagacattctaaccgaggagcaacgcaagaaactcgaacgccggcactacaccggctggggacgcctctccgcaaaactcattaacggtattctagacaaagtcacacggaaaacgatattgggatacctcatcgatgatgggacttccaaccgaaacttcatgcagctcattaacgacgacaccctctctttcgtggacgaaatccgactagcccaaggctcgggtgaagcagaagactaccgagcagaagtgcaaaacctagccggctcgccagcgataaagaaaggtatcctgcagagtctaaaaatagtcgacgagctaatcgaagtcatgggatacgaccccgaacacatcgtcgtagagatggcaagggaaaatcagtttacaaaccaaggacggagaaactcccagcaacgatacaagaaaatagaaaatgcgatcaaaaacctagattcgaacctaaactcgaaaatactcaaagaatacccgaccaataaccaagcactacagaacgaccgtctgtttctatattacctacaaaacgggaaagacatgtacacggacgaagaactcgacatagaccaactctcacagtacgatatcgaccacataattccacaggcattcataaaagacgacagcctagacaacaaagtccttaccaagagcgctaaaaaccggggcaaatcagacgacgtcccatctctagaaatagtccacaagaagaaaaacttctggaaacaactcttagacagtcaactcatatcccagcgtaaattcgacaatctaaccaaggcagagcgcgggggccttacaaatgaggacaaggcccgcttcattcaacggcaactggtcgaaacacgacagataaccaagcacgtggcccgcattctagacacaagatttaacactaaacttgacgaagccggaaaccgcatacgtgaccctaaagtaaacatcataaccctgaaatccaacctagtatcacagttccgcaaggattaccaactctacaaagtccgcgaaatcaacaactaccaccacgctcatgacgcctacctgaacgccgtagtggccacggcactattaaagaaatacccccaacttgccccggagtttgtctacggagattaccccaaatataacagctacaaaagtcgcaaaagcgccacagaaaaagtcctcttctattccaacatcatgaacttcttccgtcgcgtcctagtatactcaaaaaccggcgaggttagaatacgccccgtaatagaggtcaacaaagagaccggggaaatcgtttgggacaagaaaagcgactttaggaccgtccgcaaagtcctcagctacccacaagtaaacgtggtcaagaaggtggaaatgcaaaccggaggcttcagcaaagagtccatattacaacacggcgactcagacaaactcatacctcgcaagaccgagaaattctacctggacacgaagaaatatggagggttcgacagcccgaccatcgcatacagcgtcctactcatagcagacatcgaaaagggaaaggccaagaaactcaaacgagtcaaagagctaataggcatcacgatcatggaaagaatggccttcgagaagaacccaatagagtttctagaacataaaggctacaaaaacatcctggagaaaaacataataaaactcccaaagtacagcctcttcgaactagaaaacggacgccgccggctcctagcctcggctaaagaactccaaaagggaaacgaaatgatacttcctccccaccttgttaccctactctaccacagcagcaacatacataagataaccgagcccatacacctaaactacgtgaacaagaacaaacacgagttcaaagagctactccggcacatctcagactttagcacccgctacatactagcacaagaccgtctcagcaaaatagaagaactctacgacaagaatgacggcgatgacatctctgatctgaccagcagtttcgtcaacctcctcaccttcacagcaatcggcgcaccagcagcattcaaatttctcggttcggtcatagatagaaagcgctacacctccatcgccgagatactcgaagccaccctaatccaccaatcagtcacaggcctctacgaaacaagaatcgacctatccaaactaggaggggactga

SEQ ID NO: 6570 - RNA, 4101 nt, synthetic construct
  misc_feature 1..4101: note = Cas9 variant
  source 1..4101: mol_type = other RNA
atgaagaaaccatacagcatcggcctcgacattggcacaaactcagtcggctgggccgtcatcaccgacgactacaaggtccctgcaaagaaaatgaaagttttaggcaacaccaacaaaaagacaatcaagaagaacctcataggcgctctcctgttcgacgctgggaacactgccgccgaccgacgactgaagcgtaccgcacgccgccgatatacccgacgccgaaaccggatcctttacctacaagagatattcgcagcagaaatgaacaaactcgacgaatccttctttcatcgccttgacgactcattcttggttcccgaggacaaagggggttcaaagtatccgatcttcggaacgctcgaagaggaaaaagaataccataagcaatttcccaccatataccacctcagaaaaagtctcgccgactcaaaggaaaaggcagacctacggctaatctacttagcactagcgcacattataaaatacagaggccacttcctgtacgaggataccttcgacatcaaaaacaacgatatacagaaaattttcaacgagttcacatccatctacaacaacatcttcgaagaatccagcctcagcaacgagaacgcccaagtagaggagatcttcacagacaagatctcaaagagcgctaaaaaggaccgagtccttaaactcttccccgacgagaaatctaccggcctcttctccgaatttctaaagctcattgtgggaaacaaggcagactttaagaaacatttcgacctggaagaaatggcacccctccaattcagtaaagacacctacgacgaagacctggaatcactcttaggacagataggagacgactacgcagatctcttcgtcgtcgccaagaaactatacgacgcgattctactagccggcatcctatccgtcaaagacccggcaacaaaggcgcccctttcagcgtccatgatcgaacgctacgacaaccaccagaacgacctctcggccttgaaacaattcatccgatcaaacctacccgagaaatacgccgaggttttctccgatgactcgaaagacggatacgccggatacatcgatggcaagaccacacaagaagggttctacaaatacatcaagaaccaaatttcaaagttcgaagggacaaagtattttctggagaagatagaacgggaagatttcctgcgaaaacagagaacattcgacaatggatccatcccccaccaaatccatttgcaggaaatgaacgccatactccaaaaccagggcggatattacccatttctgaaagccaacaaagagcgaattgagcaaattcttacattcaggatcccatactacgtgggaccgctcgcacgaggcaactcagacttcgcctggcttacacggaatagcgacgacgcaatacgcccctggaactttgaggaagtcgtcgacaaagcctcatcagccgaggacttcataaacaagatgaccaactacgacctgtatctaccagaagaaaaggtcctgccgaagcatagcctcctctacgaaacgttcgcggtgtacaacgaactcaccaaggtcaaattcatcgccgaggccatgaaggactacgagttcctcgactccgggcaaaaacgaaaaatcgtagaaaatattttcaaaaaccaccggaaagtaaccgaaaaggacataatcaactaccttcacaatgtcgacggctacgacggcatagagataaagggaatagaaaagcaattcaacgcgtccctctccacctaccacgatctcctcaaaatcatcaaggacaaagagttcatggataacccgaagaacggggaaatactcgaatcgataatccacaccctcacgatcttcgaagaccgggaaatgattaaacagctcctagcccaatacaacagcgtcttcgacgagaaggtcatcaaagcactcagccgcaaacactataccggctggggcaagctctctgccaaactaatcaacggcatacgcgacaagcaaacaggcaacagcatcttggattacctgatggacgatggaaagtccaacagaaacttcatgcagctaatcaaagatgatgggctatcattcaaagagatcatcgacaaagctcaggttgtcggggagaccgacaacctacgtcaggtagtccagaaccttccgggctcacccgcgatcaagaaaggcatactgcaatccataaagctagtcgacgagctagtaaaagtaatggggtcagacccggagagcatcgtcatcgaaatggcacgcgagaaccaaacgacaaacaaaggtaaaagcaagtcacaacagcgcctgaaaactctatcagacgccatatccgaactgggcagcaacatccttaaggaacacccaaccgacaacattcaacttcaaaacgacagactatttctatactacctgcaaaatggcaaggacatgtacacaggagaagcactcgacataaaccaacttagcaactacgatatcgaccacattataccccaagcattcataaaagacgactcactcgacaacagcgtcctcacaagctcaaaggacaaccgcggaaaaagcgacaacgttcccagcctggaaatcgtggagaaaatgaaaggtttctggcaacaactcctcgacagcaaactcatctcggaacgaaaattcaataatctcacaaaagtcgaacgaggcgggctagacgaacgtgacaaggtcggattcattaagaggcaactggtggagacccgccagataacgaaacacgtggcgcaaatcctcgacgcccgcttcaacgctgaagtcaacgaaaagaaccaaaaactgcgatccgtcaaaatcatcacgctcaaatcaaacctagtcagcaatttccgcaaggagttcgggctctacaaagtccgcgaaattaacgattaccaccacgcccatgacgcctacctcaatgcagtcatcgccaaagccatcttaaaagaataccccaaacttgagccggagttcgtatacggtgactaccagaaatacgacctcaaaagatacataagcagaaccaaagaccccaaggaaatcgagaaagctacggagaaatatttcttctactcgaacctcctgaacttcttcaaagacaaggtctactacgcggatgggacaatcattcagcgagggaacgtagagtactcaaaagacacgggggaaatagcatggaacaaaaagcgagacttcgcaatagtccgaaaagtcttatcatacccccaggtcaacattgtgaagaagacggaggagcagaccgggggctttagcaaagaatcaattcttcccaaggggaacagtgacaagctcatcccccgtaagaccaaaaacattcaactcgacaccaccaagtacggcgggttcgattcgcccgtcatagcgtactccatcctactcgtagcagacgtagaaaaaggcaagagcaagaaattgaagaccgtgaaaagtctcatcggcataacaatcatggaaaaagtcaaattcgaggcaaacccggtagcattcttggagggcaaaggataccaaaacgttgtggaagaaaacatcataaggctcccgaaatactcactcttcgaactcgaaaacgggcgacgcagaatgttggcaagctcaaaagaattacagaaaggcaacgagatggtcctcccctcctaccttctagccctactgtaccacgctaagaaaatccagaaaaaggacgaacctgaacacctggaatacatcaagcaacatcactccgagttcaacgacctcctcaacttcgtcagtgacttttctcagaaatacgtcctagcagagtcgaacctagagaagatcaagaacctctacatcgacaacgaacaaaccaaccttgaagagatagcaaatagcttcataaacctactaacattcaccgccttcggagcgccagccgtgttcaagttcttcggcaaagacatcgaacgaaaacgctacagcaccgtgactgaaatccttaaagcgacactcatacaccaatccatcaccggcctctacgaaacacgcattgatctctccaaactcggcgaggagtga

SEQ ID NO: 6571 - RNA, 4101 nt, synthetic construct
  misc_feature 1..4101: note = Cas9 variant
  source 1..4101: mol_type = other RNA
atggacaagaaatacaacattggcctcgacataggaacgtcctcaattggcttcgtcgcaacagacgaggacaaccacgtcatcagagcaaaagggaaaaacgtcatcggagtgagattattcgacgaaggccaatctgcggcagaacgccggggcttccgcaccacgcgccgtcgtctaaaccgccgaaagtggcgactaaacctcctaagagagatcttcgaaccacacatataccccatagacgcgtcatttttcatgcgacaaaagtactctaacctcagcaaacaagacccaaaccagaaaattgagttcaaagacatcctattctcagataagtccgacgcagagttctaccgtcaataccccacaatataccatctacgccaagctcttatgaccgaaaagcgtcaatttgatctcagagaaatatacctcgccatccaccacatagtaaaatacagaggacacttcctggacgaaacccccacggacaagttttccttcgaccaactcgacctcactcaagagttcgaacgcctgaacgtcctcttcagcgaacaaaatccagaggagcccttcgaaatagtagtcaatcagaaccaatccatcgaggacatcctatctaaccagtcgatgaccgcctcggaccgccgcaaacaagcactcgtcgtgttctaccaacaatccgaaaacaaggaaaatgaaaaacagtacaaagcaatcgcgaccgaaatcctgaacctactgctcggcaataaagccaagctgaacgtcatcctggctcaagaagtagacaaagaagctgcgaaggactggagcctaagcctctcatcagaaaccttcgacgacgacctagaaaaggctagctcaggcctaaatgacagccaactggaaatggtaggtatatttgagagaatttactcctcacttatacttaaatccattataggggaccacaactccctctccgccgctatggtggacaaattcaaaacccacgcacaacaccgcgatctactcaaagacgtaattaagaactctgacgccaccaaaggagaacagctacagtttgcctatgaccactatctccagagacactctgctgacggaaaagcatacggtaaagacgacttctataaagaagtcaagaaaaacttagatgactccgatgccgcccaacaaatccagcagctaatagacaccgaccagtttatgcccaaacaaagaacaaaggcaaacggggcgatcccccaccaagtccagcagaaagagctagacctgattatcgaaaaccaatgccaatactacccgtggctggcagaagaaaacccaaacagcgaacgccacaacgtcgcgaagtacaagctcgacgaattagtgagcttccgagtaccctactacgtaggccctcttatctcccccgccgacgacgagaccgacccccaagccatccagaatacaaagttcgcctggatgatccgaaaggacgcgcaaggaagaataaccccctggaattttgacgacaaagtagaccgcgagaaaagcgcagacaagtttatcaaacgcatgaccaccaccgacacatacttaataggagaagacgtactccccgaccaatcgctcatttatcaacgctacaaagtcctcaacgaactcaacaacgtccgaataaacggacgccccatcgaggtccaaatcaagcagaacatatacacagatcttttcaagaaattcaaaagcgtcagcgtcaagaaactaagatcatacctcgaagagatgtcatactaccccggatccttcaaaatctccggcctcaccaaccccgggaaatttgataacgggctcacctcctacctcgactacaaaaacatacttggcgactcggtcgacgctaacgacaaaagagcagacatcgaacaaatgatcgaatggagtacaatattcgaagacaacaaaatattcgcgcaaaagctagaatcaatgacctggttgacagccgaacagcgaaaggctataagccgtaagaggtacaccggatggggccgcctttcaaacaaactccttacacaattaaagaaccaagacaacagatccatcatggacctactctgggaaacagaagaaaacttcatgaaaatacaatccgcccccgacttctccaaaatgattgaagcccacaatcaacaattcatcaaaaacgaagccaacatccagcaagtcatctccgacctatacacatcaccacagaacaagaaagctatcagacagatcctcctggtggtcgacgacatacaaaaagccgtcggccacgcccccgagcacatcgcaatcgagttcgccaaaggagaagataaaaacccccgcagaactattagccgggaaatgaaaatccaggatgtgtaccagcaaatctctgacgacatcctcgtcagcccagaagtacgagcgcagctcaacgagaaaatagaaaaccgccatggccgcctcagcgatcgcctcttcttatacttcatgcaaggcgggcgagatatgtacaccggcaagccgataaacattaacaatatcagccattacgacatagaccacatcctgccgcaggccttcattaaagacgattcactggataaccgcgtcctggttagcgataaactcaaccgagaaaagtcagacacagtcccccgggacctcttcggaagagaaatgatgtccacctgggaaaagatggcggaccgcggcctcatcaccaaacgaaaacttgccaatctgaaaaccataccgggaagcatcgatgcacacaaggcacagggattcattaaccggcagttagttgaaacgcgacaagtgattaaactggccgtgggaattatgatagaccagtaccccgaaacacagatcgtaagcgtcaaggcgaacctcacccacgaaatgcgcgaaatgttcgacttagtcaaaaatagggacgtaaatgattatcaccatgccttcgacgcataccttacagcctttgtagggaattacctcttgcaacgttacccaaagctcgaaccatacttcgtatacgacaaattcaagaaattaaaagaccagaacataagtatgcgcgacttcaacctcctctacgaccttaagaaaaacgaggacgtctatgaccagcgcaccggccacagcgcccacaaaatctgggatcagcacggatcaatagactacatccgccacctgttcgcctacaagaaaatcctcgtaagccacgaggtacaccaaaacggcggggccctctacaacatgaccgtctacggcaaagccgacgacgccaaacgaaaattaatcccgataaaagccgacaaacccacagagctctacggcggctatacatcgcgcaagctggcttacatggccattgtgaagacgaagaaaggcaagaaagaacaataccaagtcaccggggtccccgtatccgcactaaccaccttacgccaatttaaagaagatagccccgaacagaaacaagcactagaagagatcgtgcgccgaaacttcgacgagaaaaccgaagtggaaatcatagtacccaaagttctattcaaccaactcatagtagacgaaaagtgccgctttatggtaggatccgacacataccgttacaacgcccaacaactcgtcctctccgcggatgacctcgaaatcattaacgcgtcccacaaagacatccagacaatcgacagcagcgactactcccaacagctagatcaggtataccaaaacatcctgacaatcgtggacaaacatttcccaatgtacgacataaataagtttcgcactaaactccacgacatctacgaacagtacatcgaacttcctaacgaggacgtctgggaaaacaacaagctcacaacccttggcaagcacacaatcatcatccgcatcttgcaaggcttacatgcaaacgcaacagtcgttgacctcaagcaactaggcataaagaccccattcgggtttatgcaacaggcccgcggcatcgtcgtcagccccgacgcacaactaatctatcaatcaccaaccggactgtacgaaagacgagtgcgcctcggggacctatga

SEQ ID NO: 6572 - RNA, 4101 nt, synthetic construct
  misc_feature 1..4101: note = Cas9 variant
  source 1..4101: mol_type = other RNA
atgggagaccgcaaatacaacctgggccttgacatcggaacatcatcgataggattcgcagccgttgacgagaataaccaacccataagggtgaaaggaaagaccgcaattggggtccgactcttcgaggaaggaaaaaccgcagcagatcgccgcggctttcgtaccacacggcgacgtctgagccgaagaagatggagaatcaatctcctcaacgggatattcgacgcccacctggcggaggtcgaccccacctttctggcacgcctcaaagagtcaaaccgatcgaacctcgatcccaaaaagtcatttcaggggagcctcctcttcccggagcgaaaagactaccaattctataaggaataccccaccatctaccaccttcgcaaagccctgatggaggaagaccgcaaattcgacatccgagaaatatacctagccgtccaccacataataaagtaccgaggcaacttcctcaatggcacaccaatgaggagcttcaaagtagaaaacatcgagctggacaccctatttgaccgactcaaccaactatatgaggaaatcatcccagacaacgagctcgctttcgacctggagcaagtagccgacgtaaaagaagtcctaagctccacgacaatctacaaaatggacaaaaagaaacaactcgtcaaaatgatgctcctgccaacttccaacaaagcattgcaatcagaaaacaagaagatagtcacacaattcgttaacgcgatactaaattacaaattcaaactcgatgtactcctacaagtggaaaccgacgctgactggtcgcttaaactcaacgacgaaggagcagacgacaaactcgaagagtttacaggagacctagacgagaaccgcctcgaaatcatcgatctcctacagcgactacataactggttcagtctcaacgaaataaccaaggacggaaatagcctctcagcagcaatggtcgaaaaatacaaagatcaccgtcaccaccttgagctcctcaagaaagtcatcgaggaccatcccgacgccaagaaagcaaaagccctaaaagaaacatataccgcctacgtaggcaaaacagacgacaaaacgcaaaaccaagacgacttctacaaagcagtagaaaagaacctggacgacagccccgacgccaaggagatcaagcgcctcatccaactggaccaattcatgccaaaacaacgaacgggacagaacggagcaatacctcatcaactacaccaacaagagctggatcaaataatcgaaaagcaaagtaaatactatccattcctcgccgaacccaaccccaacgtaaaacgccgtaaggacgcgccgtacaaattggacgaactaatagcattcaaaatcccatactacgtcggacccctcgtgacgccagaagaacaagcccaaaacggtgaaaacgtattcgcttggatgaaacgtaaggtcgccggccctattacgccgtggaacttcgacaagaaagtagacagaatggaatcagccaaccgcttcatcagacgcatgacaaccaaagacacatacctgttcggagaggacgtgctgcccgctgaatccatgatctacgagaaattcgtcgtcctcaacgaacttaataacctaaaaatcaacggaagacatctgagcctgaaagacaaacaagacatatacaacgacctcttcaagcagcagaaaacagtttcaatcaaggcactacaaaattactatgtcaccaagaaaaaggcggcaacagctcccacggtaggcggccttgccgaccccaagaaattcctgtcaagcctctccacatacatagacttcaaaaatatgttcggagaacaagttaatgatccacagttccaagaagatttggagcaaatagtagagtggagtacaatattcgaagaccgcggcatattcaaggcaaaactgcaggccctcggctggctcagcgaaaagcaaatacaacaactcgtagccaaacgctataaaggatggggccgattatccaaaaagctactcacaggtctcaagaacgccgaaggatactctatcctagacgaaatgtggaggtccaccgaaaacttcatgcaaatacagtcccgacctgagttcgctgccctgattcaacaagccaacgaaaaacaattcgaaggcaacgacccgaacaacgtatgggaaaacatagaaaacatattaggagacgcatacaccagcccccaaaacaagaaagcaataagacaagtcgtaaaagtggtccaagatattgaaaaagccgtaggaaatcccccagagaaaatcgctatcgagttcacaagggaagccgcggccaatccacagaggactcaatcccggctccgaacactcgaaaaactctacgaatcagccgaggaagtcgtcgacgcgcgccttacagctgagctcgccgagttcaaagaaaataagcacgttctatcagacaagtactacctctactttacgcaactgggaagggacgtctacacaggtgacaccatatcactggaccggctcaatgactacgacgtagaccacatcctaccccagagcttcataaaagacgatagcttagacaaccgagtcctcacaatccgcgccgtcaacaatggaaaatcagacaacgtacccgctaaaatgttcgggaaaaagatgggatccttttggcggtacctactcgataacggaatgataagcaaacgtaaatacaacaatcttatcaccgacccagacaatatctcgaaatatgcacaaaaaggattcatcaaccggcaactggtcgaaacgagtcaggttataaaacttaccgcgaacatcctaaacggcatttacgacaaagacaccgaaatcatagaggtccctgccaaaatgaactcccaaatgcggaagatgttcgatctcgtcaaagtacgagaggtaaacgactaccaccacgccttcgacgcttacctgacaatcttcatcgggaactacctgtataagtgctaccctaaactacgcccttacttcgtctacggaaaattcaagaagttttcagacaacgaagatatcgaggtcggggacggcagattcaactttctgaaccgcattgaacgcctcaaaaatgtcaccgaccccgaaacaggggaaatcctatggagcaacgtagcccccaacgaaacgatcaaacggatcaagaaagtttacaactataaattcatgattgtatcgcgggagataacgacccggagggccgagctattcaaccaaaccgtctacccgaaaaactaccggggcaaactcatacccataaaggaggatcgcccgaccgacctctacggcgggtactccggcaacacagatgcataccttgccatcgtagcgctagaagacaaaaagaaaggcaaatacttcaaagtcgtcggcatcccaacacgcgccgctgcaaagctggaaaaactcaaacagcaagactcacaacaatacctccaggccgtccacgaggtgattgcaccacaattcaccaagtccactaagaaaggcatcaaaaagacggagttccgcatagtactcgacaaagtccactaccgccaactggtccaagacggtccagtcaaaatgatgctcggaagttccacctacaagtacaacgcaaaacagctagtactatcagaaaaagccctacaagttataaaggatgaccggaagttcgacgaaacccaaaaagacgataacctaatcgcagtatacgacgaaatcctcagcatcgtcaaccagagcttcgacctctatgacataaacggcttccgcaagaaactcaacgacaaccgcaatcaattcatagacttaccagccgaaactaaatatgaaggacgaaaagtggtcgcccacggcaaacgcgaaatgatactcgaaatactgaaaggcctacacgcaaacgcctcgttcggcaacctaaagcccataggctttgccacaccattcggccaaatgcagtccaaaaacggaatagagctaagcgaaaacgcgttcctaatacaccaatccccatccggcctttttgagcacaaaataaaactcagcgacctttga

SEQ ID NO: 6573 - RNA, 4101 nt, synthetic construct
  misc_feature 1..4101: note = Cas9 variant
  source 1..4101: mol_type = other RNA
atgaccaaactcggaaaaccatacgggataggagtagacatcggcagtaactcaataggcttcgccgcagtggacgaaaattcgcacctgattagactaaaaggcaaaaccgtaatcggcgccagactcttcgaagaaggcaaagcagcagcatatcggcgcgcatctcggaccacacgacgccgcttatcacgcaatcgctggcgcttatccttcctccgcgatttcttcgagtctcacattacccccacagatccaaatttcttcatgcggcaaaaatactccgaaatatcccccaaagacaaggcacgctacaagtatgaaaagcgcctgttcaacgacaggactgacgcagagttctaccaacagtatccaaccatgtaccacctccgcacccgcctgctaaccgacccctcaaaggccgacgtacgtgagatatactttgccatacatcacatcctaaaatcgagaggtcacttcctcacgccaggctatgcaaaagacttcaacactaacaaagtagcactgaacgaaatttttccagccctccaagacgcctacgcccaagtctaccctgatctagacatcacctttgacgaaaacaaagtgaacgagttcaaaacagtcctgctcaacgaaaaagccaccccctccgacacccagcgcgcactggtcaacctcctactcgccaaagaaggtgatcgggacatattaaagcaacaaaagcaagtgctcaccgagttcgcaaaggctgtcgtcggactcaaaaccaaactaaacgtagccttaggcacagaagtagacagtagcgaagctacggcttggaacttcagcctaggacaactagatgacaaatgggcggggatcgaatccgccatgacggacgaaggaaccgaaatcctggaccaaatccgcgacctatatagagcgcgacttctcaacggtatcgtacccgcggggaaaacactctctcaagcaaaagtcgacgactacgcccaacaccacgaagacctcgaactattcaaagactatctcaaacaacttgaagatgacggaacggcaaaggcaataaggcaactctacgaccgttacatcgatggcgacgacgcgaaaccattcgtgcgcgaagacttcgtaaaagccttaacgaaagaagtcacagcacatccgaacgccaaaagccccgagctcctcgaaaggctggcacaacccgactttatgctcaaacagcgcaacaaagctaacggggccatcccagtacagatgcaacaacgcgagctcgaccagatcatcaagaaccaggccgtctactacgactggttagcagctccaaaccccgtcgaaaaacaccgacaatcaatgacctatcaactggacgaactcctcaatttccgaatcccttactacgtagggcccctagtaaccgcaaaagaacagaaagccgcccaaggaggcgtattcgcctggatggtcaggaaagacccagacggtaacatcacaccgtacaactttgacgaaaaagtggaccgcgaagcctccgccaacacattcatacaaagaatgaaaaccaccgacacatatctaatcggggaggacgtcctcccaaaacaatccctcctctatcagtcctacgaagtactgaatgaactcaacaacgtacgcgtcaacgacaataaactttcgttcgaccaaaaacagcaagtcctaggcgaactatttgaaagacacaacaccgtcacaatcaagcaattcgtagataacctccttgcacacggggactacgatcgcatccccgaagtccgcggactagcagacgagaaacgattccttagctcactgtcgacgtacaaccaactcaaaggcatcctgcacgaggcgatcgacgacgccgacaaacaaaccgatatagaaaacataatcgcatggtcaacaattttcgaggataaggccattttcaagaccaaactaaacgaaatttcatggctaaacgcaggtatgatcaactcactcgcaaacatccgataccgcggctggggccaatttagccacaaactcctcaacgaactcacactcagcaccgggcggactgtattcgaagaactgttgatctcatcccggaacctcatgcaaatcctaactgacgaggtcctaaagcagaaaatcgctgaactcaacgcacacgaactaaaagccagcggcatatacgccgctattgacgacgcatacacctcgccatctaacaagaaagcccttcgccaagtactatctgtcatcgatgacataaccaatgctgcaggacaagccccgaactggctgtacatcgagaccgccgacggcgacggagtccccggaaagcgcacaaacagccgccagcgcaagatacaagagatctacgcaaacgccgcccaagagcttataacagggagcgtccgcggtgagttcgaagacaaaatcgcatccagggcagacttcacggaccgcctagtactctacttcatgcaaggcggcagagacatatacaccggtgagcccctaaacattgacaacttatcaagctacgacatagaccacatcttaccccagtcccttatcaaagacaacagcctcgataaccgagtcctcgtacaccctcttgtaaaccgagagaaagataccattttcgccagtactcgattcgcaaaacagatgaacggcatgtggcgacaatggcacgccgccggcctgatttccagccgaaaactccgaaacctgcagatgaggcccgacgaaatcgacaaatacgcatcgggcttcgtggcaagacagctagtggaaaccagacaaataatcaaactcaccgaacaaatcgtcgcagatcaataccccgacaccaagataatagccgtcaaggcaggcctctccagccagttaagaaaagaactcgacttccctaaaaaccgcgaggtcaaccattaccaccacgctttcgacgcgttcctcgcggccagaattggcacatacctcctcaaacgctaccccaatctcgaacccttcttcacatacgggaaattcaagaaaactgaagtcaagaaactaaaatctctcaaaagcctcaaatcatttaacttcataagagacatgacgcacgcaaaagacaaaatcgtggccaaggaaacgggcgagatagtttgggacaacgccagtgacataaacgaattagaccgcatctacaactttaagagaatgctcatcactcacgaagtccgattcgaaaccgcctccctcttcaaacaaaccttgtacgccgccaagaactccaaaaaccgcgggggctccagacagctaataccaaagaagaaaggctatctggtcgacatctacgggggctacacccaagaaaccggctcatacctgagtgtcgttcgactcacaaagaaagcaatgtatgccgtcgtgaaagtcagcacccgtgacgcagccaaattagccgtagcgaaatcaatatccgaacaaaaagaaaacgagaccctaaagaaaatcatcgacgggaaactctcaaaaacgtcaaagaaaggcaaaacaacccatcagctattcgaaatagtgctcccacgcgtcggtcagaaaacattattcaaaaactcaaaatacaatcaattcctagtaaactcggatacctacatgcacaactaccaagaactctggatgccaagagaatatcaacgaatgtggaaagacatcctcctctccaaccatggagacgcccaaatagagggacaattagaccaaatcttcaaattcatagtatcccaagttaattcctacttcaatctctacgacatcaatcaattccggaagaaaatcgcagacgccacggacaaatttgccaaactacctacccacgacacagataacgcacgcgggaaaatagccacaatcggccaactcctaatagggctacaagcaaacgcgatgcgaagcgacttgcggaacctcgacataaaaaccccatttggcctcctacaaatcggaaccgggatcacattagatcttgacacttctataatatatcaaagtcccaccggactctttgagcgtgaagtgcccctaaccgatctgtga

SEQ ID NO: 6574 - RNA, 4101 nt, synthetic construct
  misc_feature 1..4101: note = Cas9 variant
  source 1..4101: mol_type = other RNA
atgaccaaagactactcactgggactcgacatcggcaccggcagcgtaggattcgcggcactcgacactaattaccgcctgctacgagccaagggcaacaacgtcataggtgtacgactcttcaccccagcggaaaccgcggaagaacgacgaggcttccgcacggcccggagacgactgtcgcggcgccgctggcgcctaggagcgctcaacggcatcttcgcaccagaactggcaaaggtggaccccaacttcttacatcgcctcaagtacgcctgggtacaccccgcggaccagcaaaacaagggcaaatactcagccgcacccctgttcaacgacgccgccttggaccgacaattccacgacgactatccgacaatataccacctgagactaaaattgatgactgacacttcccagcacgacctccgagaagtttacctcgcgatccaccacattataaaattccgcggaaacttcctgcgtggcgaaggccccatcaacgcgagcgaagccttcgatatcaacaccttcatcgatcagatgacggccttctacgaccaggcattcccagacttcaagatcgtcgaccaagtcgaccaacagatcatcttcaaaggcctcacagacatgacgctcagccccgcagatcgagcgaacaaagcactcatgggattcaacaacgccgctcaacagcccaacaaaagaatcttcaaagcgattctctccggactggtaggcaaccaagttgacctcatggccatcttccaattagacgggataccaaaagaagaccagaaagagtttaaattcaaattcgtcgataacgacatagaagagaaacttgccgcactcggggacaaccccgccctctccgatgaacagaatgagttcctcacgaccctatacgcggcattcagcggactgaccctcaaaggcctcctcggagacgccacatccatatccgcggccatggtggcaagatacgcatcccaccggacggactggacatacatcaaagaccatgtccttacacctcaaaacaacagagaactccgactagcatacgccgacctaatgaccgacaatgaagacgtccgccttaaagcggggaaaaagttcgccaaagccatagaggccgcagacataccggcagccaagaaatcggaatttagcctgaaaatagacaacaatgagttcctaccccgccagagaacgaaggcgaacgggacaatcccgcaccaactccacctcaatgagctacaacaaatcatagaaaaccagggacaatactaccccttcctcaaggccacatttgaacaggacgggcacacactaaacaaaatcgagggtctcgtaaaattccgggtcccctattacgtcgggcccctcgtacccaagcacaaggtcgccggcaacaacgcaaaccactggatggtgcccaaagaacccggcgcaatcacaccctggaactacaccgagaaagttgaccgcgacaaaagcggcaacgagttcatccgccgcatgacgggcacagacacctacctcttaggagaacccacacttcccaaaaacagcctcgtatatcaagagttcaacgttctacaggagctcaacaacctccgcatagaaaaacgccggctcgacatcgccgtcaaacaggatatcttcgaacacgtttttaaaacgaataaaaccgtcacggtcaaacgtattgaagaatacctgacaacagaatttggctccccggtaaccctcagcggcttcgccaacgtcaacgaaaggaagctgaacagcagcctaagcacataccattacttcgtcggaatcttcggggctgagttcgtagacgatccgaagaacctaaccctcctcgaacagatagtggaattacagacagtgttcgaagaccgcaaagcactccaaagacagctcaaactccgcccagaactctcagagaaacaagtgaaacaactagcacgtacacactacacaggctggggccgattatcacagaaactacttacgtcaaagatcgtacacgtcgccctggaaggagaacgcgaacctggccaatactcaatactagaaacactctacggcacacagatgaacttcatggaaatagtcaacgacatgaaggatcgttatggagtaaaaagctggctcgatcaagaaaactccggctcagaaaataacctgtccctcaaacaacggatactggacatgcccgggcccaagaatatcaaacgcggaataaaccaagcctttcatatcatcgacgaaatcacccgcgccgtcggcaacgccccaagccgcatctacatagagttcgctcgagaatcccaacagagtaacctaacaaacgccagagtaaaccggctgaagcaactctactctaatcaagccctcaaaaaggaatttgccaaactcgcttccgaaataaaagacctcaccaaagagcaactaaaagacgatcgcctttacctatactacctacagcaaggaaaagatatgtataccgagaccgacattgacatcaccaagatctcatctaactaccagatcgatcacattataccacaagcctacaccaaaaacaactccttagacaatcgagtcctcgtgaacagcgaaatgaacgcacgcaaatcagactcccccacgttcctgccaagtctaatccaagagcgcaaagcatggtggagacagttgagagacacggggctgatgagtaccataaaatacaacaatctgacaagaacgtcagacgacttctcagccgaccaaaaggaacgctttatcgctcgatccctggtagagactcggcaagtcatcaaaaacgtcgcaacgctcattaaggaatactacgacgatagccaagtcgaagcactcccttcagaaataaccgcggaaatgcgccgatatctgaacgtgcgtaaaaatcgagacataaacgactatcaccacgcccatgacgcccttctgttcgccacagccggcgagttctctagaaaagtcggcatcatggaaaaagggcgcgtctccgacggtgccgggaacatctataaccgctacaccaaagacatcatacagcgggcccgcgccaaagccggtcaagacaagaaagtcagaccgttcacgttcatagtcggctcgatggccaaccctgacaccaaattccaaactaaccaaaccaccggagaaatagtctggacccccgaagacgtagcctacctccgtaaagtgatagactacaagaaaatgctagtaaccaaaatgaccctcgaccaaacaggtacgttatacaacgaaacacgctacggctcaggagacaaacacgtcgcggttgccctctctaaagacaaagcagcggacctctacggcggcttcggatctctcaaacccgcctacgccgcactggtatactcgaaaaagaaattcaggctggtcaacgtcctacgcctctggctcccagaaatcaagaaaaacgcgtccgtattagaacgcaaagtgcaaagcgtactgggcgacgacaatgcgaaagtcatcagggcgcacgtcccctgcggccagctactgatcaaggacggcgctctcgtcacagtatcgagcgcaaccgaattacacaacttcagacaattatggctcccaaaagccgactatcaggacatatccatactactgggcgcacctgacaaagtcacagccgaaaacagactccaagctgaatcccacttcgacgacgtcgaccaacggtttgaatccctactcaaggacgtgatagaccaagcccgccaatactacccacttaaaacccaccagacatccctcgaaaaacttatagggaaaatcggaaaattcgacgaactcaaatttgcccaaaaacaacaagttttctccagattgctatcagcgctccacgccaatgcaaccaactcagacctgaaacaaatcggcctctccaccgcctggggccgactgatctaccctaaaggggtcagcttaaccgacgaggacaagctaatcaactcatctttcaccggactcttcaatgacgtaatgtctatcaaagaatttcacgacttctccataaactga

SEQ ID NO: 6575 - RNA, 4104 nt, synthetic construct
  misc_feature 1..4104: note = Cas9 variant
  source 1..4104: mol_type = other RNA
atgaagaaacaaaaattctcggactactacctcggcttcgacataggcacgaactcagtaggatggtgcatcaccgacctggactacaacgtcctccgattcaacaaaaaggacatgtggggatcccgtctcttcgaagaagcgaaaacggctgcggagcgccgcgtacaacgtaactcgcgacgaagactcaagcggcgaaaatggcgcctgaacctactagaagagatctttagcaatgaaatactcaaaatcgatagcaacttcttccggagactaaaggaaagctcactatggctcgaggacaaatcgtccaaagaaaaattcacgctgttcaacgacgacaactacaaggactacgacttttacaagcagtaccctactatattccacttacgcaacgagcttatcaaaaatccggagaaaaaggacatacgactcgtctatctcgccatccactccatatttaaaagccgtgggcacttcctattcgagggccagaacctcaaagaaataaagaacttcgaaacactatacaacaacctcatagccttcctcgaggacaacgggatcaataagataattgacaagaacaacattgaaaagctggaaaagattgtgtgcgacagtaagaaaggactcaaagacaaagagaaagagttcaaggaaatattcaacagcgacaaacagctcgtcgcgatcttcaaactcagcgtaggcagcagcgtatctctaaacgacctattcgacaccgacgaatacaagaaaggggaagtggaaaaagagaaaatctcgttccgcgaacaaatctacgaagacgacaaacctatctactactcaatacttggcgaaaagatcgaattgcttgacatcgcaaagtccttttacgacttcatggtgctgaacaacatactcgccgactcgcaatacataagcgaagcaaaggtcaagctgtacgaagaacacaagaaagatcttaaaaatctaaaatacatcatcaggaaatataacaaaggcaactacgataaactgttcaaggataaaaacgagaataactactcggcgtacatcggactcaacaaggaaaaaggaaagaaggaggtcgtcgaaaaatcccggcttaagatcgacgacctcataaaagtcataaaaggctacctcccaaagcccgagcgaatagaagagaaggataagacggtcttcaacgagatattaagcaagattgagctcaagaccatactccccaaacaacgcatctcggacaacgggacactcccctaccaaatacatgaagttgaacttgagaaaatcctcgaaaaccaaagtaagtactacgactttcttaactatgaagaaaacggggtaagcacaaaggataaactcctcaagacattcaagtttcgaatcccctattatgtcggcccactgaacagctaccacaaagacaagggcggcaactcctggatcgtgaggaaagaggagggaaaaattctgccatggaacttcgaacaaaaagttgacatcgaaaagagcgcagaagagttcatcaaacgcatgaccaacaagtgcacatacctaaacggcgaagacgtgatcccaaaggatacgttcctctactcagaatacgtgatactgaacgaacttaacaaggtccaagtcaacgacgaatttttgaacgaagaaaacaaaagaaaaatcatcgatgaactgttcaaagaaaacaagaaagtctccgagaagaaatttaaagaatatctgctcgtcaaacagatcgtcgatggaacaatcgaactcaaaggcgtgaaagactcgttcaactccaactacatcagctacatccgattcaaagacatattcggcgaaaaactaaacctcgacatatacaaagagataagcgaaaaatccatattgtggaaatgcctctatggagatgacaagaagatattcgagaaaaagatcaaaaacgaatacggagacatactgacaaaggacgaaatcaagaaaatcaatacgttcaaatttaataactggggacgactcagcgaaaaattactaaccggcatagagttcataaacctcgagaccggcgaatgttactcgtcagtgatggacgcattgcgacgtacaaactacaaccttatggagttgctcagctcaaagttcaccctacaggaatcaattaacaacgaaaacaaagaaatgaacgaagcatcctaccgagacctaatcgaagagagctacgtaagcccctcgctcaaacgcgccatcttccagaccctaaaaatatacgaagagatccgcaaaataacaggacgggtgccaaagaaagtctttatcgagatggcacgaggcggggacgaaagcatgaaaaacaagaaaatcccagcccgccaggaacagctcaagaaactatatgacagctgcggcaatgacatcgccaacttcagtatagacataaaagaaatgaaaaactcgctcatctcatacgacaacaacagcctaagacaaaagaaattgtacctctactacctccaatttggaaaatgcatgtacaccggacgtgagatagatctcgatcgcctgctccagaacaacgacacctacgacatcgatcatatctacccgcgcagcaaagtcatcaaagatgactccttcgacaacctagtcctagtactaaagaacgagaacgccgaaaaatctaacgagtacccagtcaagaaagaaattcaggagaaaatgaaatcattctggcggttcctaaaagaaaagaacttcatcagcgacgaaaagtacaagcgtctgaccggcaaggacgacttcgaactaagaggcttcatggcccgccagctcgtcaacgtacggcagaccacaaaggaagtagggaaaatcctccaacaaatagaaccagaaatcaagatagtgtactctaaagccgagatcgcgtccagcttccgggaaatgttcgacttcatcaaagtgcgcgaactgaacgacacacaccacgccaaggatgcgtacctgaacatagttgcggggaacgtctacaacaccaaattcaccgaaaaaccatacaggtacctccaagaaatcaaagagaactacgacgtgaagaagatctataattacgacattaagaacgcctgggacaaggagaactccctagaaattgttaaaaagaatatggagaaaaacactgtaaacataacccgcttcatcaaggaagaaaagggccagctgttcgacctcaacccaattaagaaaggtgagacaagcaacgaaattatctccatcaaaccgaaagtctataacggaaaagatgacaaacttaatgagaagtacggttactacaagagtttgaatcctgcctacttcttatacgtcgaacacaaggagaagaacaaaaggatcaaatcctttgagcgagtcaacctcgtggacgtgaacaacatcaaggatgaaaagagtctagtgaaatacctgatcgaaaataaaaagctagtagaaccccgagtcatcaagaaagtttacaaaaggcaagtcatccttatcaatcactacccctactctatcgtcacgcttgactctaataaactcatggatttcgagaacctcaaacctctattcctggaaaacaaatacgagaagatcctcaagaatgttatcaagttcctcgaggacaaccagggcaaatccgaggagaactacaagtttatctacctcaagaaaaaggaccgctacgagaaaaacgaaaccctcgaaagcgtaaaggacagatataacctcgaatttaatgagatgtacgacaagttcctagaaaagttagacagtaaagactacaaaaattacatgaacaacaagaagtaccaggaactactagatgtgaaagaaaaattcattaaactaaacctcttcgacaaagccttcacgcttaagtccttcctcgacctcttcaacagaaagacaatggccgactttagcaaggttggcctgacgaaatacctcggcaaaatacagaaaatctccagcaacgtcctaagcaaaaacgaactctacctcctggaagaaagcgtcaccggactattcgttaaaaagatcaaactgtga

SEQ ID NO: 6576 - RNA, 4104 nt, synthetic construct
  misc_feature 1..4104: note = Cas9 variant
  source 1..4104: mol_type = other RNA
atgaagaaacagaaatttagcgactactaccttggcttcgatataggaaccaactccgtcggttggtgcgtgactgatctggactacaatgtcttaagattcaacaagaaagacatgtggggtagccgcttattcgacgaagccaaaacagccgccgagagacgcgttcaacgtaacagtcggcgccgactcaaacgccgaaaatggcgactgaacctgctggaggagattttctcggacgaaattatgaaaatcgactccaacttcttccggcggctcaaagaaagctcactatggctcgaagacaaaaatagcaaagaaaagtttaccctcttcaacgacgacaactacaaggactacgacttctacaagcagtatccgaccatattccatctgagggacgagctcatcaaaaacccagaaaagaaagacatacgactcatatacctcgcgctacacagtatcttcaagtccagaggccatttcttgttcgagggtcagaatctcaaggaaatcaaaaacttcgaaaccctctacaacaacttaatatcattcctggaagataatggcataaacaaatccatagataaggataatatcaagaaacttgagaagatcatatgcgactccggcaaaggcctcaaagataaggaaaaggagttcaaagaaatcttcaacagcgacaagcagctagtcgccatattcaaactaagcgtcggctccagcgtcagcctaaatgacctgtttgacacagatgaatacaagaaggaagaggtcgaaaaggagaaaatatcattccgagagcaaatctacgaggacgacaaacccatttactactcaatcctaggcgaaaagatcgaactcctcgatatcgcgaagtccttctacgactttatggtcctcaataacatactcagtgactccaactacatctcagaggccaaagtcaagctatacgaggaacacaagaaagacctcaaaaacctcaaatacatcatacgtaaatacaacaaggaaaactacgacaaactgttcaaagacaaaaacgaaaacaactacccagcgtatatcgggttaaacaaggaaaaaggcaagaaggaggtcgtcgaaaagtcgggtctcaagatcgacgacctcatcaaagtgattaaggggtacctgcccaaaccggaacgcatagaggagaaggacaaaacgatattcaacgaaatactgaacaagatagagctcaagactatactccccaaacagagaatcagcgacaacgggaccctaccctaccagatccacgaagtcgaactggagaaaatcctcgaaaatcaaagcaaatactacgacttcctaaactacgaagaaaatggcgtctcgaccaaagacaaactcctcaaaacgttcaaattccgcatcccctactatgtaggcccacttaacagctaccacaaggacaagggaggcaactcctggatcgtgcgaaaagaagaaggaaagatcctaccctggaacttcgaacaaaaagtagacatcgagaaaagtgccgaagagttcatcaagcgcatgacaaacaaatgcacctatcttaacggggaagacgtcatcccaaaagacagcttcctctattcagaatacataatacttaacgaactaaacaaagtccaagtgaatgatgagttcctcaatgaagaaaacaaacgcaagatcattgacgaactcttcaaagaaaataaaaaggtcagcgaaaagaaattcaaggaatacctactggttaaccaaatagccaatcgcaccgtggaactgaaaggcatcaaagactcattcaacagcaactacgtcagttacattaagttcaaagacattttcggtgagaagctgaatctcgacatctataaggaaatcagcgaaaagagtatcctctggaagtgcctgtacggggatgacaagaaaattttcgagaaaaagatcaaaaacgaatacggcgacatactgaacaaagacgaaataaagaaaatcaatagcttcaagttcaacacttggggacgcctgagcgagaaactactgaccgggatcgagttcataaacctcgaaacgggcgagtgctacagcagcgtcatggaagcgctgcgacgaacgaactacaacctcatggaactgctgtcctcaaagttcaccttacaagagagcatcgacaacggaaacaaagagatgaatgaggtctcttatcgagacctgatagaggaaagctacgtcagccccagccttaagcgagccatattacagacactcaagatctatgaagaaatcaaaaagatcacgggccgcgtgccaaagaaagtcttcatcgagatggcccgcgggggcgacgagacaatgaaaaacaagaaaatacccgcgcggcaagaacaattgaagaaactatacgactcctgcgggaacgacatcgcgaacttctccatcgacatcaagaaaatgaaaagcagcctaagtagctacgacaacaactctcttcgacaaaagaaactgtacctgtattatctccagttcggaaaatgcatgtacacaggacgggagatcgatctcgaccgcttgctccaaaacaacgacacctacgatatcgatcacatctacccgaggtcgaaagtcatcaaggacgactcatttgacaatctcgttctcgtcctcaaaaacgaaaatgcggaaaagagcaacgaataccccgtgaagaaagaaattcaagaaaagatgaagagtttctggcgcttcctcaaggagaagaactttatcagtgacgagaagtataaacgcctaacgggcaaggacgacttcgagctcagaggcttcatggcacggcagctagtgaatgtgcgtcaaaccaccaaggaagtcggcaaaatcctgcaacagattgagccagagatcaaaatcgtatactcaaaggccgagatcgcctccagcttcagggaaatgttcgacttcatcaaggtccgcgaactcaacgacacacaccacgcaaaagacgcatacctcaacatagtcgccggaaacgtttataataccaagtttaccgaaaagccctaccggtacctacaagagataaaggaaaactatgacgtcaaaaagatctataactacgacattaagaatgcctgggacaaagaaaatagccttgaaatagttaaaaagaacatgaagaaaaacacagtaaacatcactcgcttcataaaagaagagaagggacagctattcgacctaaatccaataaagaagggagagacatctaacgaaatcatcagtatcaaaccgaaattatacaacgggaaggaagaaaaactcaacgaaaagtacggttactacaaatcattaaacccagcctacttcttgtacgtagagcacaaagaaaagaacaaacgcataaaatcttttgaaagagtcaacctagtcgacgttaacaacatcaaagacgaaaagtcactcgtaaaataccttatagagaacaagaaattagtggaaccccgactcatcaagaaagtttataaaaggcaggtaatactcattaacgactacccgtatagcatcgttgccctagatagcaacaaactcatggacttcgaaaatctgaaacccctcttcctagagaacaaatatgagaaaatactgaaaaacgtgatcaagtttctagaggacaatcaagggaaaagcgaggaaaactacaaatttatctacctaaagaagaaggacaggtacgagaaaaatgaaaccctagaaagtgtaaaggaccgctacaacctagaatttaacgaaatgtatgacaaatttctagaaaaactagactcaaaagattacaaaaactacatcaacaacaagaaatacaaaaacctactcgacgtaaaagagaaattcatcaaactgaatctcttcgacaaggcctttaccctcaagtcattcctcgacctgttcaaccggaaaacaatggccgatttctcaaaggtcggacttacgaaatatctcggcaaaatccaaaagatcagctcgaacgtactcagcaagaacgagctatacttactggaggaatctgtcaccgggctgttcgtcaagaaaataaaactttga

SEQ ID NO: 6577 - RNA, 4104 nt, synthetic construct
  misc_feature 1..4104: note = Cas9 variant
  source 1..4104: mol_type = other RNA
atgaaaaagcaacaattctcggactactacctgggattcgacatcggcaccaatagcgtaggctggtgcgtcacagacttcaactataacgtcctccggttcaacaagaaggacatgtgggggtcccgattgttcgacgaagccaagacggcagccgaacggcgggtccaaaggaacagccgcagacgactcaagcgccgaaagtggcgactcaacctcctcgaggaaatctttagcgacgaaatcctcaagatagacagtaacttcttccggcggctaaaagaatcgagcctatggctagaagataaaagctcaaaagaaaagttcacactcttcaacgacgacaactacaaggactacgacttctacaagcaataccccacgatattccacttacgcaacgaactaatcaaaaacccagaaaagaaagacatccgcctggtatatctcgcactgcactcaatattcaagtcgcgcggccactttctttttgaaggccaaaacctgaaggacattaaaaactttgaaacgctgtataacaacctcatggccttcctcgaagataacgacatatacaagaacatagacagttcatacataggtaatctagaaaacatcatctgcgacagtaagaaagggctcaaggataaggagaaggagttcaaggaaatattcaatagcgacaaacaactcgtaggcttcttcaagctcagcgtgggctcatcagtaagtctgaacgatcttttcgataccgacgaatacaagaagggagaagttgaaaaagagaaaatatcattccgtgaacaaatttacgaagacgacaagcccatctactactcaatcttaggggaaaagatcgagttcctagacatagccaaatctttctacgacttcatggtactcaacaacatactagcggattcccaatacatctcggaagccaaagtgaaactgtacgacgagcacaaaagggacctcaaaaacctgaagtacataatccgaaaatacaacaaagaaaactacgacaaactattcaaggacaaaaatgaaagtaactatagcgcatacatcgggctcaacaaggaaaaagggaagaaagaagtcatagagaaatctcgccttaaaatcgacgactttgcgaaaatcatcaaagggtacttgcccaaagcggagaagatcgacgaaaaggataggagcatctttaacgagatactggacaagatcgagctcaagaccatcctcccgaaacaacgaatatcggacaacgggacactcccctatcagatacacgaggcggagctggagaaaatcctcgaaaaccaagcgaagtattacgacttcctaaaccacgaagaaaacggcatctccaccaaggacaaactccttatgacgtttaagttcagaataccctactatgtgggcccattgaacagctaccacaaaaacaaaggtggaaatagctggatcgtgcgcaaggaggagggtaagatcctcccatggaacttcgaacaaaaagtagacatcgagaaaagcgccgaagagttcataaaaaggatgaccaacaaatgcacctatctaaacggcgaagacgtcattcccaaggatagctttctctactccgaatacatcatactaaatgaactgaacaaagtgcaagtaaacgacgagttcctaaacaaggaaattaaaaagaaaatcatcgaagacctcttcaagaaaagcaagaaaatcagcgagaaaaacttccgcgaatacctgctagtcaatcagatcacgaataaaaccgtggaactaaagggcgtgaaagacgctttcaactcaaactacgtatcctatatcaagttcaaagacatattcggcgacaagctgaatctcgacatctacaaagagatctcagaaaaatccatactgtggaagtgcctctacggcgacgacaaaaagatcttcgaaaagaaaatcaagagcgtctacggagacatactcaccaaagacgaaatcaagaaaatcaactcctttaaattcaacacgtggggccgcctcagcgagaaacttctaaccgaaatcgagttcatcgacttagaaacgggcgagtgctacagcagtgtaatggacgccctgcggagaaccaattataaccttatggaactactctcctcgaaattcaccctccaggagaacatagacaacgaaaacaaagaggtctccgagttcagttacagagacctcgtcgaagagtcctacgtctccccctccctaaagcgagcgatccttcaaaccctaaagatttacgaggaaatacgaaaaatcacaggacgcatccccaagaaggtattcatcgaaatggcacgcggaggtgacgagaccatgaagaacaaaaagatccccgcacgccaggaacagctaaagaaactatatgacagctgcgggaaagacatcagcaacttctcaatagacataaaagaaatgaagaactcattaaacagctacgataataatagtctccgccagaagaaactgtatctatactatctccaattcggaaaatgtatgtacacaggaaaagaaatcgatctcaaccgcctactccagaacaacgacacgtacgatatcgaccacatctatccccgcagcaaggtaataaaagacgacagcttcgacaacctggtattggtccttaaaaatgaaaacgccgaaaagagcaacgaatacccgcttaagaaagagatccaagagaaaatgaaatctttctggaaattcttaaaagagaaaaacttcatatcagacgaaaaatacaagcgacttaccggaaaggacgagttcgaactgcgaggcttcatggcccggcagctggtgaacgtgcggcagacgaccaaagaagccgggaagatcctccaacaaatcgaaccagagatcaagatcgtatattcgaaggccgaaatcgcgagcagctttcgcgagatgttcgacttcataaaagtgcgcgaactcaatgacacccatcacgccaaagacgcatacctgaacatcgtggcgggaaacgtatacaataccaagtttaccgaaaagccataccggtacctccaagaaataaaggaaaactatgacgtgaagaaaatatacaactatgacatcaaaaacgcctgggacaaagagaaaagcctcgaaatagtaaagaaaaacatggagaaaaataccgttaacataacccgcttcataaaggaagaaaagggacaactctttgatctcaaccccatacgaaaaggagagacgtcgaacgaaataattgcaataaagcccaagttctacgaaggatcaacagaaaaactcaacgaaaaatacgggtactacaaatcgctcaaccccgcgtacttcatatacgtagaacacaaagagaaaaataaaataatacgcagcttcgaacgcgttaacctcgtcgacgtcaataaaatcaaggatgagaaatcacttattaagtacctaatagagaacaaaggactgatcgaaccgaaagtcataaagaaagtctacaaacgtcaggtcatccttataaacaacttcccctactctattgtcgccctcgactccaacaaacttatggacttcgaaaacctgaaaccactgttcctggaaagaaaatacgagaaaatcctaaagaacgcgatcaagttcctcgaagacaaccaggggaagacggaagaatactacaaattcctttatctcaaaaagaaagaccgcaacgagaaaaacgaaactatcgactcggttaaggaaagatacaatatcgagttcaatgaaatgtacgacaaattcctcgaaaaactcgactctaaagactacaagaactacatcaacaacaagaagtacagcgagctcgtaaacgttaaagaaaaattcatcaaactaaacctcttcgacaaagcattcaccctcaagtctttcctcgacctttttaacaggaagacaatggccgacttctcaaaggtcgggttgacaaaatacctcggaaaaattcagaaaatctcgtcgaatgttttatcgaaaaacgaattgcacctcttagaagaaagcgtgacagggctattcgtaaagaagataaaactctga

SEQ ID NO: 6578 - RNA, 4104 nt, synthetic construct
  misc_feature 1..4104: note = Cas9 variant
  source 1..4104: mol_type = other RNA
atgaaagactactaccttggactcgacatgggatcctcctccgtgggctgggccctctccgacgaacgatacaacttactgcgcgcaaaagggaaagacctctggggcgtacgcctcttcgacgaagccaagactgcggcggagcgacggaccttccggtcacaacgacgtaggcttgaacgaagcaaatggcgactgtccctactgacaagtctcttcgaagaagaaatcagcaagatagacgataagttcttcgacaggcttaaagatagcaagttctttattgatgacaagtccgaccagcaaccgaacaccctcttcaacgacgttaacttcacggacaaagaataccacaagcgatacccatccatctaccaccttcgcaatgcactcttcaaccaaaacgacaagttcgatatcagactgatattcctcgccctctcacacatcgtaaagaaacggggccacttccttttcgacggggataaagcaggatttggagaagacatagacgtaattctcgacgagctaaaagcctacctgcaagatgcatttcataccaagctcgagttcacttccgagttcaagagcattatgctagacaaaaacctacgcaaaaagcaaaaggaagaagaactgaaaaactcgattaaaatctccagcgacaccatcaacagcaaggacggcaagtccatcctaataaaacttttcctaggctacgaggccaacctgaagccgttcttcctcgagtacaaggtcgaaaaggacaacgaatacaagataaatttcagcaaggaagactacgaagaaaagctcctcgacatgacatccaaattcgaagaaacgacatacttcattgagatagcaaagaagatacacgattacttcctcctcgaagaaataatgctgggcttcaagaacatatccgcctccaaagtctccatctaccagaaacacaaaaacgacctgaaaaccctcaagaacattgtaaagaaccaaatcaacaactcatacaacgcaatcttcaaggatattgggctcgacaattacccggcctacgtctcatgctggaactcaaagaaacataaggaaaagcaaaagggctgcacaaaagataaattctacgccttcctgaaaaccaaactcaaaaatataaacaacgccaaggaaatcctagactccatcgacaacgacgacttcctgccccgtctcgtcgacaaaaactccataatcccccaccagatacacctggcagaactgatcaagatcatcgacaaccagtcccaatactatcctttcctgaaggagatcaaggacaaaatcatatccatcttcaaattccgaatccctttctatgtgggccccctaaataacttccacaaggacaaaggcggcaacgcgtggatagaaaagctgaaagacgagaggatattcccctggaacttcaacgacgtagtggacctcaataagagtgctgccaacttcatagaaaagatgataaatgaatgcagctacctaaaaggcgaaaaagtcctagctaaaaactcactcctttacacgaaatactcagtcctaaacctcatcaacaaacttaaaatcaacgggaccgcagtctccgtcgagaccaaacagaaaatctataacgaactactcctcaaacagaaaaacatcaagaaaaccgcgataaagaaattcctcataaacaacagcattatagacaaaaacgacgaaatcagcggtatcgacgactccctgacctcgaacctcgcagtgttcatcgacttcgagaaaatctcgaaccgtctacgctacgaccaaaaagaagacatcatcaaaagtatcagcttattcggatacgacaacgccatgctgaaaaagcaaataatcacaattgcgccagacctaagcgaagacgaactagaaaaactctccaagctacgctactccggcttcggccggctctcaaagcgactcctcacctccataaagcataacggaaaatcaatcatcgagatgttatgggacacaaatgacaacctgatggaactcctatcggaccgctacacattcatcgaacaaataaacaaacataacgacggattcaaagaggacataaatctcaacttccaaaacgttgacacgctttacgtaagcccctcggttaaacggcaaatctggcaggccttcaaggttatcaacgagctaataagtgtcatgggccgcgagccaaagaaaatttttgtggaaatggcacgagaggaaggcgaaaagaaacgcacccaagcacggaaagacaaggtgctcgaactctacaaatctatcaagaacaatgaaatttccaccttcctaacaaacttcaaagacatcaaaaccaaacttgaaggagagagcaacctaaattccaaaaagctgtacctttactatctccaactaggggtcgacatatacaccggagagaagatccccttcgagaagctatttgaccaaaacatatatgacatagatcatgtcataccccgcagtctcaagaaagacgattcgtttgacaatctagtgctcacaagcaaaacaaataacgccaagaaaacagacgagttccccgtgtcctcagaaatacaatcgaaaatgcaaacgttctggaaagtactgaaagacaaagaccttatgtcggagataaaatacaccaacctcaccaggaagacccacctatcagacgacgaactaggggactttatcgcacgacaactcgttgaaacgcgacaatcgaccaaggccctcacccaaatcctgaagaacgtatacgccaactcggacatcgtatacgtcaaggcaggcatcgtgtccgagttccgccagcaattcgatatgctgaaaatcagagaactcaacgacttccaccacgcaaacgacgcctacctaaacatcgtcatcggaaatgtatacaacatcaaattcaccaaaaacccacgaaactacgttaaagaatactacaagaaaggcgagcactacaacctcaaaatcgagaaaatgctagagaaagatatcgcacgcggagggaacttcggatgggacaagaaacactccatagagacagtgcaaaagacgatgaaaaagcaaagccctctgatcacctaccggaccttcgagaataaaggtgagttcttcaaccaacaaccgtccaaggcgtccgcaaatctcctagctctcaaatcatcggacaagcgtctactggacaccgtccggtacggcgggtacaagggaacccaatacgctcacatgttcctagtcgaacacttcaacggaaagatcataaaagagatcatgggcgtccccatctacctcagcaaagaaatcaaggacgataaggccaaactgctagaatactgtaacgacgtactcaaacttaaaaaccctaagatcctcttctcgaagataccctacaactctctgatcgtctacaacggctaccccatacttctccgaggattaaccggcgtacggggagctgcacaactgaagctcgaccaaacgtcaacgcaagtggtcaagaacattgtcaaactttacgactggctctcccaaaaacaaaaagagctctctgacctctcaaagaagatagagttcttccaggaaaataacaagaaagacgaagttaaagccgcaatgctcgaagcagataacatactattcatcttaaacgaccgatttaaaaacacaaagatcggaaaggatatcatgaacgacaaccacttaaacaacctatacgacactttcatcaacaagctggaaaactcaatctataagaacaaaccaggcgggaagcaggatgtcctcatgaaagaaaaacgagacctcttcctatccttcagcatgagtaagaaatgcataaccctgtacaaaatcatcaaaatattcgggtcctgtgaccagggcgtagatttcagcgatatcgccgagaaaatatccaaatctggaggaataggaggcaaaaacctaggcaaaaacaccttcgacctagttttcaaagaaaactccacatacaccctggttcagtcgtcagtcaccggcctttacgctaagaaaaccgacctacacaaactctga

SEQ ID NO: 6579 - RNA, 4104 nt, synthetic construct
  misc_feature 1..4104: note = Cas9 variant
  source 1..4104: mol_type = other RNA
atgaaaaagcaaaagttctcagactattaccttggtttcgatataggcaccaacagcgtcggatggtgtgtcacggacctagattacaatgtgctgaggttcaacaagaaagacatgtggggcagccgtctcttcgaagaagcgaaaacagccgccgagcgcagggtgcaacgcaacagcaggagacggctaaaaaggagaaaatggcgcctaaatctcctggaggaaatcttcagcaacgaaatcctgaaaatagactcgaactttttccggcggctcaaggaaagctcgctctggctcgaggacaagtcgagcaaggaaaagttcacgctgttcaatgacgacaactataaagattacgacttctacaaacagtacccgacaatcttccatttaagaaacgaactgattaagaaccccgaaaagaaagacatccggctcgtgtacctcgcgatacattcaatattcaaatcacgcgggcacttcttgttcgaaggccagaacctcaaggaaatcaagaacttcgagacactctataacaacctcatcgccttcctggaagacaacggcataaataagataatcgacaaaaacaacatcgaaaaactagaaaagatcgtatgcgactcaaagaaagggctcaaagacaaagaaaaagagttcaaagagatcttcaacagcgacaaacaactggttgcgatcttcaagttgtcagtgggctcaagcgtaagtctgaacgatctgtttgatacagacgaatacaagaaaggtgaagtagagaaagaaaagatctcattcagggagcagatctatgaagacgacaaaccgatatactattccatcctgggcgagaaaatcgaactgctagacatagcgaaaacattctacgacttcatggtcctaaacaacatcctcgccgacagccagtatataagtgaggcaaaggtcaaactatatgaggaacacaagaaggacctgaagaacctcaagtacataatacggaaatacaataaagggaactacgacaaactcttcaaagataaaaacgaaaacaactatagcgcttacataggcctcaacaaagaaaagtcaaagaaagaggtcatagaaaagtcgaggcttaaaatcgacgacctcatcaagaacatcaaggggtacctaccaaaagtggaagaaatcgaagaaaaggacaaggctatatttaacaaaatcctcaacaagatagagctaaaaaccatcctcccgaaacagcgcatctcggacaacggcacacttccgtaccagatccacgaagccgaactcgagaaaatcctggaaaaccagtccaaatattacgacttcctgaactacgaagagaacggtataattaccaaggacaagctactcatgaccttcaaattcaggatcccttactacgtcggacccctaaattcctaccataaagacaagggaggcaactcatggatagtccgcaaagaggaaggcaaaatcctaccatggaacttcgaacaaaaagtagatatcgagaaatccgcggaggagttcataaaacggatgacgaacaagtgtacctacttaaacggtgaggacgtgatccccaaagacacgttcctctactcagaatacgtaatcttaaacgagctcaataaagtccaggtcaacgacgagttcctcaacgaagaaaacaaacggaaaataatagacgaactcttcaaggagaacaagaaagtctccgaaaagaaattcaaagagtacctactcgtcaagcaaatagtagacggcaccatagagctcaaaggcgtcaaagacagcttcaactccaactatatctcgtacatccgcttcaaagacatattcggcgagaaactcaacctggacatctacaaggagatcagcgagaaatccattctctggaaatgcctctacggagacgacaagaaaatcttcgagaagaaaatcaaaaacgagtatggggacatcctgaccaaagacgagatcaagaaaatcaacactttcaaatttaacaactgggggcgcctatcagagaagctgcttaccggaatcgagttcatcaatttggaaactggcgaatgctactcatcagtcatggacgcgcttcgacggacgaattataacctaatggagctcctctcttccaagttcaccctccaagaaagcatcaacaatgaaaacaaagagatgaacgaagcctcatatagagacctcatcgaagaaagttacgtcagcccatcactcaaacgagcaatcttccaaaccctgaaaatctacgaagaaatccggaaaattacgggccgcgtaccaaagaaggtcttcatcgaaatggcccggggcggcgacgaaagcatgaagaataagaaaatacccgcgcgacaagagcagcttaagaaactctacgactcctgcgggaacgacatagcgaacttcagcatcgacattaaagagatgaaaaactccttaatctcgtacgacaacaactccctgagacagaagaaactatacctctactaccttcaattcggcaaatgcatgtacaccggccgcgagatagaccttgacagactacttcaaaacaacgacacgtacgacatcgaccacatctacccgcgcagcaaagtcatcaaagacgactcatttgacaacctggtcctagtactcaaaaacgaaaatgcggaaaaatcaaacgaataccctgtaaagaaagaaatccaggagaaaatgaaatccttctggagatttctgaaagagaaaaacttcataagcgacgaaaaatacaaacgcctaacggggaaagacgacttcgaactgcgaggcttcatggcaagacaacttgtaaacgtccgccaaacgaccaaagaagtaggcaaaatcctccagcaaattgaaccagaaatcaaaatagtctacagcaaagccgaaatagcctcatcattcagagaaatgtttgacttcataaaggtaagggaactaaacgacactcaccatgcgaaggacgcatacttgaacatcgtagccggaaacgtttataacacgaagttcaccgaaaagccataccgttacctacaagaaattaaagaaaactacgacgtcaagaagatttacaactacgacatcaagaacgcgtgggacaaggagaactcgctagagattgtgaaaaagaacatggagaaaaacaccgtaaacatcacgcgtttcataaaagaaaagaaagggcagctattcgacctgaaccccataaagaaaggagagacttcaaatgaaataatatcaatcaaaccgaaagtctacaacggcaaagacgacaaactaaacgaaaaatacggctactacaagagcttaaacccggcatacttcctatatgtcgaacacaaagagaaaaataaacgaatcaagagctttgaaagagtcaacctagtagacgtcaacaatataaaagatgaaaagagcctcgtgaagtatctaatagaaaacaagaaactcgtggaaccgcgagtgattaagaaagtatacaaaaggcaagtaatcctaatcaacgactacccttactccatagtcacactggactcaaacaaattaatggacttcgaaaacctcaaaccactattcctggagaacaaatacgagaaaatactgaaaaacgtcatcaaatttctcgaagacaaccaaggcaagtccgaagagaactacaaattcatatacctcaaaaagaaggaccggtacgagaaaaacgaaaccctcgaatcggtaaaagacagatacaacctcgagttcaacgaaatgtacgacaagttcctagagaaacttgacagcaaggactacaaaaactacatgaacaacaaaaagtatcaggaactgttagacgtcaaggaaaagttcatcaagctgaacttgttcgacaaagcatttactctaaagtcattcctcgacctcttcaaccgcaaaacaatggctgactttagcaaggtggggctcacgaagtacctcggaaagatacagaaaatctcaagcaatgtgctgagtaaaaacgaactctacttgctcgaagaatccgtaacgggcctcttcgtcaaaaagataaaattgtga

SEQ ID NO: 6580 - RNA, 4104 nt, synthetic construct
  misc_feature 1..4104: note = Cas9 variant
  source 1..4104: mol_type = other RNA
atgaagaaacagaaattctccgactactacctcggattcgatatcggaaccaacagcgtcgggtggtgcgtaaccgacatgaattacaacgtcttgagattcaacaagaaagacatgtggggcagccgcctcttcgaagaagccaaaacagcagctgaacgacgcgtccagcgcaatagcagaaggcgcctcaaacgccgaaaatggcgtctaaacctcctagaggagatcttttcaaacgaaatcctgaagattgacagcaactttttcaggcgcttgaaagagagctccctctggctggaagacaagtcctcgaaggaaaaattcacgctattcaacgacgataactacaaagactacgacttctacaagcaataccctaccatcttccacctccgaaacgaattaatcaagaatcccgaaaagaaagacatccgcttggtgtacctcgcaatccacagcatattcaaaagcaggggacacttcttgttcgaggggcagaacctcaaagagatcaagaacttcgaaacactatacaacaaccttatcgcattcctcgaagacaacggtataaacaagagtatcgacaaagacaatctggaaaagctagagaaaatcgtgtgcgactctggcaaggggctgaaggacaaggagaaggaatttaaggaaatcttcaactcagacaagcaactcgttgcaatattcaaactctccgtgggcttatccgtaagcctcaacgacctcttcgacacagatgagtacaaaaagggcgaagtagaaaaagagaaaatatcattccgagagcaaatctacgaagacgataaacctatctactactccatactcggcgaaaagatagaacttctggacatagctaaatccttctatgactttatggtactaaacaatatactcgcggacagccaatacataagtgaggcgaaggtaaagctgtatgaggagcacaaacgagacctcaagaacctgaagtacatcatccggaaatacaaccgcgaaaactacgataaactcttcaaagacaagaatgaaagcaactacccagcttatatcgggctcaacaaggaaaagagcaagaaagaggtaatcgaaaagtccaagctgaagatagacgacctaataaaatccatcaagggatacctaccgaaagtagaggaaatcgaagaaaaagacaaggcgattttcaacgaaattctcaataaaatcgagctcaagatcatcctccccaagcagagaatatcagacaatggaaccctaccataccaaatacacgaagcggagctagagaaaattctggaaaaccagtccaagtattacgactttctgaattacgaagagaacgggatcataacaaaggacaaactcctgatgaccttcaaattccgcatcccctattacgtaggcccactgaacagctaccataaagacaaagggggcaactcatggattgtccgcaaagaagaagggaaaatactaccatggaacttcgaacaaaaagtagacatcgagaaatccgcggaggagttcatcaagcgcatgaccaataagtgcacctacctaaatggcgaggacgtcattccgaaagattccttcctatactctgagtatataatactgaacgagctgaacaaagtccaagtgaacgacgagttcctcaacgaagagaacaaaaggaagatcatcgaggaactcttcaaaggaaataagaaagtaagcgaaaagaaattcaaagagtacctccttgtcaaccagatcacgaccggaacaatcgaactaaaaggcatcaaagactcgttcaactcaaactacatcagctacatcaaattcaaggacatattcggtgaaaagctcaacctagacatatacaaagagatcagcgagaaatccatcctatggaaatgcctctatggagacgataagaaaatattcgaaaagaaaattaaaaacgaatacggtgacatactcaccaaagacgagataaagaaaataaacacgttcaaattcaacaactggggaagactgtcagaaaaactcctgaccggaattgagttcataaatctagaaaccggcgaatgctacagcagcgtgatggaggccctccgccgcaccaactataacctcatggagctcctgtccagcaaatttaccctgcaagaaaacatcgataatgagaataaagacatatcccaattttcataccgtgatctagttgaggaatcctacgtctcgccaagcctgaagcgggcaatcctccaaacactgaaaatctacgaggaaatcaagaaaataacgggtcgcgtccccaagaaagtcttcatcgagatggcgagagggggagacgaatcgatgaaaaacaagaaaataccggcacgacaagaacagctcaagaaactgtacgactcatgcggcaacgacatagccaactttagtatagacatcaaagaaatgaaaagctcgttgagcctgtatgacaacaactcccttcgccaaaagaaactgtatctctactacctacaattcggaaaatgcatgtacaccggacgagaaatcgaccttgaccgtctcctacaaaacaatgacacttacgacatcgaccacatatacccccgaagcaaagtcatcaaggatgacagcttcgacaacctagtactcgtgctaaagaacgagaacgcggagaaatcaaacgaatacccagtcaagaaggaaattcaagaaaagatgaaatccttctggcggttcctgaaagagaaaaatttcatcagcgacgagaaatataaaaggctaacgggaaaagacgacttcgagctgcgagggttcatggcccgacagctagtaaacgtcagacaaaccaccaaggaagtaggcaaaatcctgcaacagatcgaacccgagatcaaaatcgtttactccaaggccgaaatcgcatcgagcttccgcgagatgtttgacttcatcaaggtacgcgaactgaacgacacgcaccacgccaaagacgcatatctaaacatagttgccgggaacgtatacaacaccaaattcaccgagaaaccctaccgatatctacaagagatcaaggagaattacgacgtaaagaaaatctactcctatgacatcaagaatgcctgggacaaagagaactccctcgaaatagtcaagaaaaatatggagaaaaacacggtcaacatcacgcgcttcatcaaagaagagaaaggtcaactgtttgacctcaaccctatcaagaaaggcgagacaagcaacgaaatcatttctataaaaccaaaagtctataacggaaaagacgacaaattaaatgagaagtacggctactacaagtccctcaaccccgcctacttcttgtacgtcgaacataaagagaaaaataaaagaatcaaatcgtttgagcgagtaaacctagtcgacgttaacaacattaaagacgaaaaatcacttataaaatacctagtcgagaataaaaagctggtcgagccccgagtcatcaagaaggtctacaagcgacaggtcatcctaataaacgactacccatacagcatcgtcgccctagacagcaacaaacttatggacttcgaaaacctcaagccacttttcctcgaacgcaagtacgagaaaatcctgaagaacgtcatcaaattcctcgaagacaaccagggcaaaagcgaagaaaactacaagttcatctacctcaaaaagaaagatcggtacgagaaaaacgaaacgctagaaagcgtaagagaacggtacaacatagagttcaacgaaatgtacgacaaattcctagaaaaactaaatagtaaggactacaaaaattacatcaacaacaaaaagtaccaggacctactcgacgtcaaggaaaaattcatcaaattaaatctcttcgacaaagccttcaccctcaaatcttttctagacctctttaacagaaagactatggcagatttcagcaaagtcggactgaccaaatacctcggaaaaatccagaagataagcagcaacgtcctatccaagaacgaactctacctactagaagagagcgtaactggactgttcgtcaagaaaattgagctgtga

SEQ ID NO: 6581 - RNA, 4104 nt, synthetic construct
  misc_feature 1..4104: note = Cas9 variant
  source 1..4104: mol_type = other RNA
atggtcaaaaagaagtatgcgattggtatcgatatcggcacgaactcggtgggttggtcggtggtgaccgacgactacaaagtaccctcgaagaagatgaaagtcttcggcaacacggaaaaacgatacatcaagaaaaacctcctcggcaccctattgttcgacgaaggcaacaccgcggagaaccgccgactcaaacgtacagcccggcgtagatacacacgacgccggaaccgtatcctgtacttacaggaaatcttcgccgaggagataaacaaaatcgacgacagcttcttccagcgcctcgacgacagcttcttaatcgtcgaggacaaacaaggaagtaaacacccaatatttggcacgctgcaagaagaaaaagagtaccacaagcaattccccactatctaccacctacggaaacaactagccgacagcagccaaaaagccgacattcggttgatatacctcgcgctcgcacacataataaaatatagggggcacttccttttcgagggcgacctcaagtcggaaaacaaagacgtacaacacctattcaacgacttcgtcgaaatgttcgacaagacggtggagggaagttacctcagcgagaatctaccaaatgtcgcagacgttctagtagaaaaggtatccaaaagtcgacgcctcgagaacatcctccactacttcccaaacgaaaagaaaaatggactattcggcaacttcctgacactcgccctcggactccaacccaactttaaaaccaactttgaacttgccgaagacgcaaaaatacagttctcaaaagagacttacgaggaggacctcgaagaactactagggaagatcggcgacgactacgccgacttattcatcgcaacaaagagcctatacgacggcatcctcctggccggcatcttatctaccacggattctacgacgaaggctcccctctcttcctccatggtcaatcgctacgaagaacaccaaaaagacctggcccttctgaagaacttcatacatcaaaatctgtcagattcctacaaagaagtattcaacgacaagctcaaagacggatacgccggatacatcgaagggaagacgacacaggaaaacttctatcgcttcataaagaaagccatcgagaaaattgagggaagcaactactttatcgacaaaattgatcgagaagacttcctccgcaagcaacgcaccttcgacaacggaagtataccccaccaaatccatctccaagagatgcacgccatcatccgtcgccaggcagagttctacccattcctggtcgaaaaccaagacaagatagagaaaatcctcacattccgaatcccgtactacgtaggacccctagcaagaggtaaatccgagttcgcatggttgaaccgcaaaagcgacgaaaagataagaccatggaacttcgacgaaatggtagacaaagagacttccgccgagaactttatcacacgaatgaccaactatgaccagtacctccccgaccagaaggtccttcccaaacactcactcctatacgagaagttcgccgtgtacaacgaactaaccaaagtacgatacgtcacagaacaaggcaaatcctttttcttcgacgcgaatatgaagcaggagatattcgacggagtattcaaagtttatcgcaaggtgaccaaggaaaagctaatggacttcttgggcaaggagttcgacgaatttcgaatagtcgacctcctaggcctggacaaagacaacaaatccttcaacgcatcactcggaacataccatgatttaaagaaaattgtcagtaaagacctcctcgacaacccggaaaacgaagacatactagaaaacgtggtactaacgctaacgctatttgaagaccgcgagatgataaggaaacgcctagagaaatacaaggatgtgctcacagaagaacaacgcaagaagctagagcggcgacactacacaggttggggcaggctctcagccaagctaattaacggcatacgcgacaaagtaacacgcaaaacaatactcgattacctaattgacgacggcacctccaaccgcaacttcatgcagctcataaacgacgacacccttagcttcgtggacgagatcaggcttgcacaaggctcgggagaagctgaagactaccgggcagaagtccaaaacctggccggatctccagccataaagaaaggcatcctgcaaagcctaaaaatcgtagacgagctgatcgaggttatgggatacgaccccgaacacatagtcgtagagatggccagagaaaaccagttcaccaaccaaggacgccgcaactcccaacaacgatacaagaaaatcgaaaatgcgatcaaaaacctggactcaaacctaaactccaaaatactcaaagaataccccactaataatcaagcactccaaaacgaccggctttttctgtactacctgcaaaacggcaaagacatgtacaccgacgaggaactcgacatagaccaactcagccagtatgacatcgaccacatcatcccccaagccttcattaaggatgactcactagacaataaagtcctgaccaagagcgccaagaaccgaggtaagtccgatgacgttccgtccctcgaaatagtacacaagaagaaaaacttttggaaacaactactagactcccagcttataagtcaaagaaaattcgacaaccttacgaaagccgagcgcggaggcctaacgaacgaggacaaggcccgttttatccaacggcaactcgtggagaccagacaaatcactaaacacgtcgcccgcatcctcgatacgcgcttcaacaccaaactcgacgaagccgggaacaggatcagagaccccaaagtcaacatcataaccctaaaatccaaccttgtctcccaattccggaaggattaccaactatataaggtacgcgagatcaacaactaccaccacgcacacgacgcgtacctaaacgcagtagtggcaaccgccctgctcaaaaagtacccccagctggcacccgagttcgtctacggagactacccaaaatacaactcatacaaatcaagaaaatccgccaccgaaaaagtccttttctactccaacataatgaacttcttccgaagagtcctagtatactcgaaaaccggcgaggtcagaatacggccagtaattgaggtcaacaaagaaaccggagaaatagtctgggacaagaagtccgacttcagaaccgtgcgcaaagtcttatcttacccccaagtgaatgtagtaaagaaggttgaaatgcagaccggaggattctcaaaagaaagtatactgcaacacggcgacagcgacaaactgatcccacgcaaaacagagaagttctacctagacaccaagaagtacggcggcttcgatagcccaaccatcgcctactctgtactccttatagccgacatcgagaaaggcaaagcgaagaaactaaaacgagtcaaagaactcataggaataacgatcatggagcgcatggcattcgagaaaaacccaatagagttcctagaacacaaaggttacaaaaacatacttgagaaaaacataatcaaactcccaaagtactccctattcgaactggaaaacggcaggcgccgactgttagcatccgcgaaagaactccaaaagggaaacgaaatgatcctgccaccccatctcgtcacgctcctctaccactcgtcaaacatacataaaatcacggagcctatccacctaaactacgtcaacaagaataagcacgagttcaaggaactcctgcgacacatctcggacttctccacccgctacatactagcccaagaccgcttgtcaaaaatcgaagaactgtacgacaaaaatgacggagacgacatttctgacctcacatcgagtttcgtcaacctgctgacatttactgccatcggagcccccgccgcattcaagttcctcggatcagttatagatcgtaagcgatacaccagcatagccgagatccttgaagctactctaatccaccaatcagtcaccggcctgtacgaaacgaggatagacctatcaaaactagggggcgactga

SEQ ID NO: 6582 - RNA, 4104 nt, synthetic construct
  misc_feature 1..4104: note = Cas9 variant
  source 1..4104: mol_type = other RNA
atggtcaagaagaaatacgccattggcatagacataggaaccaacagcgtgggatggagcgtcgtcacagacgactacaaagttccctcaaagaaaatgaaagtcttcggaaataccgaaaaacgctacataaagaaaaatctacttggaacactactattcgacgaaggcaacaccgccgaaaatcgacgcctcaaacgtaccgccaggcgccgttacaccagacgaagaaaccgaatcctttacctacaagaaatattcgcagaagaaatcaacaaaatcgatgactccttcttccaacgactcgatgactccttcctgatagtcgaggacaaacaagggtcaaagcatccaatattcggaaccctccaggaagagaaagagtaccacaagcaattccccaccatataccatctgcggaaacagctagcagacagcagccaaaaagctgacatccgcttaatctacctagcccttgcccacataataaaataccgaggccacttcctcttcgaaggagacctaaagagcgaaaacaaggacgtccagcaccttttcaacgacttcgttgagatgtttgataagaccgtggaaggatcctacctaagcgaaaaccttcccaacgtcgcggacgtccttgtcgaaaaggtaagcaagtcacgccgacttgagaacatactacattactttccaaacgaaaagaaaaacggactatttgggaactttctggcactcgcactaggcctccaacctaatttcaaaacaaattttgaactcgcagaagatgccaagatccagttctctaaggaaacgtatgaagaggacctcgaagaactactcgggaagatcggagacgattacgccgacctcttcattgccacaaagtcgctctacgacgggatacttctcgctggaatactcagcaccactgactcaaccacgaaggcaccactgtcgtcttcaatggtcaaccgctacgaagaacaccaaaaagacctcgccctcctgaaaaacttcatccaccaaaacctctccgactcttataaagaggtctttaacgataaactcaaagacggttacgccggttacatagaaggcaagacaactcaagaaaacttctaccgctttatcaaaaaggcgatcgagaaaatcgagggaagtaactacttcatcgacaagatcgaccgagaagacttcctgcgaaagcagcgcacattcgacaacggctcaatcccacaccaaatacacctccaagaaatgcacgcaatcatacgccgccaagcagaattttaccccttcctagtggagaaccaagacaagatagagaaaatccttacattccgcataccctactacgtcggaccccttgcccgtggaaaatccgagttcgcatggctgaatcgcaagtcagacgaaaagatcagaccttggaactttgacgaaatggtagacaaagaaacctcggccgaaaatttcatcacccggatgaccaactacgaccagtacctcccggaccagaaagtcctacctaaacactccctcctctacgaaaagttcgccgtttacaacgaactaaccaaagtcagatatgtaacagaacagggtaagtccttctttttcgacgcgaacatgaaacaagaaatatttgacggcgtattcaaagtataccgaaaagtaacgaaggaaaaactgatggatttcctcgggaaggagttcgacgagttcagaatcgtcgacctactagggcttgacaaagacaacaaatccttcaacgcaagcctaggcacctaccacgacttgaagaaaatcgtctctaaagacctcctcgacaacccagaaaacgaagacatactcgaaaacgtcgtcctaacgcttaccctcttcgaagaccgagaaatgatcaggaaacgcctcgagaaatacaaagatgtacttaccgaggaacaacgcaagaaattggaacgacgccactacacgggctggggacgcctaagcgcaaaactaatcaacggcatccgggataaagttacacgcaaaacaatcctggactacctgatcgacgacggaacctcaaatagaaacttcatgcaactaatcaacgatgacacgctcagcttcgtcgacgagatccgcctagcccaaggctccggcgaagcagaagactaccgggctgaagtgcaaaacctggcaggcagtcccgccattaagaaggggatactccaatccttaaaaatcgtagacgagcttatcgaagtaatgggttacgaccccgagcacatcgtagtggaaatggcccgcgaaaaccaattcacgaaccaaggtcgcagaaacagccaacaaaggtacaagaaaatcgaaaacgcgatcaaaaacctcgattccaacctgaactccaagatactaaaagaatatccaaccaacaaccaggccctacagaatgacagactcttcctttattaccttcagaacggcaaagacatgtacacagacgaggaactagacatagaccaactctcccaatacgacatagaccatataatcccccaggcatttattaaagacgactccctagacaacaaggttctcaccaaaagcgccaaaaaccggggtaaaagcgacgacgtccccagcctcgaaattgtgcacaaaaagaaaaatttctggaaacaactcctagactcgcaactcatatcccaacgcaagttcgacaacctcacaaaggccgaacgaggcgggctcaccaatgaagacaaagcccgattcatccaacgacagctggtcgagacccgccaaataacgaaacacgtcgcacgtatactagacacccgattcaacaccaaactcgacgaagccggtaacagaatacgcgaccctaaggtaaacatcataacactaaaaagtaacctcgtttcccaattccgaaaagactaccaactatataaagtacgcgagatcaacaactatcaccatgcgcacgacgcctacctcaatgcggtcgtcgccacggcactcctgaaaaagtatccacagctagcacccgagttcgtctacggggactatcctaaatacaacagctacaaaagccgcaaaagcgctacagaaaaggtactcttctactctaatatcatgaactttttccgccgcgtcctcgtgtattcaaaaacgggagaagtcagaattaggcccgtgatcgaagttaacaaagaaaccggagagatcgtctgggacaaaaagagcgacttccgcacggtccgtaaagtcctgtcctacccacaagtcaacgtggtgaaaaaggtcgaaatgcagacaggcggattcagcaaagaatcaatactccaacacggagatagcgataagctgatcccccgcaaaacagaaaaattctacctcgacacgaaaaagtacggtggtttcgacagcccaacaatcgcttacagcgtcctacttatagccgacatcgagaagggcaaagcaaagaaactcaagcgagtcaaagaactcatcggaatcacaatcatggagcgaatggccttcgagaaaaaccccatagagttcctggaacacaagggatacaaaaatatactcgagaaaaacatcataaagctcccaaaatactcccttttcgaactagaaaacggtcgcagacgactcctcgcatctgccaaagagctgcaaaaaggcaacgagatgatcctgcccccgcacctcgtcacacttctataccattcgtcgaatatacacaaaatcacagagccgatccaccttaactatgtaaacaagaataaacacgagttcaaagaactactcaggcacatatccgacttctcaacgaggtacatcctggcccaagaccggctatcaaaaatagaggagctctacgacaaaaacgacggcgacgacatctcggacttgacttccagctttgtaaacctcctaacgttcaccgcgataggcgcccccgctgcattcaagttcttgggatctgtcattgatcgcaagagatataccagcatcgccgagatactagaagccacgctcatccaccaatcagtcaccgggctttacgaaacgcgaatagacctatcaaaactcggcggcgactga

SEQ ID NO: 6583 - RNA, 4107 nt, synthetic construct
  misc_feature 1..4107: note = Cas9 variant
  source 1..4107: mol_type = other RNA
atggacaaaaagtactccatcggacttgacatcggaaccagctccataggcttcgtgggtgtcgacgaaaacggttggcccctcaacataaaaggaaaacgagcaatcggagcccacctcttcagagaaggcgaggcagctgctgagactcggggtttccgtacaacccgtaggcgttacaaccgccgaaaatggaggcttagactactccgcgagatcttcgatgaacccatatcccgtgtagaccccaccttcttcgcgcgaatgaaagaaagctccgtatccccaaaggacccaaactacgacggcctggccaaggaaatactcatcccccgagacaaagacggcaagatcctataccccacaatataccacctaagacacgcgcttatgtacgaagaccaccagttcgacattagagagatatacctagcaatacaccacatagtcaagtaccgcggtcactttctactcgacggcgcggccaaaaacttcgaatcctccaaccttgacctgaaatcagacatacacgaaatcaacgccatcctggtcggtatatttggaaacgaacaggtacaattcaacgatcagtacgtagaaaaactcaaagaagtcctactagacagcacccagtcacggagcgacaggcagaaagcagccgcaaaagtcctactaccaaccaatgaccttgacaaagacaccacaaaaatcctaaaaacagtatccacagaaataactaaagccatcacgggtttaaaagccaaattcttcgtcatcaccggcaacgatattgccaaagaccagcaaaaagactggacgttctctatagacactctagacgaaaagatgtccgtcatagagccctctttctcagaaaagaatttcagcctcattaccatcttgcaaaagctatattcctcagtcaccttagccggaatcgtcccaaacggtttatcgctctcggaggccatgatccaaaaatatgaccgccacgcctcagacttagtcctcctcaagaaatactgggatacaaaacccaaagttctgaaacaccaactacaaaatacctacgccgaatacatcgaaatccaccaggtagtcgacgagttctactcagacctcagtaagctaatcaaaaacgacgacgacaccctcgcccaagaaataaaatccaagatcaccataggcaacttcctgcccaaacagcgcacaaccgaaaacggcgtcatcccttatcagctacaacaacgcgaactcgacaccatcatcaaaaatcaacaagagtattatccatggctagcggaggaaaaccccgtggcagaccaccaaatagccttcccatacaagctcgacgaacttgtcggcttcagaataccgtactacgtagggcccatgatagccaaagaagatacaagtaacagcaagaactccaaattcgcttggatgatccgaaaacagtccggggaagtgaccccctggaacttcgacgaaaagatagaccggaccgcctccgcgaccgcgttcatcgatagaatgaccaccacagatacctacctaataggtgaagacgtcctaccaaaacaaagcctgatctaccaacgattcgaagtgctcaacgaactgaacaaaatctccatagatggccaacccataacgcggaaacaaaaacagagcgtgtacacccacgtattcgaaaagaaaaagacggtccaggtaaaggacgtccaaaaattcctcgtctcaagtggagaagtgatgagcctacccaagataggcggcctggcgaacgaaaaacaattcaacagttccctaagcaccctttacgactacaacaaaatcattccagacgcactagaagaccggaacaaggtcgatgacattgaaaagatcatcctatggtctactattttcgaggacaacagcatttttgtcgagaaactagactcaatcgactggctaacctcctcccaacggaaacgcctagcacagaagcgctacaggggatggggacgactatcactgcggctactcacaaccttcaaaaataaggacggctattccatcctcgacgaactctggaactccaaccataatttcatggaaatccaagcacagtccgacttcagcgaacaaatcgccacggcaaacaacaacaacctgagccaagtgctccccgcaaaatgggagcccggccgcaaaaacctcgcatcccttgatgagttcatctctaacctttacaccagcccccaaaataagaaagcccttcgcaaagcgatccgggtcgtccaagacatgatgaccgcagcaggccacatgcccgagaaaattttcattgaagtcgctcgagacacctccaactcacaccaacaaaccatcgcacgacaacgacagcttcaacaactctaccaatccgaagcaaaggaagtaatcgacagctcagtgcgatcggaactagacgatatcctcaaaaaccgagccaacatcaaagaccaactattcctatacttccaacaaggaggccgagacctatacacgggcaaggccataaacatcgataaactgtccctgtaccacatagaccacatactaccacaatccctagtaaaggacgacagcctagacaaccgtgtacttgtctcccagaaaaccaacgaagacaaaggggtcacctttgtatccgacaaatacatgaacaacatgctaccaacctggaagcggtggcacgaaatgggtctcatctccgcaaggaagctaaagaacctcacaatgcgccccgacgagatagacaagtacgccccgggattcatacaacgccaactcgtagaaacacgacaagtgacaaaactcgtgattgaactactagacgcactcctaggcaactcacaaacagaaataatcacgatcaaggcaagtctctcccaccaattccgacaacagtttgacctggtaaaaattcgagaggttaacgacaaccatcacgcattcgacgcattcctcgcggcaagaatcggcacgtacctctacaagcggtaccccaagctaaggccctactttgtatacggtcaatatatgcagaaccacaaaaacctcaagtctataaacctaatcaaaacgctagattccgacaaagccatcgtagacgaaggcaccggtgaaatcctatgggacaagaaatccgaccttgcgaaaatgatcaaaatatacaattaccaacgactacttataacccacgagtctagaacatcgttcggcgcgatgtacaagcagaagatcctaaaagcgaccgacgcgaaacaaaacggcgggggtttcaagctagtccccaccaagcggaactggccagtagacatatacggcgggtacacaggccaaaccgcagcctacctcaccatagtccgggtctactcaaagaaaacctcagaactccgcgtcctacccatctataccaacaaagtccaacaaatagaaaaagcaatgacccagggcgacaaagccactatgctagccttcaagaaagtaatcgcaccccaactcggcaaagaaaacaaaaagacccacgagattaaaatacccgagttcgacgtagtaatccccaaagtacttctggaccagctcgttatcgacgacatcgctggctcacctcatcgcttccgactcgggactgatacctactaccacaactcccagcaactcttcctgcctctatcaatgcagcggcaactcatggaccgtgaatccgacgacaaagtctacctggacatcttcaatgacgtcttgaagcaggtagactcgtacttcaatctgtacgacgtcaacggcttccgcgcagccctacaaaagagtaagaaagcgtttgaacaactcccgatcaatgattttcccaaagacgtgcccgacaacaaaaagaagaaaggaaaacgcagtatactaaaagaaatctttataggcttgcacgccaacgccaccctaggtaacctcaaacaaatgggaataaaaacagacttcggcaaacttcagaaaagtaacggcctccgaatcaccgagaactgtaaaattatccatcagtcccctacgggactcttcgagagaatcgtaccaataaaatga

SEQ ID NO: 6584 - RNA, 4107 nt, synthetic construct
  misc_feature 1..4107: note = Cas9 variant
  source 1..4107: mol_type = other RNA
atgtcccgaccctacaacattggactggacattggcaccagctccatcggatggagcgtcgtcgacgaccaatccaaacttgtgagcgtacgcggcaagtacggatatggggtacggttatacgacgaaggacagaccgccgcagagcgccgttccttccgaaccacccgtcgaagactcaaaaggcgaaaatggcgcttaggccttctccgcgaaatattcgaaccctacattacgcccgtagacgataccttctttttacgacaaaaacaatccaacttatccccaaaagaccaacgaaaactgtacccccaaacttccctcttcaacgaccgaacggaccgagccttctatgacgactaccccacaatctaccaccttcgatacaaactaatgacagaaaaacggcaatttgacataagagaaatctacctcgccatgcatcacatcgtcaaatataggggccatttcctcaacgaagccccagtcagctccttcaaaagttccgaaatcaatcttgtagcccacttcgaccgcctaaacacaatattcgcggacctcttctcagagtcggggttccaactagaaactgacaaactagcagaggtcaaagcactgctcttagacaaccagcagtcagcctctaaccggcagcgccaggctctctcactgatctacacaccaagcacgaacaaagccgtagaaaaacaaaacaaagccatagcaacggagctgctgaaagccatactaggactgaaagcgaaattcaacgtcctaacaggaatcgaggcggaagacgtcaaagcatggactctcaccttcaacgcggagaactttgacgaggaaatggtcaaattagagtcgagcctagacgacaatgctcaccagatcatcgaaagcctacaagaactctacagcggagtcctccttgccgggatcgtcccggagaaccaatcactttcacaagccatgattaccaagtacgacgaccaccaaaaacatctaaaaatgctcaaagccgtccgagaagccttagccccagaagaccgccaaagactcaagcaagcatatgaccagtacgtcgacggacaggagaacaccaaagcctattctaaggaagacttctacggcgatataacgaaagcacttaaaaacaatccagaccaccccatcgtcagcgaaatcaagaaacttatagaactagaccagtttatgccgaaacagcgcacaaaagacaacggcgcgattccacaccaactacaccaacaggaactagaccgaatcattgagaaccaacaacagtactacccatggctagcagaactcaacccaaactccaaacgccaaacagtcgccaaatataaactagacgagctagtagccttccgcgtcccatactacgttggacccctcataaccgccgaacaacaacgccaaagcagcgacgccaaattcgcctggctgattcgtaaggccgagggtcgcataaccccatggaatttcgacgataaggtcgaccgacaagcgtcagcaaacgagttcataaagcgcatgacaaccaccgatacctacctgctagctgaagacgtgctgccaaagcaatcgctaatatatcaacgattcgaagtcctaaacgaactcaacgggctgaaaatcgacgatcaacctatcacaaccgaactgaagcaggcaatattcaccgacctctttatgcagaaaatctccgtcaccgtcaaaaatatccaagactacctcgtatccgagaaaagatacgcgtcccgccccgccatcaccggactctccgacgaaaacaaattcaactcccgcctctccacataccacgacctcaaaatgatcgtcggcgacgccgttgacgacgtggacaaacaagccgacctcgaaaaatgcatcgaatggtccaccatcttcgaagacgggaaaatctatagcgccaaactgaacgaaatcgactggctcaccgaccaacaacgagtccaacttgcagcgaagcgctatcgcggctggggccgtctaagcgctaaacttctaacacaaatagtaaatgccaacggccaacgcattatggaccttttatgggacactactgacaatttcatgagaatagtccactcggaagatttcgacaaactcatcactgaagcaaaccaaatgatgctggcagagaatgatgtccaagacgttataaacgatctttacacatcgccccaaaacaagaaagcactacgacagatcctactcgtcgtcaacgacatacaaaaagcaatgaagggccaggcacccgagagaatcctcatagagttcgcacgagaagacgaggtcaacccccgtctttccgtacaaagaaagcgacaagtcgagcaagtatatcaaaacatctccaacgaactcctgaacaacactgaaatccgcaacgaactgaaagatctctccaactccgcactcagcaacacccgacttttcctttacttcatgcaaggcggccgcgacatgtacacaggcgactcacttaacatagaccgactttccacatacgatatagaccacatactcccacagagcttcgtcaaggacaacagcctagacaaccgggtcctcgtatcccaaaagatgaaccgatccaaagcagaccaagtgccaacagacttcacgagcgtggagctgggaaagaaaatgcaactacagtgggaacagatgttaagagcgggacttattacgaaaaagaaatacgacaacctaacactcaaccctgaccacatctcaaagtacgcaatgaaaggattcattaaccgacaacttgtcgaaacgcggcaagtcatcaaacttgcaacgaacttactcatggaacaatacggcgaagacaacatcgaactgataaccgtcaaaagcggactcacccaccaaatgcgaacagagttcgactttccgaaaaaccgcaatctaaataatcaccatcacgcatttgacgcatacctcactgcgttcgtcggactatacttgctcaaaagataccccaaactcaaaccctatttcgtttacggcgaataccaaaaagccagccaacaagataagtggaggaacttcaacttcctcaacggcctaaagaaagacgaactcgttgacgaaaacaccgaagcagtgatatgggacaaggaatccggactcgcgtaccttaacaaaatctatcagttcaaaaagatactggtcacacgggaggtccacgaaaacagcggagcattattcaatcaaaccctgtatgcggcaaaagatgacaaggcaagcggccagggcggcaagcagctaattccagccaaacaagaccgtcccaccgcactttacggcggctactccgggaaaacatcagcatacctgtgcctagtcaaaatcaaaaacaagtctgaatacatataccgaatcttcggagtaaataccagctggtccagcgagctcaagcagatccaagatccagcagagcgcctcgtacgactcgagaaactgctgacaccccaacttacaataaacaaaaagaagaaaggcgaacccgtaccagtaacaaaagatttcaaaataatcctcccgcggatcctcatcaaccaaaaattctacagcagaggccaagacatttccatagcttccgagttctacctacataatgagcaagagctagtcctagacaaatctgacatcaaaatcctcaacggtgccataaaagtaaataactccaacaaacaagtcatcaacctctttaaccacatcctagaacaggtgaaccagtacttccccgtatacgacatctacaaatctcgcgaagtactaaattccagcaaagaaattttcgaaaacctgacatggaacgaccaatggcgcaaccgcaaactgatcaacgtaggccagaaaaccatactcaaccgaatcctgatcggcctgcacgctaacgccgcaagaataaaaatctccgaactcggattcaagaacgacttcggactcctcacccaaacatccggaatcacattcacccctgacacacaaatcatatatcaatcgccaaccggcttattcgaacgccgggtcgccctccgcgatctatga

SEQ ID NO: 6585 - RNA, 4107 nt, synthetic construct
  misc_feature 1..4107: note = Cas9 variant
  source 1..4107: mol_type = other RNA
atgaagcgctcatacaacattgggctagacatcggcaccaacagtatcggatgggccatcgtagatgaccaatccaaactaataagcgtaaaagggaaatatggatacggggtacggctttacgacgagggacaaactgccgccgaaagacgctcatttcgtaccacccgacgccgcctaaagcgacggaaatggcgactcggcctacttagagaaattttcgaaccgtacattacacctatagactccacgtttttcctcagacaaaaacaatccaacctcagccccaaagaccaacgaaagctctatccgcaaacctcactattcaacgaccgacccgacgccgacttctaccaacagtatcccaccatctaccacttgcggtaccagctgatgacggaaaaacgacaattcgacatccgcgaaatatacctggcgatgcaccacatagtaaaatatcgaggccattttctcaacgaggcccctgttgcatctttcaaatcaagtgaaatcaacttagcagaacattttgaccaactgaatacaatattcgccgatctattccgtgaatcgggattccagctcgagacagacgagctggtcgcagtaaaagccctgctcatggacaaccagcagtcagcaagcaaccgccaacgaaaagcactaccaaaactgtacaccccatcagcggacaaatcaatcgaaaaacaacgtaaagctatagccaccgagatcctcaaagctatcctcggcctcaaggcgaaatttaacgttgtcaccggaatagaagccgaagacgtaaaggcttgggccctaacgttcaacgccgaaaatttcgatgaagaactagcaaaactagagtcctccttagacgataatggccatgaagtcatcggaatcctgcaggaactttacagcgggatcctactcgcaggaatagttccagaaaaccaaagtctgagccaggctatgatcaccaaatatgaggaacaccaagcccatctcaaaatgctcaaagcggtccgcgacgacctcgccaccgcggaccagcaaaaattaaagaaagcatacgatcaatacatcgacggccaggaaaacaccaaagcctactccaaggaagcgttctacgacgacgtgacaaaggccctaaaagactactccgaacaaccacttgtatcagaaatccaaaaactaatcgaactcgaccaattcatgccaaaacagcgaacgaaggacaacggtgccatcccacatcagctccaccagcaggaattagaccggatcatcgaaaaccaacagcaatattatccttggctagccgaactaaacccgaaccccaaacgccaaactgtcgccaagtataaactcgacgagcttgtcgctttcagggtcccctactacgtgggacctcttatcacagcggagcagcaacaacaatcctccaacgcaaagttcgcctggatgatacgaaagactgaaggccgaataacaccgtggaacttcgacgacaaagtcgaccgccaagcctcagcgaacgagttcataaagcggatgaccaccactgacacctacttactggcagaggacgtgctcccaaaacagagcttaatctatcaacggtttgaagtactcaacgaactaaacggactaaaaatcgacgatcaacccatcacgaacgaactaaaacaagctatcttcaacgacctcttcatgcaaaagacatccgtcagcgtaaagaacatccaggattacctcgtctcagaaaagcgctatgcctcccgtccagccatcacggggctatccgacgaaaagaaattcaactcccgactctccacgtaccacgacctaaaagtaatcgtaggcgacgcagtcgacgacgtcgacaaacaagcagacctcgaaaaatgcatcgaatggtcgacgatctttgaagacggaaaaatctacagcgcaaaacttaacgagattacatggctcacagaacaacaacgcggccagcttgccacaaaacgataccgggggtggggccggctatcagccaaactcctaacccaaatcgtaaatgccaacgggcaacgcatcatggacctcctatgggatacaacggacaatttcatgcgtattgtacacttcgaggacttcgacaaactcatcacagaggcgaaccaaatggtcctcgccgaaaacgatgtccaagacgtaatcaacgacctctatacatcaccacaaaacaagaaagccctacgccaaatactcctagtggtcaacgacatacaaaaagccatgaaggggcaggcacccgagcgcatactaatagagttcgcccgcggcgctcaaaaggacaaaagcctaaccgtacgacgtaaacgcaaactggatgaaatgtactcccaaatatcggatgcagtacttgccgacgaatctgtgagacaagaactaaaatcgagcaaccaagacgatctcgtaaaagaaaaagtctacttatacttcatgcaaggcggacgtgacctctacaccggtaacgccctaaacatagaccgcctgtccgactaccacgtagaccacatcatcccacaggcatatattaaggacgactccttagacaacaaggccctggtatcctcccgcatgaacgaaattaaggccgaccgagtacccctccaggtagtacaaaaacaatttggcaagaacatggcctccgaatggggctacatgcaccgagcaggcttaatatcacgaaagaaatacgacaatctgatgtttaaccccgaaaacctcaacaaataccaaattaaccgcttcatctcccgtcagctagtggaaactcagcaggtcataaagctagtcgccaacctactgagtaaccaatacgaaggcgacaacgttaaaatcataaccgtcaaatctaaacttacccaaacgatacgatccgagtttgacttccccaaaaaccgagaagtaaacaactaccaccacgccttcgacgcctatctcaccgccttcgtaggcatgtacctcctgaaaagatatccaaaactaagctcttatttcacgtacggggaatatcttaagggcaaccaacaggacaagtggagtagcttcaactttctaaacgacctaaaaagggctaaactcgaagacaaaacgaacaaagaaatcttctggcacaaagaaagcggcctagcctacctcaacaagatctatcaattcaagaaaatacttgttacgcgcgaagtccacgagaacagcggcgccctattcaaccaaaccctctacgctgcaaaagacgacaaagcctccggccaaggagggaaacaacttataccagcaaaacaggcacgacccacggcgctctatggcggctactcaggcaagacagttgcctacatgtgcatcgtccgaattaaaaacaaaaagggagacctatacaaagtatgcggtgtagaaacatcatggctcgcacaactaaaacaactcaaagacgaggactcacaaaaagcgttcctcaaacagaagatctcaccccaattcacaaaggctaagaaacaaaaaggaacaatagtcaaagtcgttgaagacttcgaagtgatagcaccacacatcctaatcaaccaaagactctttgacaacggccaagaactcaccctgggatccgcaacatacaagcataacgagcaagaactcatcttagacaaaacggcagtgaagctactcaacggcgaactaccactagcccaatcggaggaactagccgagttagtctacgacgaaatcctcgaccaagtaatgcactatttcccgctttacgatacgaaccagttccgagcgaagctactcgccggtaaaaccgcattcatgcaactcccatggaagtcaaatcccgacgacaacaaaaccgtacagatcacccaacccatagtccttaagaaaatcctccaaggactacacgccgacgccggccgagtttcactcaaagaactaggcatgacaaccgacttcggcatgctacaaaaagccaccggaatcacattcacaccggacacacaaataatataccaaagccccacgggactcttcgagcggagagtggcactacgagacctatga

SEQ ID NO: 6586 - RNA, 4107 nt, synthetic construct
  misc_feature 1..4107: note = Cas9 variant
  source 1..4107: mol_type = other RNA
atggacaagaaatacagcattggactggacatcggaacaaatagcgtcggatgggccgtcatcaccgatgactacaaagtaccgtcgaaaaagttcaaagtcttaggcaacacagaccgccactcaatcaaaaagaacttaataggtgcactcctctttgacagcggtgaaaccgccgaggccacgcgactcaagcgaaccgcccgcagacgatatacccggcgtaaaaaccgaatctgctacctccaagagatcttctctaacgaaatggcaaaggtcgacgactcattctttcatcgcctagaagagagcttcctggtagaagaggacaagaaacacgaacgacaccccatcttcggcaacatagtggacgaagtcgcataccacgaaaagtacccgactatctaccacctccgcaagaaactcgtcgactcaacagacaaagcagatctccgcctaatctacctagcgcttgcccatatgataaaattccgtggacattttctcatcgagggagacctgaacccagacaacagcgacgtcgacaaacttttcatccaactggtgcaaacctacaatcaactctttgaagagaaccccataaacgcatccggtgtagacgcaaaagctatactctcggccaggctatccaaatcgcgccgactcgagaacctcattgcgcagctgcccggagagaagaaaaacggactcttcgggaacctcatcgcgctatcactaggcctgaccccgaacttcaaatcgaactttgacctcgcggaagacgctaaactacagctgtcgaaagatacctacgatgatgacctcgacaacctactcgcccagataggggaccaatacgctgatctctttctcgccgcgaaaaaccttagcgacgccatccttctatcagatatactcagggtcaacacggaaatcacaaaagcacccttgtccgcatccatgatcaaacgctacgacgaacaccaccaggacctaacgcttctcaaagcccttgtacgccagcaactaccggaaaaatacaaagagatcttcttcgaccaatccaagaacggctacgccggatacatcgacgggggagccagtcaagaggagttctacaaattcatcaagccgatcctcgaaaagatggacggcaccgaagagttgctggtaaaactcaaccgagaagacctcctacgtaaacaacgaacgttcgacaatggctccatacctcaccagatccacctcggcgaactccacgccatcctcagacggcaggaagatttctatcccttcctcaaggacaaccgagagaaaattgagaagattctcacattccggataccatactacgtcgggccactcgcccgcggtaactccagattcgcatggatgacccgaaaatcggaagagacaatcacgccctggaacttcgaggaagtcgttgacaaaggagccagcgcacagagcttcatcgaacgcatgaccaattttgacaaaaatctacccaacgaaaaggtccttcctaagcactcactcctatacgagtactttaccgtctacaacgaactcactaaagtcaaatacgttactgaggggatgcgtaaacccgcgtttctatccggggaacaaaagaaagcaatagtcgacctactcttcaaaacgaaccggaaagtcaccgtcaaacaactcaaagaggactacttcaagaaaatagaatgcttcgacagcgtcgaaatctccggcgtcgaagacagattcaacgccagcctcggcacctaccacgacctactcaaaataatcaaagacaaagacttcctagacaacgaggaaaatgaggacatccttgaagacattgtcctcacattaaccttattcgaagatcgcgagatgatcgaagaacgcctaaaaacgtacgcacacctcttcgacgacaaggtaatgaaacaactcaaaaggaggcgctacaccggttggggacgcctgtcccgcaagctcatcaatggcatccgagataagcaatctgggaaaaccatactcgacttcctaaaatccgacgggttcgccaaccgcaacttcatgcaactgatccacgacgactctctcactttcaaagaagacatccaaaaagcccaagtttctgggcagggcgactcgctgcacgaacacatagccaatctagcgggaagccccgcgataaagaaaggaatccttcagacagtcaaagtagtcgacgaattagtcaaagtcatgggtcgccacaaacccgagaatatcgtcattgaaatggcccgcgaaaaccagacgacacaaaagggacaaaagaactcccgcgaacgcatgaaacgaatcgaagaagggatcaaggaattgggctcccaaatcctaaaagaacacccagtcgaaaacacccaactccaaaacgaaaagctctacctctattacctacaaaacggtcgagacatgtacgtggaccaagaactcgacatcaacaggctcagcgattacgatgtcgaccacatagtcccgcaatctttcctaaaagacgacagcatcgataacaaggtactcaccagaagcgacaaaaaccgagggaaatctgacaatgtcccctcagaagaggtcgtcaagaaaatgaaaaattactggcgccaactcctcaacgcaaagttaatcacccaacgcaaattcgacaacctgaccaaagcagagagaggcgggctcagcgaactcgacaaagccggcttcataaaacgccagctcgtcgaaacaagacaaataactaaacacgtggcccagatcctggactcccgcatgaataccaagtacgacgagaacgacaaacttatacgcgaggtgaaagtcatcaccctaaaatcaaagctagtgagcgacttccgaaaggatttccagttctacaaggtacgcgaaatcaacaactaccaccacgcgcacgacgcgtatctaaacgccgtcgttggcaccgctcttatcaagaaatacccaaaacttgagtccgagttcgtatacggagactacaaagtgtacgacgtgcgcaaaatgatcgccaaatctgaacaagaaatcggcaaagccacagccaaatactttttctactctaacatcatgaactttttcaaaaccgaaatcaccctagcaaacggggaaatcagaaaaagacctttaatagaaactaacggtgaaacgggagaaatcgtatgggacaaaggccgcgatttcgcaaccgtccgtaaagtgctctctatgccccaagtcaacatcgtcaagaaaaccgaagtacaaaccggagggttctcaaaagaatcgatcctacccaaaagaaactcggacaaactgatcgcacgtaagaaagattgggaccccaaaaagtacggcgggttcgactcaccgaccgttgcatattcggtcctagtagtagcaaaagtcgagaaggggaaatcaaagaaactaaaatctgtcaaagaactcctcgggatcacaataatggagcgaagctcattcgagaagaaccccatcgactttcttgaagcaaaagggtacaaggaagtcaaaaaggacctaataataaaactgccgaaatactcactatttgaattagaaaacggacgaaaacgcatgctcgcctcagcaggggaactacaaaaaggcaacgagctagcactcccgagcaagtacgtaaactttctatacctggcgagccactacgaaaagctcaaaggaagcccggaagacaacgaacaaaaacagctgttcgtagagcaacacaaacattacctcgacgaaatcatagagcaaatcagcgagttctcaaaacgagtaatcctcgccgatgccaacctcgacaaggtactcagcgcgtacaacaaacaccgggacaaacccatccgcgaacaagccgaaaatataatccacctcttcaccctcaccaacctcggcgcacccgccgcattcaagtacttcgacaccaccatagaccgcaagcgttacaccagcacaaaagaggtgctagacgctacgcttatccaccagtcgatcaccggcctatatgaaacgcgaatagacttgagtcaactaggcggagactga

SEQ ID NO: 6587 - RNA, 4107 nt, synthetic construct
  misc_feature 1..4107: note = Cas9 variant
  source 1..4107: mol_type = other RNA
atggacaaaaagtactccatcggactcgacataggcacaaacagcgtcggctgggcagtgatcacagacgactacaaggtgccgtccaaaaagctcaaaggcctaggaaacacagacagacacggcatcaagaaaaatctaatcggagcactactgttcgactccggcgagaccgccgaagcgacccgcctaaaacgcaccgcccgccgccgctacacgcgccgcaaaaaccgcatctgctacctccaggagatattcagcaacgagatggcgaaagtcgacgatagcttcttccaccgcctggaggaatccttcctcgtagaagaggacaagaaacacgaaagacacccaatatttggcaacatcgtagacgaagtagcgtaccacgaaaaatacccaaccatataccacctgaggaagaaactcgcggacagcaccgacaaagtcgacctaagacttatatacctagcgctagcccacatgataaagttccgtggccatttcctaatcgagggcgacctcaaccctgacaactcagacgtagacaaactcttcatacaactggttcagacatacaaccaattattcgaagaaaaccctatcaatgcgagccgagtggacgctaaagccattctatccgcccggctaagcaagagccggcggctcgaaaacctaatagcgcaacttcccggagaaaagaagaacggcctcttcggaaacctcatcgcgctctcactcgggctcactcccaatttcaaatccaatttcgacctagcagaagacgcaaaactccaactgtcaaaggacacatacgacgacgacctagacaacctcctcgcacaaatcggggaccagtacgccgacctattcctagcggcgaaaaacctgagcgacgccacgctactctccgacattttgcgggtaaactcagaaatcacaaaagcaccccttagcgcttccatgatcaagcgatacgacgagcatcaccaggacctaaccctcctaaaagcccttgtacgccaacaactccccgaaaaatacaaagagatattctttgaccaatccaaaaacggctacgcagggtacatcgacggaggggcttcacaagaagaattttacaaattcataaagcccatcttggagaaaatggacgggaccgaagaactcctcgcaaagctgaacagggaagatctcctccgtaaacagcgcacattcgacaacggaagcataccctaccaaatccaccttggagaactgcatgctattctacgccgccaggaggacttctacccctttctcaaagataaccgggagaaaatcgagaaaatcctaacgttcaggatcccatactacgtgggtccgctagcgcgcggcaacagccgcttcgcctggatgacccgcaagagcgaagaaactataaccccatggaacttcgaagaagttgtagacaaaggagcttccgcacagagctttatagaacggatgaccaactttgacaaaaatctcccaaacgaaaaagtcctaccaaaacactcactcctctacgagtacttcacagtgtacaacgagctcacaaaggtaaaatacgtcactgaggggatgcgaaagccagcattcttatcaggagaacaaaagaaagccatcgtcgacctgctctttaaaacaaaccggaaagtaacggtcaaacaattaaaagaagactactttaagaaaatagaatgcttcgatagcgtggaaatatcgggcgtagaagaccgattcaacgcgagcctcggcacataccacgacctactcaaaataatcaaagacaaagacttcctcgataacgaagaaaacgaagatatcctcgaagacatagtactcaccctgaccctattcgaagaccgtgagatgatcgaggagaggctcaaaacatacgcccacctgttcgacgacaaagtcatgaaacaactgaaacgccggagatacaccggatggggccgactctcccgaaagctaatcaacgggatacgcgacaagcaaagcgggaaaacaatactagacttcctgaaatccgacggcttcgccaaccggaacttcatgcaactaatccacgacgacagcctcacattcaaggaagacatacaaaaagcacaagtgagcggacaaggggacagccttcacgaacacatcgccaacttagccggatccccagcaataaagaaaggcatacttcaaaccgttaaagttgttgacgaacttgttaaagttatgggccgccacaagccagagaacattgtaatagaaatggcccgcgaaaaccaaactacgcaaaagggccagaaaaatagcagagaacgaatgaaacgcatcgaagaaggaatcaaggaactcggctcggatatactaaaggaatacccagtagaaaacacccagctccaaaacgaaaaactttacctgtactacctacaaaatggtagagacatgtacgtcgaccaggagctcgacatcaaccgcctgtccgactacgacgtagaccacatcgtgccccagagcttcctcaaggatgactcaattgacaataaagtactcacccgatccgacaaaaacaggggcaaatcagacaacgtcccatccgaagaagtggttaagaaaatgaaaaactactggaggcagcttctaaacgccaaactgataacccagaggaagttcgacaacctcactaaggccgaacggggaggactctcggagctggacaaggtaggatttataaagcggcaactcgtggaaactaggcagattacaaaacatgtggcccaaatattggactcccgaatgaatacaaaatacgacgaaaacgacaaactaattcgggaagtccgtgtcatcacactgaaatccaagctcgtatcagattttaggaaagacttccaattttacaaagtccgtgaaatcaacaactaccaccacgctcacgacgcatacctcaacgcggttgttggcacagcattgataaagaaataccccaagctcgagtccgagttcgtatacggagactacaaggtctacgatgtgcgcaagatgatcgccaaatccgaacaagaaattggcaaggcaacagccaaatacttcttctactccaacatcatgaacttcttcaagacagaaattaccctcgcgaacggagaaatacgcaagcgcccacttatagaaaccaacggagaaactggggaaatcgtatgggacaaaggccgagatttcgccacagtccgaaaggttctaagcatgccccaagtgaacatcgtcaagaaaacagaagtgcaaactggtggcttctcaaaagagtcgatattgccaaaaagaaattcagacaaactcatagcacgcaaaaaggactgggaccccaaaaagtacgggggcttcgattccccgacagtagcctactccgttctcgtagtcgccaaagtcgaaaaaggcaaatccaagaaactaaaaagcgtaaaggaactgctgggaattaccatcatggagcgtagcagttttgaaaaggaccccatcgacttcctcgaagcaaaaggatacaaagaagtccgtaaggacctcatcatcaaactacccaaatacagcctattcgagctcgaaaacggccggaagcgcatgctcgcatccgctggtgaacttcaaaaggggaacgaactcgcactaccatccaaatacgttaacttcctatatctcgcgtcacattacgaaaaactaaaaggtagcccggaagacaacgaacaaaaacagctatttgtggaacagcacaaacactacctcgacgaaataatcgaacaaatctctgagttctcgaaacgagtcatactagcagacgccaacctagacaaagtcctctccgcttataacaaacaccgagacaaacccatccgggaacaggccgaaaacatcatccaccttttcacattgacaaacttaggagctccagcagcatttaagtactttgataccaccatagaccggaaaagatacacgtccaccaaggaagtgcttgacgcaactctcatccaccaaagcatcacaggcttatacgaaacccggatcgatttaagccaactcggtggcgattga

SEQ ID NO: 6588 - RNA, 4107 nt, synthetic construct
  misc_feature 1..4107: note = Cas9 variant
  source 1..4107: mol_type = other RNA
atggacaagaaatactcaataggcctagacataggaaccaactccgtaggctgggccgtgataacagacgactacaaagtgccaagcaaaaagttcaaagtactcggaaacacagataggcacagcatcaaaaagaacctgataggggcgctcctgttcgatagcggagaaacagcagaagcaacccgcctaaaaaggaccgcccggcgtcgctacacccggcggaagaaccgaatatgctacctccaagaaatcttcagtaacgaaatggccaaagtcgacgactcattctttcaccgactagaggagagctttctcgtggaagaggacaagaaacacgaaagacacccgatatttggaaacatcgtagacgaagtcgcttaccacgagaagtatccaactatctaccacctccgtaagaaactagcagactctactgacaaagctgacctgcgactaatctacctcgcattagcacacatgatcaagttccgcggccatttcctaatagaaggagaccttaacccggacaactcagacgtcgacaaactcttcatccaactcgtccaaacctacaaccaactcttcgaagaaaacccaatcaacgcatccagagtcgacgctaaagccattctaagcgcgcgcttgtcaaaatcccgccgcctagaaaatctgatcgctcagctccccggagaaaaacggaacggcctattcggtaacctaatcgccctttccctaggacttacccccaacttcaaatccaacttcgatctggcagaagatgcaaagctacaactatccaaagacacgtacgacgatgacctagacaacctgctagcccagataggcgaccagtacgcggacctattcctagccgcgaagaacctcagcgacgcgatcctgctctccgacatcttgcgagtcaactcagaaatcaccaaagcaccgctgtccgcctctatgataaaacgctacgatgagcaccaccaagacctcacactcctaaaagcactcgtcagacaacaattacccgaaaaatacaaggaaatcttctttgaccaaagcaagaatggctatgccggctacatcgacggcggagctagccaagaggagttttataaattcatcaaacccattctcgagaaaatggacggaacagaagaacttctcgccaaactcaaccgagaggacctgctgcggaaacaacgaacgttcgacaacggatcaatcccgcaccaaatccacttaggggagctacacgcaatcctgcgccgacaagaagatttctacccctttctcaaggacaacagagagaagatcgagaaaatcctcacgtttaggattccctactacgtcggccccctggcaaggggcaactcccgattcgcctggatgacacgaaagagcgaagaaactatcaccccttggaacttcgaggaagtcgtcgacaaaggtgcctctgcacagagcttcatagaacgaatgaccaatttcgacaaaaacctccccaacgagaaggtacttcccaagcattccctgctctacgagtacttcactgtctacaacgaactaacaaaggtaaaatatgtaacagaaggaatgcgcaaacccgagttcctgtcaggcgaacaaaagaaggccatagtagatctgctgttcaaaacgaaccgcaaagtaacggtaaagcaactcaaagaagattacttcaaaaagatcgagtgtttcgacagcgtagaaatctccggggtcgaggaccgattcaacgccagcctcggaacataccacgatttactcaaaataatcaaggacaaggatttcctcgacaacgaagagaacgaggacatcctagaagacatcgtcctaacgctaacactcttcgaagaccgcgagatgatagaagaacggctcaaaacctacgcccacctttttgatgacaaagtaatgaaacagctgaagcgtcgacgctacacgggatggggacgcttgtcgcgaaaactcatcaacggaatccgagataagcagagcgggaaaacaatcctagacttcctaaagagcgacggtttcgccaaccgaaacttcatgcagctgatacacgacgatagcctaaccttcaaagaagatatccaaaaagcccaagtctcaggccaaggagacagtctacacgaacacatcgccaacctggccgggtccccagccatcaaaaagggaatcctccaaaccgtcaaagtcgtggacgagctcgtgaaagtcatgggccgacataaacccgagaacatagtcatcgagatggcgagggaaaaccaaaccacacagaaaggccagaaaaactctagagaacggatgaaacgcatcgaagaaggaatcaaagagctcggcagcgacatactaaaggaatacccggtcgaaaacacgcaactacaaaacgaaaaactctatctatactacctccaaaatggacgagacatgtacgtcgatcaagagctcgatataaaccgcctgtctgactacgacgtggaccacatcgtgccccaatcattcattaaggatgactcgatagataacaaagttctcacccgcagcgataaaaaccgtggaaaaagcgacaatgtaccctcggaagaagtcgtcaaaaagatgaaaaactattggaaacaactcttgaatgccaaattaatcacacagcgcaaattcgacaacctgacaaaagccgagcgaggtggactctcggaactcgacaaagcaggattcatcaaaaggcaactcgttgaaacccgccaaatcacaaaacacgtagcgcagattcttgactcacgcatgaacacgaaatacgacgagaacgataagctcatcagagaagtgaaagtcataacacttaagtccaagctagtctcggacttccgcaaggacttccagttctacaaagtcagagagatcaacaactaccaccacgcccacgacgcctacctaaacgccgtcgtcggcaccgccctcataaagaaatatccaaagctggaatccgagttcgtatacggagactacaaagtctacgacgtccgaaaaatgatagctaaatccgaacaggaaatcggcaaagcgacagcaaaatacttcttttacagcaacatcatgaactttttcaaaaccgagattacacttgcaaacggggaaatcagaaagcgccctctcatcgaaacaaacggggaaaccggagaaattgtctgggacaagggacgcgatttcgctaccgtccgcaaggtattgtctatgccacaagtaaacatcgtcaaaaagaccgaggtgcaaaccgggggattctcgaaagaatcaatactcccaaaacgcaatagcgacaaactaatcgcacgaaagaaagactgggatcccaagaaatacggcggcttcgattccccgacggtcgcatactccgtcctagtagtcgcgaaagttgaaaagggcaaatccaagaaactcaaatccgtgaaggaacttctcggaatcaccatcatggaaagaagctccttcgagaaaaaccccatagacttcctggaagccaagggctacaaagaagtccgtaaggacctcataatcaagctgccaaagtattcgctattcgaactggaaaacggacgcaaacgcatgctagccagcgccggagagctccaaaaaggtaacgaactcgctctccccagcaagtacgtaaacttcctatatctagcgagccactacgaaaaactgaaaggatcccccgaagacaacgaacaaaagcaacttttcgttgaacaacacaagcactaccttgacgaaatcatagagcagatatccgagttctctaagcgagtgatcctcgcggatgcgaacctagacaaagtactatccgcatacaacaagcaccgcgacaaacccatcagagaacaagccgaaaacatcatacacttattcaccctcacgaacttcggcgcaccagcggccttcatctacttcgacacaaccattggccggaacagatacaaatctatcaaagaagtccttgacgcaacccttatacaccaatccatcacgggactctacgaaacgcgaatcgacctatcacaactcggcggtgactga

SEQ ID NO: 6589 - RNA, 4107 nt, synthetic construct
  misc_feature 1..4107: note = Cas9 variant
  source 1..4107: mol_type = other RNA
atgaaatacgaaagtgaagaatactacataggactagacatgggcacaagctccgtcggatgggccgttacggacccccactatcaccttatccgaaagaaaggcaaagacttatggggcgcgcgactcttcgaaaaagccaatacggcacaggagcgccggaccaaccggatcaaccgccgccgcaaccagcgccgcaaacaaaggatagcgttcatccgcgaagccttccgcaaagaagtcgaaaaggtagacgtcaacttcttccgcagactcgatgagtcccagctatacctcgaagacaaatccataaaggaaccgtacctcctattcaacgacctcaactacaccgacaaagacttctaccaccaataccctacggtattccacctaatcaccgacctgctcacttccgaccgtaaattcgacattcgggaaatatacatcgcagtcagctctctttacaaccatcgcggcaacttcctaaacaagagcctaggcaacgaaacgcaggacgaggacctagtattcaaaaacctcgacgaggccttctcagcatgcgggatgaactggaacaccaaagccgagaacatcgaggtcgttaagcagatcctctgcgaccgctccctaaacaaaaaggaaaagcaggatcaactcgcacattgtctagagatcaataagaaaaccgaaaaagagaagattgagttcctcaaactccttacagggggcaaggccgacagcaagaaaatgttcccccaataccactacgaacgggacgaaaaattatcctttgcgttcgctgacgaaaacggcgacgaaaactgggaagaaaccctgaacgccatcgaagaaagattgacgtcggacgaatatggcctaatcctcgcacttaaaagcgtctacgactggagcattctggctgatctaatgaaaaacgagaaaacgggagaaacctatccttacctcagtatggcgagaaaagacagctatgagaaacacaaggcggatctgcggcttctcaaatcagtaatcaaacgactcatccccaacgagtacaaccactttttccgacagtacgacggtaagggcaagacctatacgaactacataggaagcgtgcagtaccacgagaaacgtcacagattcaaacacatcaccaccaaagaattttacgacgggttgaagaaattactcaaaccatactccgaggacgaggaaataaagcaaatcctacaggacatagaatccgaaacgttcctccccaaacagatcacgaacatgaacggagtcatcccaaatcaagtacatgccaaagaactgaaggtcatactagaaaaagcaagccaacactacgatttcctaaacgaaacgaacgaatccggtctcacagtgaaagaacaaatcatgcagatgttcaccttccaaatcccgtattacgtaggacccctcgccaacctaaatgggaaaggaaacggctgggccgtacgctacgtcgggaaggaaagaaccaaagtgtacccatggaacatggacgaagttatcgacgagaaagaaacggccgaccaatttataaaacgcatgataagtacctgcacatacctcggggacgaatacgtactacccaagagctcaatcctgtacgaaaaatttgccgtcctcaacgagcttaactcactaaaaataaacgggcaaccggtgagcgtggacttgaaacagaaaatataccgcgatctattcaccaaaggcaagagagtaactcagaagggcctgttactatatctaaaacgagaaggggtgatcagcaaatccgaagaaacaatcttatccggcttcgacatagacttcaaaaacacccttagctcataccggaaattctgcgaggtcttcgcaacaaacgaactcaacgacgaacaaataagaatggccgaagacataatagaatggctgacggtcttcggcgacagcaaaaagtttgtccgcgagaaaatacacgggaactacccccagatcaccgcgaatcaactcaaacggattctatccttcaactttaaggactggggtaagctctccaaacaatttctggaattggaaggcgaggacagagaaacaggcaagtcatgcagcctaattcaagccctctgggacaccaacaacaacctaaatcagctcctcagtagtcgatttacatacaaggaaaacctagagaagaaacgcaagaaaatcgaaatggacctatttgagttcacgcacgaagacctagacgacctgtacatatcggcacccgtgaaacggatgatatggcaagcccttaaaataatgaaggacatagttatcgtaatgaaagaatcacccacaaaactctttatcgaaatgacccgcaacaacgaaaacgaaaagacacgcaccgtatcccggaaaaacaagctcgtcgacctatacaaaaagatcaaaggggagtcacgtgactggatcaaggagctcgagagatacgaggagaaagacttccggtccaagaaactgtatctttactatacccagatgggcaaatcagcgtacagcggcgagcccatcgatatggacaaactgttcgacaaaaacgtatacgacatagaccatatatacccaaaatccaaagtcaaagatgactcactacttaacaattgcgtcctagtgaaaagaaaagagaacatggacaagggcaacaacttccccatagaccccgacatacagacgaaacaagaacacctctggaaattctggcttgagaagggcctgatcacacaagaaaaatttaacagactcacaagaaagaaaccattcaccaacgacgagctcgccgatttcgtaaaccgacagctagtagagacgggccaagcaacaaagacgatcgcggacctcttcaaaatgacctttcctaacagcgatatagtttacgtcaaagcaggcaacgtgaccgatttccgccaatacatagaggtctacaagtgccgcgaggtgaacaatctacaccacgcctacgatgcatacctcaacgttgtagtcggaaacgtctacgacaccaaattcacgaaaaaccccatgaactacataaaggaacaacgaaaagagaacagtaacgagagataccatatggacaaaatctttgaatttcccgtcatacgaaacggtaaggaggcttggatcacgaagaaggacgaaagtatcaacatagtacgcaaaacactagcgaggaagacacccctggtgacaaaaaggaacttcgaggcgaacggcacaatagcaaaagccaccatctaccctaagggcaacgtcaaggaccaaggctacctccctagaaagacctccataccagccctgcgagacatgaagaaatacggcggcgtcacctcaatccagatagcgtacttcttcctagtagaacacgaggttaaaaagaagcgtatacgcacgatagagtgcgtcccaatataccgcaaggaggaacttaagacgaaagagcagctggaaaggtattgccgagaggaactaaagctaattaacccaagcatacggctcgagaaaatcaaaccctacagcctccttaagatgaacgggaacttcttctacataacaggcaagacgaacgatagattcagcctagccaacgccatggagctatacgtagacaaagtaagcgagaaccacatccgagacctcgtaaagtacaaaaactgtgggtacttcaatgtagacgacaaagaagcacgcaaacgcaacgaacgcctctacacgatactaaccaaaaagcacctcaccgtcttcaaaggctccccaaaaccgatgggagaaaagctccaacagtaccagcaactcttcctcgaactagaagtctcaaaacaagtatacgtccttctccagatactacagctaacagcaacaaacgtcaagacaaaggccgacctgacagccatagggggcaaagcaaacgaaggcacaatggacatcagcaaaaatctagaaaacgtcattaaaaaccaaataaagaaaggtctcgtaccggagctcatgctaataaaccagtcgccgactggcctattcgaaagcgaaatcgacctcctaacaatttga

SEQ ID NO: 6590 - RNA, 4107 nt, synthetic construct
  misc_feature 1..4107: note = Cas9 variant
  source 1..4107: mol_type = other RNA
atgtcgcgtccgtacaacatagggcttgacatcggcacctccagcatcggatggagcgtagtagacgaccagagtaaactcgtatccgtacgcggaaaatatgggtatggcgtccgcctgtacgacgaagggcaaactgcagcagaacgaagatccttccgaacaacacgccgtcgcctgaaacggcgcaaatggagactcggactcctacgcgagatctttgaaccgtacattacacctgtcgacgacactttcttccttcgcaagaaacagtctaatctatccccaaaagaccagcgaaaactatacccccagacaagcctattcaacgaccgcacagatcgagctttctacgacgattaccccaccatctaccacctccgatacaagctaatgaccgaaaaacgccagttcgacatccgagaaatctacctagccatgcaccatatagttaagtaccgagggcacttcctaaacgaggcccccgtcagctcattcaagagcagcgaaataaacctagtcgcccacttcgaccgtctcaacaccatcttcgcagacctgttctccgagagcggattccaactcgagaccgataaattggccgaagtcaaagctctactgctagacaaccaccaatccgcatccaaccgccagcgccaagcactcctcctcatatacacaccttccaccaacaaagccgtcgaaaaacagaacaaagcaatcgcaaccgagctactgaaagcgatactaggcctaaaagccaagtttaatgtgctcacaggaatagaagccgaggacgtgaaaacatggacactgaccttcaacgcagagaacttcgacgaagagatggtcaaactagagtcatcattggacgacaacgcccaccaaataatagaaagccttcaagaattatattccggcgtgctactggccggcatcgtaccggaaaaccagtccttgtcccaggcaatgataaccaagtacgacgaccaccaaaagcatctaaaaatgctcaaagcagtcagagaagcattagcccccgaagaccgccagcgcctaaaacaagcgtacgatcaatacgtggatggacaagaaaacaccaaagcctactccaaagaggacttctacggcgacatcacgaaagccctcaaaaacaacccagaccaccccatcgtatcggaaatcaagaaactcatcgaactcgatcaatttatgccaaagcaacgcacaaaagacaacggcgcaatcccccaccagttacaccaacaagaattagaccggataatcgaaaaccagcaacaatactacccttggctagcagaacttaatcccaactctaagcgacaaaccgtcgccaagtacaagctagacgagctcgtagcgttccgcgtgccatactacgttgggccgctcattaccgccgagcagcagcaacagtccagcgatgccaagtttgcctggatgatacggaaagcggaagggcaaatcacaccgtggaacttcgacgacaaagtcgaccgtcaggcctcagcaaacgagttcatcaaacgcatgactacaaccgacacgtacctactagctgaagacgtacttcccaagcaaagcctcatctaccaaagattcgaagtactaaatgagctaaacggactcaaaatcgatgaccaacccataaccacagagctcaagcaggccatcttcaccgacctcttcatgcagaaaacatcggtcacagtcaaaaacatccaagactacctagtatcggaaaaacgctatgcctccaggcccgcgatcaccggcctatcagacgaaaacaaattcaactcacgcttgtctacctaccacgacttaaaaaccatagtaggtgacgcagtggacgacgtcgacaagcaagccgacctagagaaatgcatagaatggtcaacaatatttgaggatggaaaaatatactcggctaagctcaacgagatagactggctaacggaccaacaacgggtacaactcgcggcaaaacgttacagagggtgggggcgcctctcagcaaaactgctcacccaaatagtaaatgcaaacggtcagcggatcatggacctcctctgggacactacagacaacttcatgcgaatcgtgcactccgaagacttcgataaacttattaccgaagctaatcaaatgatgctcgccgaaaacgacgtacaggacgtaataaacgacctatacaccagtccccaaaataagaaagccttaagacaaatcctgctcgtagtcaacgacatccaaaaagccatgaaaggccaagcacccgagcgcatactaatagagttcgcccgagaagatgaagtaaacccacgcctatccgtccaacgcaaacgccaagtggaacaagtctaccaaaacatatcaaacgagcttctcaacaacactgaaatccgcaacgaacttaaggacctatccaattcagccctctccaacaccagactcttcctgtacttcatgcagggaggccgagacatgtacacaggagactcccttaacattgacagactctccacatacgatatagaccatatcctcccccaatcattcattaaagacaactccctcgataaccgagtcctagtttcacagcggatgaaccgcagcaaagcagatcaggtgcccaccgatttcacatccgtggaactcggacagaaaatgcaaatacaatgggaacaaatgctgcgcgcaggcctcatcacaaagaagaagtacgacaacttaacccttaaccccgaccacatcagcaaatacgccatgaagggattcataaatcgacaactggtcgaaactcggcaagtaatcaaactcgccacaaacttgctcatggaacaatacggcgaagacaacatcgaactcattacagtcaagagcggcctcacgcaccagatgcggactgagtttgacttcccgaaaaacagaaatctaaacaatcatcaccacgcatttgacgcatacctcacagcctttgtgggtctctacctactaaaacgctaccccaagttaaaaccatacttcgtatacggggaataccagaaagcctcacagcaagataagtggcgaaacttcaacttcctcaatggactaaagaaagacgaactcgttgacgaaaacaccgaagcagtcatctggaacaaggaatcggggctcgcataccttaacaaaatctaccaattcaagaaaatcctcgtcacacgggaggtccacgagaatagcggcgcactcttcaaccaaactttatatgctgcaaaagacgacaaggccagcggtcaaggcggaaaacaactcatacctgccaaacaagacagacccaccgcactctacggcggctactccggcaagacagtggcatacatgtgcatcgtccgtatcaaaaacaaaaagggggacttgtacaaggtctgcggagtagaaacgtcctggctagcacaactaaaacaactaacggacgaggactccaaaaaggcattcctcaaacagaaaatctcaccacaatttaccaaagtgaagaaacagaaaggcaccatcgtcaaggtagtagaagatttcgaggtaatagctccccatatcttaatcaaccagcgattctttgacaatggtcaagagttaacactaggctcggccacctacaaacacaatgagcaagaattaatactcgacaagacagccgtaaagctgttaaacggggccctccccctcacgcagtcagaggaactagccgaacaggtctacgacgaaattctcgatcaagtcatgcactacttcccactgtacgacaccaaccagttccgcgccaaactatctgccggcaaagccgccttcatgaaactaccatggaaatcacaatgggatggcaataaaatggtgcaagtaggccaacaagtcatcctggacagagtcctgataggtctccacgcaaacgctgccgtaagcgacctgggtgtgctcaagatctccacaccgctcggcaaaatgcaacaacccagcggcatttctctttcacctgacacacaaataatctaccagtctccaacgggcctattcgaaagacgagtcgccctgcgcgacctctga

SEQ ID NO: 6591 - RNA, 4107 nt, synthetic construct
  misc_feature 1..4107: note = Cas9 variant
  source 1..4107: mol_type = other RNA
atgtcacgcccatacaacatcggactcgacattggaacaagcagcatcgggtggagcgtcgtagacgaccagtcaaaactcgtaagcgtcagaggcaaatacgggtacggcgtcagactatacgatgaagggcaaaccgcagccgagcgccgatcgttcagaacgactcgacgccgactaaaaagacgtaaatggagactaggcctcctacgcgagatctttgagccctacatcacaccggtggatgacaccttctttctgcgacagaagcaaagcaacctctcgcccaaggaccagaggaaactctaccctcagacctccctattcaacgaccgcactgatcgcgctttctacgacgactatcccaccatctaccacctcaggtacaaactcatgacagagaaaagacaatttgacatcagagaaatctacctcgccatgcaccacatcgtcaaataccgcggacacttcctcaacgaagctccagtctcaagtttcaagagctccgagataaacctcgttgcccacttcgaccgcttgaacacaatattcgctgacttattctcggaatccggattccagctcgaaaccgacaaactagccgaggtaaaagccctgctcctggataaccagcaatctgcctcaaaccgacaaaggcaagccctatccctaatctatacaccctccacaaataaagcggtggaaaaacaaaacaaggccatcgccacagaactactcaaagccatattaggtctcaaagcaaaatttaacgtactcacgcgaatcgaggcagaggacgtcaaggcctggacccttacattcaacgccgaaaatttcgatgaagaaatggtaaaactggaaagttcccttgacgataatgcccaccaaataatcgaatccctccaagagctgtactccggcatcctgcttgcgggcatcgtgccggaaaaccaatcccttagccaggccatgataatgaaatacgacgaccaccaaaaacaccttaaaatgctcaaggctgtaagagaagcgctcgcccccgaagaccgacagcgactcaaacaggcctacgaccaatacgtcgacggacaggaaaacacaaaagcatattcaaaagaggacttctacggtgacataacaaaggcgctcaaaaacaacccagaccaccccatagtgtccgaaataaagaaactcatagaactagaccagttcatgccaaaacaacgtaccaaggataacggcgccataccccatcagctccaccagcaagaactcgatcgcataattgaaaaccagcaacaatattacccctggcttgccgagctcaacccaaactccaagcgccaaacagtggccaaatacaaactcgacgaactcgtggccttcagagtcccctactacgtcggaccactaatcacagcagaacaacagagacaatcgagcgacgccaaattcgcatggttgatccgcaaggccgaagggcgcatcacaccctggaatttcgacgacaaagtcgatcgacaagcgtctgccaacgagttcataaaacgcatgacgacgacagacacatacctactagctgaagacgtacttcccaagcaaagcctcatataccaacggttcgaagtgctcaacgaacttaacggcttaaagatagacgaccaaccaattaccacagaactcaagcaagccatcttcaccgacctcttcatgcagaaaacctcagtcagcgtcaagaatatacaagactatctagtaagcgaaaaacgatacgcatcacgcccagcaatcaccggactatccgacgaaaataaatttaacagcaggctaagcacctaccacgaccttaaggcaatcgtcggagacgcggtcgaagacgtagacaaacaagtggacctagaaaaatgtgtagaatggtcaacgatattcgaagacggaaaaatttactccgcgaaactcaacgagatcgactggttaaccgaccaacagcgcgtacagcttgcggccaaacggtaccgaggctggggccgcctaagcgccaaactgctcacccagatcgtaaacgccaacggccaacgcatcatggacctcctttgggacaccaccgacaacttcatgaggatagtacacagcgaagacttcgataaactgatcaccgaagctaaccagatgatgctcgccgaaaacgacgtacaagacgtaataaacgacctctacacatccccgcaaaataagaaagctctcaggcagattcttctcgtcgtgaacgacatacaaaaagccatgaaagggcaagccccagaacgcatactcatcgagttcgcacgtgaagatgaagtcaacccccgtctctcggtccagcgtaaacgacaagtcgaacaagtttaccagaacataagtaacgaactacttaacaacacagaaatccgcaacgaactcaaagacctctcaaacagtgcactctccaacacacggctttttctctacttcatgcaaggaggacgggacatgtacacaggagactccctcaacatcgataggttatcgacgtacgacatcgaccacatcttaccgcagagctttatcaaagacaacagcctcgataaccgagtcctagtatcgcagaaaatgaaccgctctaaggcggatcaggtgccgactgactttacatccgttgagctaggcaaaaagatgcaattacaatgggaacaaatgctccgcgcaggactcataacaaagaagaaatacgacaatctgaccctcaaccctgaccacataagcaaatacgcaatgaaagggtttataaaccgccaattagtggagacccgccaggtgataaaactcgctacgaacctcctaatggagcagtacggagaagacaacattgaactcataaccgtaaaaagcggcctcacgcaccaaatgcgcacggaatttgacttcccgaaaaatcgtaacctaaacaaccaccaccacgccttcgacgcctacctcaccgctttcgtcggactctatctcctcaaacgctatcccaaactaaaaccatatttcgtttacggagaatatcaaaaagcgagccaacaagacaaatggcgcaacttcaatttcctaaacggcctcaaaaaggacgagctagttgacgaaaatacagaagccgtaatctgggacaaagagtccggccttgcctaccttaacaaaatataccaattcaagaaaatactcgtcacccgcgaagtgcacgagaacagcggcgccctcttcaatcaaacactgtatgcagccaaagacgacaaggcctcaggccaaggcggaaaacaacttatccctgccaagcaggatcggcccactgcactttatggaggatactccggcaaaactgtagcctatatgtgcatcgtacgcatcaaaaataagaaaggcgatctctacaaagtatgcggtgtcgagacctcatggctcgcgcaactaaaacaattaaccgacgaggattcacagaaagccttcctcaaacagaaaatcagcccacaatttacaaaagtgaagaaacaaaaggggacaatagtaaaagtagtagaagatttcaaagtcatagctccccacatcctcatcaatcagcgattcttcgacaacgggcaggaactaacactaggctcagcgacctacaaacacaacgaacaagaactgatactcgacaaaacagcggtgaagctcctcaatggcgccttacccttaacgcagtccgaagaactagcggagcaggtctacgacgaaatactcgaccaagtcatgcactactttcccctctacgacaccaaccaattccgtgcaaagctatccgccggcaaagcagcatttatgaaactaccgtggaaatcgatttgggacggcaacaagatgacgcaaatagggcaacaaatcattctagaccgcatcctcatcggccttcatgctaacgcagccgtttccgatctgggcgttttaaagataagcacaccactcggaaaaatgcaacaacccagcggaatatcccttagccccgatacccaaatcatataccagagccccaccggactattcgagcgacgagtagccctccgtgacctatga

SEQ ID NO: 6592 - RNA, 4107 nt, synthetic construct
  misc_feature 1..4107: note = Cas9 variant
  source 1..4107: mol_type = other RNA
atggtcgagaagaaaagctacagcataggactcgatatcggtaccaactcagtcggttgggccgtcattacggacgactacaaagtccccgccaagaaaatgaaagtactaggcaacacatctcgccaaagcatcaaaaagaacatgataggcgcactactcttcgacgaaggaggccccgccgcttccacccgcgtgaaacgaaccacacgacggagatacacacgccgcaaaaacagactctgttacctccgagacatattcgaatccgaaatgcataccatcgacaaacatttcttcctgaggctcgaggactcctttctacacaagtccgacaaacgatacgaggcgcaccccatcttcggcacacttcaagaagaaaaggcctaccatgacaactaccccactatataccacctcagaaaagcactcgcggacaacaccgaaaaagccgaccttcggctcatatacttagccctcgcacacatcataaaatttagaggtcacttcctcatcgagggagccctcagtgcgaacaatacagacgtgcagcaactggttcacgcgcttgtagacgcctacaacatcatgttcgaagaagaccaactagacatagaagctatagacgtaaaagccatccttaccgaaaagatatcgaagactcgccgtctcgaaaacctaatctcgaacattcctgggcaaaagaaaaacggcctattcggcaacctcatcgcactgtcccttggcctgacacccaacttcaaatcgcacttcaacctgcccgaggatgccaaactccaactcgccaaagacacgtacgacgaagaactcaataacctactcacccagattggggacgaatatgcagacctcttcctcagcgccaagaacctatccgacgcaatcctattgtccgatatactaaccgtgaacggcgacgggactcaagcaccgttgtccgcatcactaattaagagatatgaagaacacagacaggatctagcgctacttaaacagatgttcaaagaacaactaccagatctttaccgcgacgtcttcactgacgagaacaaggacggttatgcaggttacatctccggcaaaacatcccaggaagcattctacaagtacataaagccgattctcgaaaccctagacggagcagaagatttcctcacaaaaatcaatcgcgaagacttcctccgcaaacaacgtaccttcgacaacggtagcatcccacaccaaatacacctcggcgaactccaagccatcctagagagacagcaagcctactaccccttcctcaaagacaaccaggagaaaatagaaaagattctaaccttccgcatcccctattacatcggccccctcgcccgaggaaactcacgcttcgcctggctaaccaggacaagcgaccagaaaatcaccccgtggaacttcgatgaaatggttgatcaagaagcctccgcccaggctttcatagaacgcatgaccaacttcgacgaatatcttccgcaagaaaaagtcctccccaaacattcactaacctacgaatacttcacggtatacaacgaactcaccaaagtgaaatacgtcaccgaaggcatgaccaagcccgagttcctatctgcaggacaaaaagaacaaatagtagaactcctgttcaaaaagtaccgaaaggtgaccgtaaaacaactaaaagaagacttcttcagcaaaatcgaatgtttcgacacggtcgacatctccggggtagaagacaaattcaatgcatccctggggacgtatcacgatctactgaaaatcatcaaggacaaggcttttctcgataactctgaaaacgagaacataatcgaagatatcatacttacactaaccctgttcgaagataaagaaatgatcgccaaccgactcgctgtctacgaggacctgttcgaccaaaacgtactcaaacaactcaaacgccgccactacacaggatggggcagactctcgaagcaattaatcaacggcatgcgagacaaacacaccgggaaaaccatactagacttcctgaaagccgacgggttcatcaaccgcaatttcatgcaattgattaacgacgacaacctatccttcaaggaggagattaagaaagcccaagaaggcggcttaaaagatagcatcaacgatcaaatccgcgacctcgcaggctcacccgcaattaagaaaggcatactccaaaccatcaacatcgtagacgaaatcgtaaaaatcatgggcaaggctccccaacacatcgtagtcgaaatggcccgagacgtccagaaaacagacatcggagttaagcaaagccgggaacgaatgaaaagagtgcaagaagtcctaaagaagctaggctcccagctgctcaaagaacaccccgtagagaacttccaactacaaaacgagcgactttacctatattacttgcagaatggtaaagacatgtatacgggggaggaactctccatctccaacctatctcactacgacatagaccatattataccccgctcctttataaaagatgactcgatagataacaaggtcctcacccgatcagaacacaaccgcggaaaaaccgacaacgtcccaagcattgaagtagtaaagcgcatgaagccgtactggcaaaagctactcgataccaaggtcatcagccaaagaaaatttgacaacctaactaaggcagaacgaggtggcctccaggaaagcgacaaagccaacttcatacaacgccaacttgtagaaacccgccagatcaccaaacacgtggctcagatactagacagccgcttcaacaccgaacgagacgagaaggaccgtccaatccgccgggtcaaggtaattacacttaagagcaaattcgtatccgacttccgacaagacttcggcttctacaaattacgggaaataaacgactaccaccacgcccatgacgcttaccttaacgccgtagtggggaccgccctcctgaagatgtacccaaaactcgcctcagagttcgtttatggtgactatcaaaagtacgacctcaaaagaatggtaggcaaaagcggaaaggcatccggacacgcaacggccaaatacttcttctactccaacctcatgaatttcttcaaaagcgaagtaaaacttgctaacggcaacataataaaacgaagtccgatcgaagtcaacgaggaaacgggggagatagtatgggacaaaaccaaagacttcggaacagttcgaaaggtcctctccgcaccccaagtaaacatagttaaaaagacggaaatacagaccggaggcttcagtaacgagacaatcctctctaaaggaaaatcgtcaaaactcatcccacgcaaaaacaagtggcgcgataccaccaaatacggcggcttcaatacacccaccgtagcttactccgtcctagtggtcgcgaaggtcgaaaagggcaaagcaaagaaactcaaaccggttaaagagctcgtaggcataaccatcatggaacgtactaaattcgaggccaacccgatagcattcctagagtcgaaagggtatcacgacattcaagaacacctgatgataacgctgccaaaatactccctattcgagctagaaaacggaagaaggcgcctcctggcctccgcaacagaactgcaaaaaggcaacgaaatggtccttccgcagcacctcgtcacgttcctctacagggtttcaaaacgcgacaaaggaacccaatccgaaaatatggagtacatctccaaccacaaagagaagttcatagaaatattccattacatcatcagatacgcagaaaagaacgtcataaagccgaaggtcatcgagaggctcaacgatacctttaatcaaaagttcaacgacagcgacttaacggagctcagcatatcgttcctcaacctatttaagttcacatccttcggagcccctgaaaaattcacgttcctaaactcagaaatcaagcaagacgacgtccgctaccggtcgaccaaggaatgcctgaactccaccctaatccaccaatcggtaactggtctgtacgagacgcgcatcgacctaagccaatttggcggggactga

SEQ ID NO: 6593 - RNA, 4107 nt, synthetic construct
  misc_feature 1..4107: note = Cas9 variant
  source 1..4107: mol_type = other RNA
atggataagaagtactctatcggcctggacatcggcacaaactccgtcggctgggcggtgatcacggacgactacaaagtgccctcaaagaaatttaaagtccttggaaacaccgaccggcacagcatcaaaaagaatctcataggcgcactcttattcgactccggcgagaccgctgaagccacccgactaaagcgaacagctcgcagaagatacacccgacgcaaaaacagaatttgctaccttcaagaaatcttctcgaacgagatagccaaggtagacgattccttcttccacagactcgaagagtcatttcttgtggaggaggacaagaaacacgaacgtcaccccatattcggaaacatagtcgacgaagtggcataccacgaaaagtacccaacaatataccatctgcggaagaaactagcggactcaaccgacaaagcggacctccggttgatataccttgcactggcccacatgatcaagttcagaggccactttctaattgagggcgacctaaatcccgacaactccgacgtagacaagctattcatccagctagtccaaacctacaatcaactcttcgaggaaaatcctatcaatgcctccagagtcgacgccaaagccatcctgtctgcccgactctcgaaatcccgccgactagagaacctgatagcacagctacccggggagaaacgaaacggcctcttcggcaacctcatagccctttctttaggccttacccccaacttcaaatccaacttcgatctggcagaagacgccaaactccaactttcgaaagacacctacgacgacgacctggacaacctgttagcgcagatcggcgaccagtacgccgacctctttttggcagccaaaaacctctccgacgcaatcctacttagcgatatcctacgcgtcaataccgagatcacgaaagcaccactatccgcctcgatgatcaaacgctacgatgaacaccaccaagacctcacactcctaaaggctctcgtccggcagcaactcccggaaaagtacaaagagatcttcttcgaccaatccaagaacggctatgcaggctacatagacggaggagcatcccaagaggagttctacaaattcataaaaccaatactagagaaaatggacgggaccgaggaactcctcgctaaactcaaccgagaagatctcctacgcaagcaacgcacattcgataacggatccatcccccaccagatccacctcggcgaactacatgccatcctacgtcgtcaagaagacttctaccccttcctaaaagacaacagagaaaagatagagaaaatactaacattccgaatcccctactacgtcggcccactggcaagaggcaacagccgtttcgcttggatgacacgaaagtcagaagaaaccatcaccccctggaacttcgaagaggtcgtagataagggggcctccgctcaatcattcatcgaacgcatgaccaacttcgacaaaaatctgccaaacgagaaggtactgcccaagcatagcctcctatacgagtatttcactgtctacaacgaactcaccaaagtgaaatacgtcacagagggaatgcgcaaaccggcattcctctcgggcgaacagaagaaagcgatagtcgacctcctcttcaagaccaaccgcaaagtaacagtcaaacaactcaaggaagactacttcaagaagatagaatgcttcgactcagtcgagatcagcggggtcgaggatcgattcaacgcgagcctcggtacatatcatgacttgctcaaaataataaaagacaaggacttcctagacaatgaggaaaacgaggacattctagaagacatcgtcctcaccttaacccttttcgaggatcgagaaatgatcgaagaacggctaaagacctacgcacacctctttgacgacaaggtaatgaagcaactaaagagaaggcgatacaccggatggggccgactctctcgcaaactcatcaacgggatacgcgacaaacagtcgggaaaaaccattctcgacttcctaaagtccgacggctttgcaaatcgcaacttcatgcaactaatacacgacgattccctcaccttcaaagaggacctacaaaaagctcaggtgagtggccaaggggactcgcttcacgagcacatcgccaacctagcaggttctccggcaattaagaaaggcatccttcagaccgtcaaagtcgtggacgagcttgtaaaagtcatgggccggcacaagcccgagaacatcgttatagagatggcccgcgaaaaccagacgacccaaaaagggcaaaagaactcgcgcgagcgaatgaaacgcatcgaggaaggcataaaggaactcggctcagacatactgaaagaataccctgttgaaacaacccagctacaaaacgagaaactatacctatactacctacaaaacggtcgagacatgtacgtcgatcaagaactcgacatcaaccgactcagcgactacgacgttgatcacatcgtaccccagtcattcctaaaagatgatagcatcgacaacaaagtcctgacaagatctgacaagaacagaggaaaaagcgacaacgtccccagcgaagaagtggtcaagaagatgaaaaattactggaagcagctactgaacgcaaagctgatcacccaacgcaagttcgacaacctgacgaaagcggagcgagggggcctgagtgaactcgacaaagccgggttcatcaaacgccaactcgtagaaacccgccaaatcaccaagcacgtagcccaaatactagacagccgcatgaacacgaaatacgatgaaaacgacaaactgatacgcgaggtacgagtgataacactgaaaagcaaactcgtcagcgacttccgcaaagatttccaattctacaaagtgcgagaaataaataactaccaccacgcccacgacgcctacctaaacgccgtagtaggaaccgcgttaatcaagaaatatcctaaactcgaatcagagttcgtgtacggcgactacaaggtctacgacatccggaagatgatcgcaaaatccgaacaggaaattggcaaggccacggcaaaatacttcttctactcgaacatcatgaacttcttcaagaccgaaatcacactcgcaaacggcgaaatccgaaaacgacctttaatagaaaccaacggagaaacaggcgagatcgtttgggacaaaggacgcgatttcgccacagtgcgaaaagtcctgtccatgccgcaagtcaacatcgttaagaaaacagaagtgcagaccggcggtttctccaaagaatccatcctacccaaacgcaatagcgacaaactcatcgcgcgaaagaaagattgggaccccaagaaatacggcggatttgactccccgacggtcgcatactccgtactcgttgtagccaaagtagaaaaaggaaaatcaaagaaactaaaatcggtcaaagagctagtcgggataaccatcatggaacgaagctcgtttgaaaaagacccggtggacttccttgaagcaaaaggctacaaagaagtgcgcaaagacctgattatcaaactcccaaaatactcactattcgaactcgagaacggacgaaaacggatgctcgccagcgccggagaactccaaaaaggtaacgaactagcactcccgtctaaatacgtgaatttcctctacctagcatcgcactacgaaaagctcaaggggtcgccagaagataacgaacaaaagcaactattcgtggaacagcataaacattacctcgacgagatcatagagcaaataagcgaattttcgaaaagggtcatactcgccgacgcgaatctcgacaaggttctcagcgcgtacaacaagcaccgagataaacccatacgcgaacaagcggaaaatatcattcacctcttcaccctcacaaatttaggagcacccgccgctttcaaatgcttcgacaccactatcgggaggaaccggtacaagtccatcaaagaggttttagacgcgacgctgattcaccaatcgatcaccggcctatacgagacgcgcatcgacctatcgcaactcggcggtgactga

SEQ ID NO: 6594 - RNA, 4107 nt, synthetic construct
  misc_feature 1..4107: note = Cas9 variant
  source 1..4107: mol_type = other RNA
atggataagaaatactccataggactagacattggcaccagctccataggcttcgtcggcgtcgacgaaaacgggtggccattaaacatcaaaggcaagagagcgatcggagcacatctattccgcgaaggcgaagccgcggcagaaacccggggattccgaacaacacgccgccgctacaaccggcgcaaatggcgacttagactgctacgggaaatatttgacgaaccaatttctcgagttgacccgaccttcttcgcgcgcatgaaagaatcctccgtctcgccaaaggaccccaactacgacggactggccaaagaaattctaattccgcgcgacaaagacggcaaaatactctacccgaccatataccaccttcgccacgccctaatgtacgaagatcatcaattcgacatccgcgaaatatacctcgccattcaccacatagtcaagtatcgcggccacttcttactcgacggggcggccaaaaatttcgaatcctcaaatctagacctcaagtccgacatccacgagatcaacgccatactggtaggaattttcggcaatgagcaagtccagttcaacgaccaatatgtggagaaactcaaggaagtgctccttgattccactcaatcccgctccgacagacagaaagcagccgccaaactactactacccaccaacgacctcgacaaggacactacgaaaatccttaagaccgtgagtacagagatcaccaaggccatcacggggctgaaagcaaagttctttgtcatcaccggaaacgatattgccaaagaccaacaaaaggactggacattctcgattgacactctggacgaaaagatgtctgtcatcgaaccctcttttagcgagaaaaactttagtctcataaccatactacagaaactatactcttccgtcacactcgcaggcattgtcccaaacgggctctcgctgtcggaagccatgatccaaaaatacgatcgacacgcctcagacctcgtacttctgaagaaatactgggacacaaaaccaaaagttctaaaacaccaactccaaaatacgtacgccgagtacatcgaaatccaccaagtcgtagacgagttctacagcgacctcagcaaactaatcaaaaacgacgacgacacactggcccaagaaataaagagcaaaataactatcggcaatttcctccccaagcagaggacaaccgaaaacggcgtgataccctaccagctgcagcagcgggaactagacacgatcatcaaaaaccagcaggagtactacccgtggctcgcagaagaaaaccccgtcgccgaccaccaaatagccttcccctacaagctcgacgagctagtcgggttcagaatcccttattacgtcggccccatgatcgccaaagaagatacatcaaattcaaagaactccaagttcgcctggatgattcgcaaacagtctggtgaagtcaccccctggaacttcgacgaaaagatagaccgcacagctagcgctactgccttcatagaccgcatgaccactaccgacacctacctaattggagaggacgtcctacccaagcaatccctgatataccaaagattcgaggttttgaatgaactgaacaaaatctctatagacggccaacccatcacgcggaaacaaaagcagtcagtctacacacacgtgttcgagaaaaagaaaaccgtacaggtcaaagacgtccaaaaattcctcgtaagctcaggcgaagtaatgtccctcccaaaaataggtggacttgcaaatgaaaagcagttcaactcatcactatcgacactctatgactacaacaaaattatccccgacgcgcttgaagaccgcaacaaagtagacgacatagagaaaatcatcctctggtcgactattttcgaagacaattccattttcgttgaaaaattggactcgatagactggcttacctcctcccaacggaaacgactagcccaaaaacgatacagaggctggggaagactctccctccgactgttgaccacattcaagaataaagacggctacagcatcctcgacgaactttggaactcgaaccacaacttcatggaaatccaagcccagtccgatttctccgagcaaatagccacggcgaataacaacaacctctcccaagtcctccctgccaaatgggaaccaggacgcaaaaacctagcatcactggatgaatttatctcaaatctctacacctccccacagaacaagaaagcgcttcgaaaagccatccgcgtcgtccaagacatgatgacagccgccggacacatgcccgagaaaattttcatcgaagtcgcacgcgacacctccaatagccaccagcaaacgatagcacgccaacgtcaactacaacaactttaccaatccgaggacaaagaggtcatcgactcctccgtccggagcgagttagacgacatcctaaagaaccgagccaacatcaaagaccaactcttcctgtatttccagcaaggtggtcgtgacctctacacgggaaaagctataaacatagacaaactatccctctaccatatcgaccacattctcccacaatccctcgttaaggacgacagcctcgacaaccgggtactcgtgagtcagaaaaccaacgaagacaaaggcgtgaccttcgtttcagacaaatacatgaacaacatgttacccacatggaaacgctggcacgaaatgggcctgatttccgcccgaaagctcaagaacctaacaatgcgcccagacgaaatcgataaatacgcccccggcttcatccagcgccagctcgtcgaaacgagacaggtcactaagctagtcatcgagctcctcgacgcattacttggaaactcccaaacagaaatcataactataaaagcctccctcagccatcagttcagacaacaattcgacctagttaagatcagagaagtcaacgacaatcaccacgccttcgacgcattcttggccgcccgcatcggcacctacctatacaaacgctaccccaagctccgcccttacttcgtctacgggcaatacatgcaaaatcataaaaacctaaaatccatcaacttaattaaaaccctcgacagcgacaaggcaattgtagacgaaggcaccggcgagatcctatgggacaagaaaagcgaccttgccaaaatgatcaagatctacaactatcaacggctgctcataacacacgaatcaaggaccagcttcggcgcaatgtacaaacagaagatcctcaaagcgaccgatgcgaaacaaaacggaggcggctttaagctagtacccacaaagcgcaacagacccgtagacatatacggcggctacacaggacaaaccgccgcctacctgacaatagtccgcgtctacagtaaaaagacgtcagaacttagagtactacccatatacacaaacaaagtacagcaaatcgaaaaagccatgacccaaggagacaaggcaaccatgctagcatttaaaaaggtcatcgcaccccaactaggaaaagagaacaagaaaacgcatgaaatcaaaatccccgagttcgatgtggtaatccccaaagttcttttagaccaacttgtcatagacgacatagcaggttcgccacaccgatttcgccttggcaccgacacctactatcacaactcacaacaactcttcctccctttaagcatgcagcgtcagctcatggatcgggaaagtgatgataaagtctacctcgacatcttcaacgacgttctgaaacaggttgacagctacttcaacctctacgacgtcaatggcttccgagccgcgctacagaaaagcaaaaaggcattcgaacaactccctatcaacgacttcccaaaggacgtccccgacaacaagaagaagaaaggcaaacgctctatcctaaaagaaatcttcatcggactccatgccaacgccacactcggaaaccttaaacagatgggtatcaaaaccgacttcggcaaactccagaaatcgaacgggctccgcatcaccgaaaactgcaaaatcatccatcagagccctacaggccttttcgaacgcattgtacccattaaatga

SEQ ID NO: 6595 - RNA, 4107 nt, synthetic construct
  misc_feature 1..4107: note = Cas9 variant
  source 1..4107: mol_type = other RNA
atggacaagaaatattccattggcctcgacatcggcacaaattcagtcggctgggcagtaataaccgatgactacaaagtcccgtccaaaaagttcaaggtactcggcaacaccgacaggcactcgatcaagaagaaccttattggcgcacttctcttcgacagtggggaaatagccgaagccacacgactcaaacgtaccgcacggcgcagatatacacgtaggaaaaaccgaatctgctacctccaagaaatcttcagcaatgaaatggccaaggtggacgactcattcttccaccgccttgaggagtcctttctggtcgaagaagacaagaaacacgaacggcaccccatcttcggaaatatagttgacgaagttgcctaccacgaaaaataccccaccatctaccacctcagaaagaaattagtggactccaccgacaaggcagacctaagactgatatacctcgcactagcccacatgatcaagttccggggccacttcctaattgaaggcgacctcaatccagacaactccgacgtagacaaactgttcatccagctagtccaaacatacaaccaactcttcgaagagaacccgatcaacgcgagcggagtggacgcaaaagcaattctctccgcccgactctcgaaaagccgaagacttgagaacctcatagcccaactccccggcgaaaagaaaaacggtctcttcgggaacctcatcgccctttcactcggtctcacgccaaactttaaaagtaacttcgacctcgccgaggatgcgaaactccaactctccaaagacacatacgacgacgacctcgacaaccttctggcccaaataggggaccagtacgccgatctattcctcgccgcgaagaacctctcagacgcgatcctgctgtccgacatacttcgactaaactctgagatcacaaaagcacccctctcagcaagcatgatcaagcgctacgacgaacaccaccaagacctaacgttgctaaaagccctagttcgccaacagctgcctgagaaatataaagaaatcttcttcgaccaatccaagaacggatatgccggatatattgacggtggcgcaagccaggaagagttctacaaattcatcaaacccatcctcgagaaaatggacggaaccgaagaactgctcgcaaagctcaaccgagaggacctcctacgcaagcaaaggacctttgataacggaagcataccccaccaaatccacctcggggagctacacgccatcctgcgaagacaagaagacttctatccattcctaaaagacaaccgtgagaagatcgaaaagatacttacattccgaataccctactacgtaggaccgctggcaagaggaaactcccgcttcgcctggatgacgagaaaatcggaggagaccataacaccatggaacttcgaggaagtagtcgataaaggagctagcgcacagagcttcatcgaacgcatgacaaactttgataaaaacctcccaaatgagaaagtactccccaagcactccctgctatacgaatacttcacagtctacaacgagctcaccaaagtgaagtacgtgaccgaaggcatgcgcaaacccgcgttcctaagcggggaacaaaagaaagccatagtcgacctactattcaagacgaacagaaaggtcaccgtcaaacaactaaaagaagattacttcaaaaagatcgaatgcttcgacagtgtcgaaataagcggtgtagaagatcgattcaacgcgtcccttggaacctaccacgacctcctaaaaatcataaaagacaaagacttcttagataacgaagaaaatgaggacatcttggaggacatagttctcaccctcacactgttcgaagacagggaaatgatcgaggaacgcctcaaaacctacgcccaccttttcgacgacaaagtcatgaaacaactgaaacgccgccgctacacagtctggggacgattaagccgcaaactaataaacggcatacgggataaacagtcaggcaaaacaatcctggactttctgaagtcggacggattcgcgaaccggaacttcatgcaactcatccacgacgactcgctcaccttcaaagaggacatacagaaagcacaagtaagcggccagggagacagtctacacgaacatatcgccaacctcgccggatccccagcaattaaaaagggaatcctccaaaccgtaaaagtcgtcgatgagttggtgaaagtcatgggcagacacaaacccgaaaacatagttatcgagatggcccgcgaaaaccagaccacccaaaaaggacaaaagaactcacgagaaagaatgaaacggatagaagaaggtataaaagaactcggaagccagatcctcaaagagcaccccgtcgaaaacacacaactgcagaacgaaaaactatacctctactacctacaaaacggccgcgacatgtacgtcgaccaggagctcgacataaatcggctatccgactacgacgtagaccatatcgtaccccagtccttcatcaaagacgactcaatcgacaataaggtcctcacccgatccgacaagaaccgcggcaagagtgacaacgtaccttccgaagaggtcgtaaagaaaatgaaaaactactggcgccagctcctaaacgcaaaacttatcacccaaagaaagttcgacaacctaactaaagccgaacgagggggcctcagtgaattggacaaggcgggattcatcaaacgacaactcgtggaaacccgacaaatcaccaaacacgtggcccaaatactagatagcagaatgaacacgaaatacgacgagaacgacaaactaatccgcgaagtgaaagtcattaccttaaaatctaagctagtaagcgacttcagaaaagacttccaattctacaaggtacgggagatcaacaactaccaccacgcccacgacgcctacctaaacgccgtagtaggaactgctctcataaagaaataccctaaactagagagcgagttcgtctatggagattacaaggtctacgatgtcagaaagatgctcgcaaaatccgagcaagagatcggcaaggccacggcaaaatacttcttctatagcaacataatgaactttttcaagacagaaatcactctcgcaaatggcgaaatcagaaaacgccccttgatagaaacaaacggcgaaaccggcgaaatagtctgggacaaaggccgcgacttcgcaactgtccgaaaagtactgagcatgccacaagtcaatatcgtaaagaagaccgaagtacaaacaggaggtttctccaaggaaagcatactgcctaagcgcaacagcgacaaactcatagcccgcaaaaaggactgggacccaaagaaatacggaggcttcgactccccgactgtcgcctactctgtcctcgtggtagcaaaagtcgagaaaggaaaaagcaagaagctaaaatcagtcaaagagctcctcggcatcaccataatggaacggagctccttcgagaaaaaccccatcgactttctagaagccaaagggtataaagaagtgcggaaagacctgataatcaaactaccaaaatactccctgttcgaactcgagaacggccgcaaaaggatgctagcgtcagccggtgaacttcaaaaaggaaatgaattagcactcccaagcaagtacgtcaacttcctgtacctcgcaagccattacgaaaagctgaaaggaagccccgaagacaacgaacaaaaacaactgttcgtagaacaacacaaacattacctagacgaaatcatcgaacaaatctccgagttctcaaaacgtgtgatcctggcagacgccaatctagacaaggtcctcagtgcatacaacaaacatcgagacaagcccataagagaacaagctgagaacatcatccacctattcaccctcacaaacctgggcgccccgacagcattcaaatatttcgataccaccatcgaccgaaagaggtacacctcaacaaaggaagtgctcgacgcgaccttcatccaccaatccatcacgggactctacgaaacacggatcgatctcagccaactaggcggcgactga

SEQ ID NO: 6596 - RNA, 4107 nt, synthetic construct
  misc_feature 1..4107: note = Cas9 variant
  source 1..4107: mol_type = other RNA
atggacaagaaatattcaatcggtctcgacatcggaacgaacagcgtcggatgggccgtcatcaccgacgactataaagtacccagcaagaaattcaaagtcctgggcaacacggacagacactcgatcaagaaaaacttaatcggggccctcctgttcgactccggcgagacggccgaagcgacacgactcaaacgcactgcacggaggcgctacacccggcgcaaaaatcgaatatgctacctacaggagatattctcgaacgagatggcgaaagtagacgacagctttttccaccgtctagaagagagcttcctagtagaagaagacaagaaacacgaaaggcacccgattttcggcaatatagtggacgaagtcgcctaccatgagaaatacccgaccatctaccacctacgtaaaaagctagtagactcaacggacaaagcagaccttcgactcatctacctcgcactcgcacatatgatcaaattccgaggacacttcctcatagaaggcgatctaaatcccgacaattccgacgtcgacaaactctttatccagctggtccaaacgtacaatcagctgttcgaagagaatcccatcaacgcatccggagtcgacgcgaaagccatcctatccgcgcgtctcagcaaaagcagaaggctcgagaacctcatcgcccaactaccaggagaaaagaaaaacggcctatttggcaacctaatcgcactctccctcggattaacaccaaacttcaaaagtaatttcgacctcgccgaagacgctaaactccaactcagcaaggacacatacgacgatgacttagacaacctcctggcccaaataggagaccagtacgccgacttgttcctggccgctaaaaacctatcggacgcaatccttctctcagacatcctgcgactcaactcggaaatcaccaaggcacccctcagcgcctctatgatcaaacggtacgacgagcatcaccaagacctcaccctcctaaaagcgctggtacgccaacaactgcccgaaaaatacaaagaaatcttcttcgaccaatccaaaaacggctacgcgggctacatagacggcggcgcgtcacaggaggagttctataaatttatcaaacccatactcgagaaaatggacggcaccgaagaactgcttgcaaaattaaatcgtgaagatctccttcgtaagcaaagaacgtttgataacggctcaatcccacaccagatccacctcggggaacttcacgcgattctccgcagacaggaagacttctaccctttcctcaaagacaatcgggagaaaatagaaaagatactcacattccggatcccctattacgtcggccctctcgcccgcggcaattcccgcttcgcctggatgacacgtaaaagcgaagaaacaatcacgccctggaattttgaagaagtagtggataaaggggcatccgcacaatccttcatagaacgaatgaccaacttcgacaaaaacctgcccaacgaaaaggtcctgccaaaacactccctgctttacgaatacttcacagtttacaatgaactaacgaaggtgaaatatgtaacagaaggcatgcggaagcccgccttcctgtcaggcgaacagaagaaggcgatcgtcgacctcctattcaaaaccaaccggaaagtgacagtaaaacagctaaaggaagattacttcaagaaaatcgaatgcttcgacagcgttgaaatcagcggcgtggaagatcgcttcaacgcgagcttgggtacctaccacgatctgcttaagataatcaaagataaagacttccttgacaacgaggagaacgaggacatcctcgaggatattgtccttaccctcaccctattcgaggaccgcgaaatgatcgaagaaagactcaaaacctacgcccacctatttgacgataaagtcatgaaacagctcaaacggcgaagatataccggatggggacgactaagtcgcaaactcatcaacggcatcagagacaaacagtcaggcaaaacaatcctcgacttccttaagagcgatggcttcgcgaatcgtaactttatgcaactgattcatgacgactcgctcacctttaaagaagacatacaaaaagcacaagtctccggccagggagatagcctacacgagcacatagccaatctcgcggggtccccggcaattaagaaaggaatcctacaaacggtgaaagtcgtcgacgaactcgtaaaagtaatgggcaggcacaagccagagaacatcgtcatagaaatggcgcgagaaaatcaaacaacacagaagggccagaaaaactcccgcgagcgcatgaagcggatcgaggagggaatcaaagaacttggatcacaaatactgaaagaacacccagtcgaaaatacccagctccaaaacgagaaactctacttatactacctccagaacggtcgcgacatgtacgtcgaccaagaactagacatcaaccgcctctcagactacgacgtagaccacatagtaccccagagcttcataaaagatgatagcatagacaacaaagtcctcacaagaagcgataagaaccgcgggaaatccaataacgttccgagcgaagaagtagtgaagaaaatgaaaaactactggcgccaactactaaacgccaagctcatcactcaacgcaaattcgacaatctcacaaaagccgagaggggcggcctctcagaactcgataaagctgggttcatcaaacgacaactcgtagaaaccagacaaattactaaacatgtcgcccaaatcttagacagccgaatgaacacaaaatatgacgaaaacgacaaactaatccgagaagtcaaagtgatcaccctcaaaagcaagctagtctccgacttccgaaaagacttccaattctataaagtgcgcgagatcaacaattaccaccatgcgcacgacgcttacctcaatgccgtcgtgggcaccgcactcataaagaaataccctaaactagaatccgagttcgtctacggggactacaaagtctacgacgtacgaaaaatgatagccaaatctgagcaagaaatcggcaaagccacagccaaatacttcttctacagcaacataatgaacttcttcaaaaccgaaatcactctcgcgaacggagaaatacgcaaacgaccgctcatcgaaaccaacggcgaaaccggcgaaatcgtctgggacaaagggcgagactttgcaaccgtccgcaaagtactcagtatgccccaagtcaacatagtcaagaaaaccgaggtacaaaccggtggtttcagcaaggaatccatcctacctaaaagaaacagtgataaactcatcgcgaggaaaaaggactgggacccaaagaaatacggtggtttcgactcgccgacagtggcatacagcgtcctcgtagtagccaaagttgaaaaaggaaaaagcaaaaagctcaagtctgtaaaagaactcctcggcataacaataatggaacgaagcagcttcgagaaaaaccccatcgacttcctggaagcgaaaggatataaagaggtccgcaaagatctcatcgtaaaactcccaaaatactcgctgttcgagctcgaaaacggccgcaaacggatgctcgcgagcgcaggcgaacttcaaaaagggaatgaactcgccctacccagcaaatacgtgaacttcctatacctcgcctcccactacgaaaaactcaaaggatcaccagaagataacgagcaaaagcaactcttcgtcgaacaacataagcactacctcgacgaaataatcgagcagatctcggagttcagcaagcgggtgatcctggccgacgctaaccttgacaaagtcttgtcagcgtataacaaacaccgtgacaagcccatccgagagcaagcggagaatatcatccacttattcacactcaccaatctaggcgccccagcagcgttcaaatatttcgacaccaccattgatcgcaagcggtacaccagcaccaaggaagtcttagacgcaaccttcatacaccaaagcataaccggcctttacgaaacacgaatcgacctaagccaactcggcggcgactga

SEQ ID NO: 6597 - RNA, 4107 nt, synthetic construct
  misc_feature 1..4107: note = Cas9 variant
  source 1..4107: mol_type = other RNA
atgagccgcccatacaatatcggtctggacataggaacaagctccatcggatggagcgtcgtagatgatcaaagcaagctcgtctctgtccgcggaaaatacggctacggcgtacgtctgtacgacgagggacaaaccgccgcagaacgtcgcagctttcgcaccacccgaagacgactaaagcgccgcaagtggcgcctcgggctcctacgagaaatattcgagccctacataacccctatcgatgacacctttttcttacgccagaagcaatcaaacctctcacctaaagaccagcgcaaactctacacgcaaacgtccttattcaacgacagaaccgaccgcgccttctacgatgactaccctacgatctaccacctccgataccggctcatgaccgaaaagagacaatttgatatccgagaaatatacctcgccatgcaccacatcgtcaagtaccgcgggcacttcctgaatgaagcccccgtaagttctttcaaatcctcagaaataaacttggtagcccacttcgaccggctcaacaccattttcgcagacctcttctccgaatccggcttccaactcgaaacggacaaactcgccgaggttaaagcccttctacttgacaaccagcaaagcgcctcaaaccgtcaacgccaagctctctcgctcatctacaccccatccactaacaaagccgtagaaaagcagaacaaagcaatcgccaccgagctcttaaaggcgattcttggcctaaaggcgaaattcaacgtactcaccgggatagaagccgaagacgtcaaagcatggacgctaaccttcaacgccgaaaatttcgacgaagaaatggtcaaactcgaatctagtttagacgacaacgcccaccaaataatagaatccttgcaggaactatacagcggcgtactactagccgggatcgtcccggaaaaccaatccctatcccaggctatgatcaccaaatatgacgatcaccagaaacatctcaaaatgctcaaagcagtgcgcgaagccctggctccgggcgacaggcagcggctaaaacaagcctacgaccagtacgtcgacgggcaagaaaacacaaaagcctattccaaagaagatttctacggagacatcaccaaagcgcttaaaaacaaccccgaccacccaatcgtatcggaaatcaagaaactaatagaactagaccaattcatgcccaaacagcgcaccaaagacaacggtgccatccctcaccaactacaccaacaagaactcgaccgaatcattgagaaccaacagcagtactacccatggctcgcggaattaaaccccaactctaaacgtcagaccgtcgccaaatacaaactcgacgagctggtcgcatttcgcgtcccctactacgtaggaccactcatcaccgccgagcagcaacgccagagcagcgacgccaagttcgcatggctcataagaaaagcggaaggtcgcataaccccatggaattttgacgacaaggtcgaccgccaagcctctgcaaacgagttcatcaaacgaatgacaactaccgacacctacctcctcgctgaagatgtgctacccaaacaatctctcatttaccagcgattcgaagtcctgaacgaactcaatggccttaaaattgacgaccagccgatcacaaccgaactaaaacaagcgatcttcaccgacctattcatgcagaaaatctccgtgacagtgaagaacatacaagactacctggtatcggaaaagcgatacgcgagccggcctgcaatcaccggcctctcagacgagaacaagttcaacagccgattatccacctaccacgacctaaaaatgatcgtcggcgacgcagtggacgatgtcgacaaacaggcggacctggaaaagtgcatcgaatggtcgaccatcttcgaagacggcaaaatctattcggcaaaactaaacgagatagactggctcaccgatcaacagcgagtgcaactcgccgccaaacgatatcgaggctggggacgcctatccgcaaagctcctcacacaaatcgtcaacgccaacggccaaagaatcatggaccttctgtgggacacgaccgacaacttcatgagaatcgttcatagcgaagattttgataaattaatcacagaagccaaccaaatgatgctcgcagagaacgacgtccaggacgtcatcaacgacctctacacgtctccccaaaacaagaaagccctccgacaaatactgctcgttgtaaacgatatacaaaaagccatgaaaggccaagcacccgagaggatactcatagagttcgcacgtgaagacgaagtgaactccagactctcagtgcaacgcaagaggcaggtagaacaagtttaccaaaacatttcgaatgaactgctcaacaatacagaaatccgcaatgagctaaaagacctatccaacagcgcgctcagtaacacacgactcttcctctatttcatgcaaggcggccgggatatgtacaccggagactccctcaacatcgacagactcagcacctacgacatcgaccatatactaccccagagcttcataaaagacaacagcctggacaaccgtgtcctagtcagccaaaagatgaaccgctcgaaagccgaccaagtaccaacagacttcacatcggtggaacttggacagaaaatgcaaatacaatgggaacaaatgctacgggccggactgataactaaaaagaaatacgataacctgacactcaaccccgaccacatctccaaatacgcgatgaagggattcatcaaccgacagctagtagaaacccgccaagtcataaaacttgcaacaaacctactcatggaacaatacggagaagacaacatagagctaataacagtgaaaagcggtttaacccaccaaatgcggactgagttcgatttcccgaagaaccgcaacctgaacaaccaccaccacgcattcgacgcatacctcaccgcattcgtgggcttatacctacttaaacgttacccaaaactcaagccctactttgtgtacggagaatatcaaaaggcctcgcaacaagacaaatggcgcaacttcaacttcctcaacggcctcaagaaagacgaactcgtagacgaaaacacagaagccgtaatatgggacaaagagtccggactcgcgtacctcaacaaaatatatcaattcaagaaaatactcgtcacgcgaggcgtgcacgaaaacagtggcgccctcttcaaccaaacactatatgcggccaaagacgacaaagcatccggccagggaggcaaacaactcatccccgcaaaacaagatcgctccaccgcactctacggcgggtactccggcaaaacggtcgcatatatgtgcatcgtacgaatcaaaaacaagaaaggcgacctatacaaagtctgcggtgtagagacttcctggctagcacagctcaaacagctaacggatgaagattcccagaaagccttcctcgaacagaaaatctccccacaattcactaaagtgaagaaacagaagggcaacatcatagaagccgtcgaggagtttgaagtaatcgcaccccatatcctgatcaatcaacgattcttcgacaatggccaagaactaacactcggatccgccacatacaaacacaacgagcaagaactgatcctagacaaaacagctgtcaaattgctgaacggagccctgccgctgacacaatcagaagaactcgccgaacaagtatacgatgaaatattggaccaagttatgcactacttccccctgtacgatacaaaccagttccgagcaaaactgtcaacaggcaaagccgccttcatgaagctcccatggaaaagccaatgggacggaaacaaaatggtccaagtaggccaacaagtcatactagaccgtattctcatcggactccatgcgaacgctgcaatgtccgatttaaaagtactcaaaatgacaacacccttcgggatgattcagcaatccacaggcatcacgctatccgccgatacacagatcatctaccaatcacccaccggcctgttcgaacgaagggtagcgctacgcgacctctga

SEQ ID NO: 6598 - RNA, 4107 nt, synthetic construct
  misc_feature 1..4107: note = Cas9 variant
  source 1..4107: mol_type = other RNA
atggataagaaatactcaataggcctcgacataggcaccaactctgtcggctgggccgtcataacagacgactacaaagtccccagcaaaaagttcaaagtgcttggtaacacagaccgacattccatcaagaaaaacctcataggcgccctcctatttgactcgggtgaaacagcagaagcgacacgactaaaacggaccgctcgccgcagatacacgcgccgaaagaacagaatctgctacctccaggaaatctttagtaacgaaatggcaaaagtagacgactctttcttccaccgactagaagaatcatttctcgtggaagaagacaagaaacacgaacgccaccccatcttcggcaacatcgtagacgaagtcgcctaccacgaaaaatatcccaccatataccacctacgcaaaaagctagtcgattcaactgacaaagcagatctcagactcatatatctcgccctagcgcacatgatcaaatttcgcggacacttcctcattgaaggcgacctcaacccagacaacagcgacgtcgacaaactattcatccagctcgtccaaacctacaaccaactattcgaggagaatccgataaacgcgtccggggtcgatgcaaaggccatcctttccgctcgtctatcgaaatcacgacgactggaaaacctgatcgcgcagctccctggggagaagaaaaacggactgttcggaaatctaatcgcactctcactcggactgacccccaatttcaagtcaaacttcgacctagcggaagacgccaagctacaactctcgaaagacacgtacgacgacgacctcgacaacctcttagcacaaataggcgaccaatatgctgacctgttcctcgcagcgaagaacttatccgacgccatcctcctaagcgacatcctaagactcaactccgaaatcactaaagcgcccctcagcgcaagcatgatcaagaggtacgacgaacaccaccaagatctaacattactcaaagcgctagtacgccaacagcttccagagaaatataaagagatattcttcgatcaatcgaaaaacggatacgcaggatacatcgacggaggagcatcccaggaagagttctacaaattcatcaaacccatactcgagaaaatggacggcaccgaagaactgcttgccaaactcaaccgagaagatctcttgagaaaacagcggacctttgacaacggatcgattccacaccaaatccacctaggcgaattacatgcaatcctcagaaggcaagaagacttctacccatttctgaaagacaatcgcgaaaagatagagaaaatcctcacttttcgaatcccgtactacgtaggtcccctggcccgcggaaacagccgattcgcttggatgacccggaaaagcgaagaaaccataaccccctggaatttcgaagaagtagtcgacaaaggggcatccgctcagagcttcatcgaacgcatgactaacttcgacaaaaacctccccaacgaaaaagtcctacccaaacacagcctcctatacgaatacttcacagtctacaacgaattaactaaagttaaatacgtcacagaaggaatgcgcaaacccgccttcctgtcgggagaacaaaagaaagccatcgtcgacctactattcaaaaccaacagaaaagtcaccgtcaaacaactcaaagaagattacttcaagaaaatagaatgcttcgacagcgtagaaatatccggcgtcgaagaccgattcaacgcttccttgggaacctaccacgacctacttaaaatcatcaaagacaaagatttcctcgacaacgaagaaaacgaggacatactcgaggacatagtgttgaccctaaccttatttgaagaccgtgaaatgatcgaggaacgcttaaaaacatacgcgcacctgttcgacgacaaagtcatgaaacaactgaaacgtcggcgatacactggctggggccgactgtcgagaaaactcatcaacggaatcagagacaagcaaagcggcaaaaccatcctcgactttctcaaatcagacgggttcgccaaccgcaacttcatgcaactaatacatgatgactctctcaccttcaaggaagacatccaaaaggcccaagtgtccggacaaggcgactccctacacgaacacatcgcgaacttggccggctctccggcaatcaagaaaggcattctccaaaccgtcaaagtggtcgacgagctagtaaaagtaatgggcagacacaagcccgaaaacatagttattgaaatggccagggaaaaccaaaccacccaaaaagggcagaaaaattcgcgagaacgcatgaaacgaattgaggagggtatcaaagaactgggctcgcaaatcctcaaggaacacccagtcgagaacacccaactccaaaacgaaaaactgtacctttactatctccaaaacgggagagacatgtacgtcgatcaagaactagacataaacagactctcagactacgacgtggatcacatcgtcccccaatcatttataaaagacgactccatagataacaaagtccttacccgctccgacaaaaaccgcggaaaatcggacaacgtcccatcggaggaagtcgtcaagaaaatgaaaaattactggcgccaactcctgaacgccaaactaataactcaacgaaagttcgataaccttaccaaagcagagcgtggcggactgtccgaactcgacaaagccggcttcatcaaacgccaactggttgagacacgccaaatcaccaagcatgtggcccaaatcctggactcccgaatgaacaccaaatatgacgagaacgacaaactcatacgtgaagttaaagtaatcacgctcaagagtaagctagtatccgatttccgcaaagacttccaattctataaagtccgcgaaatcaacaactaccaccacgcccacgacgcgtatttaaacgctgtcgtaggtacggccctaataaagaaataccccaaactcgaaagcgagttcgtctacggcgactataaagtatacgacgttcgtaagatgatcgcaaaaagcgaacaggaaataggaaaagcaacggccaaatactttttctacagtaacatcatgaactttttcaaaacagaaatcacgctcgccaacggggaaatacgaaagagaccactcatcgagaccaacggggaaacgggtgaaatcgtctgggataagggtcgagacttcgctacagtgagaaaggtcctaagcatgccccaggtcaacatcgtgaagaaaacagaggtgcaaaccggtggcttctccaaagaatcaatcctgccgaaacggaacagcgacaagctaatagcccgaaagaaagactgggacccgaagaaatacggcggctttgacagcccaaccgtggcgtactccgttctcgtggttgccaaagtggaaaaaggaaaatccaagaaactcaaaagcgtcaaagaactcctgggactaacgatcatggaacgatcatctttcgagaaaaacccaatcgatttcctagaagccaaaggctacaaagaagtcaagaaagacctcataattaaactaccgaaatacagcctattcgaactagaaaacgggcgaaagcgcatgttggcaagcgccggagaactccaaaagggcaacgaactcgcgctaccgagcaagtacgtaaacttcctatacctagccagccactacgaaaaactaaagggaagtcctgaagataacgagcaaaaacaacttttcgtcgaacaacacaagcactacctcgacgagattatcgagcaaatatctgagttctccaaacgagtcatcctagcggatgcaaatctcgataaggtcctctcagcgtataacaaacaccgggacaagcccatccgagaacaagccgagaatataatccatctgttcacactaaccaaccttggtgcaccagccgcatttaagtacttcgacaccaccatcgaccggaaacgctacacaagcacgaaagaagtcctggatgccaccttgatacaccagtcaataacagggctgtacgaaacccgcatcgacctaagccagctcgggggtgactga

SEQ ID NO: 6599 - RNA, 4110 nt, synthetic construct
  misc_feature 1..4110: note = Cas9 variant
  source 1..4110: mol_type = other RNA
atgaaacggatacttggactagacctcggtacgaactcaatcggctgggcactcgtaaacgaggcagaaacagtcaacgagaaatcgagtatcgttaaacttggagtcagggttaatccactaaccgtcgacgaacagaaaaatttcgaggcgggaaaaagcatacccacgaacgcaggacgaacactcaaacgaggaatgaggcgcaacctccaaagatacaaacttaggcgagactacctcatccaatgtctgaaggaatacggctggataacttcagacacactactatacgagtgtggaaatcgcaccaccttcgaaacatacaggctgcgtgcaaaggctgttgacgaggaaattgcactagaggaactcggcagggtcctcctcatgattaacaagaagcgcggctacaaaagcaacagaaaagccaaaagcagcgacgaaggccagctgatcgacggcatggcaatagccatggacatgtaccacaatggtaccacacccggagaatacgtatattccctcctatcaaaaggaaagaaatacatacccgtcttttaccgcagcgacctcttggacgaatttgaccgcatatgggactaccagtgcgcctactaccccgacatcctcacctcacaattcaaggaactcatacgaggcaaaagcagccaagtgacgtcaaaactattcaaacaacaatacaacctattcaccgcagacaacaaggaaaaggataagcgcctgcaggcgtactgtcgacgcgcggacgcgctcaagaaacgccttccagtcgaagaagtcgcggccgcactatgcgatgtcaatcgcgacgtgaacgcatcctccggctacctcggaaccataagtgacagatccaaaaagctattcttcaacaaacaaaccgtgggacagtacctcatgctcgaactagacaaagacagccacttctcagtcaaaaacgaagtattctaccgacaggactacctaaacgagttcgaggcaatctgggaaaaacaagcagaataccacccagaactaactcctgaccggaagaagatactacgcgatgtcgttatcttctaccagcggccgctcaaaagccaaaaagacttagtcgcctgttgcgaactggaacgcagacgcatcgaggtgatgaaggacggaaaagtccgctcggtcgaaataggcccaaaagtatgccccaaatcatcacccctcttccaagacttcaagatctggcatgtactcaacaacctgaaagtacgtgacaaggcaacgggagatgagagattcctagaactcgacgaaaaagaaatattgttcagtgaacttgcgatcaaaagcaaactctcaaaaactgaagcgctgaaactactctaccaaaaaccaaaaggactggacctcaactacgacagcgtagagggcaatacaacgcaagctgcgctatttgaagcctaccaaacagtcatcgccatgaccggccacggagaatacgtcttctctaaaatgagcgcatcggaagttatgtcggtcgtcgaaggcgtatttggaggactaggtttcaacacaagcgttctaagattcgacagtctactgcaagggaaagagctagaaaaacaagacagctacaggctgtggcatctcctctactcctacgagggggataacagtgtgaccgggacagacggactcgtcgcaaaagtcgcaagcctcctacgctgcgacgaagaatatgccaaggtggtcgccggggtcacattccagcccgactacgggtcattatcggcaaaagcgatacgaaggatcctcccgcacatgcgtgcggggaacgaatactcccttgcctgcgaatacgcaggctacaaacacagtcgccgcagcctcacaaaagaagaactagagcagaaggactacaaggaccacttggaactcctcccccgcaactccctccgcaaccccgtcgtggagaagatcttaaaccagatggtgaatgtagtcaacgccgtagtagacgcatacggcaaacccgacgaaattaggatcgagatggcccgcgaactgaagaaaagcgccaaggaacgcgaggagatgacagcggctatcaacaaagccaccagcgaacacgaaagaatcaaagaaatcctaaacaaagagttcgggatccaacacgtttcccataacgacatagtacgctacaaactgtactgtgaactaaagaacaatggctacaaaacgctatatagtgacacatacatcccacaagaaaaactcttcagcaaggaagtagacatcgaacacatcctgcctcaggcccgactgttcgatgactccttctccaacaagaccctagaataccgaagcgtcaacatcgagaaaagcaaccaaacagcatgggactatgtagcagccaagtggggcgaggaaggaagcctacgctacaagaaacgggtggacgacttactcgccgcgggcgtcataggaaaatccaagcacgataaacttctaatgaaacaagaagacataccgacagacttcatcaaccgagacctcagggatacccaatacattgcgaggaaagcgagggaaatcctcgaagacctagtacccatggtagtcagtacgaccggcgcagtgacggaccgactccgagaagattggcagctagtcgacgtcatgcaagaactaaactgggacaagtacgcgatgaagggcctcacagaagaatggaccgacaaagacggccgacggatctcacgtatcaaagaatggacgaaaagaaacgatcaccgacaccacgcgatggacgcgctcacgatagcgtttaccaaacactcgttcatacaatacttaaacaacctcaacgcccgcagcgacaaaagtgggtccatctacgcaatcgaacaaaaagaattgtatcgcgacaaccacggcaaactccgcttcatcatgccattcgaagggttccgttccgaagccaagagacaactggaaaatatcctcgtcagtatcaaggcgaaaaataaagtagtcacgcgcaacgtgaacaacgcccgacgaggtagcggccgtcaggcgaaagtccaactcaccccacgcggccaactacataacgagacaatctacggcagcatacacaggtacgtcaccaaacttgagaaagtaggcggaaacttcgacggcgagcaaatagccaaggtcgccaaccttaggtaccgagaggcgctacaagcccggcacgaggcatttggaggagacgcaaagaaagccttcacaggtaaaaacgcgctggataaaaaccccctgtatctaaaagacactaggacagaggtccccctaaaagtgaaaaccgtatcaacagaaaccttgtacacaatacgcaaagctgtggcccccgatctaaatgtagataaagttatagacgccaaggtccgtaaagtactggaagaacgcctccaggagtatggaggggatccgaagaaggctttcgtaaatctcgacgagaaccccatctacctgaacaaagccaagggcataacaatcaaacgagtagcaatcaccggcgtcaacaacgcgatcgcactacatgataagaaagacgtcggcgggcatgtcatgctcgacgcaagcgggcgaaaacaacctgtcgacttcgtgaacaccggcaacaaccaccacgtagctatttaccgagacgcagagggcagtctacaggaagtagtcgtcagcttttacgaagccgtggcccgcgtcagcctaggcctcccagtgatcgaccgagaatatcgaaaggaagacggctggcaattccttttcacgatgaagcaaaatgaatacttcgtgttcccaaatcccgaaaccggcttcaacccacaggaagtggacctgaccgatgagacgaactacgcactcatatccccaaacctcttccgcgtgcagaaattcacaatcaaagactacttcttccgccaccatcttgaaaccactgtcgaagacaggaaggaactcaaagacatgacatggaagaggtgtggcctcgggggtatcattgggatagtcaaggttagagtaaaccacataggccgaatagtatcggtaggcgagtactga

SEQ ID NO: 6600 - RNA, 4110 nt, synthetic construct
  misc_feature 1..4110: note = Cas9 variant
  source 1..4110: mol_type = other RNA
atggccaagacctacaacataggcctcgacatcgggacaaacagcatcggctgggccgtggttgacgatcaaaaccaccttatgagtatcaaaggcaagtatggctacggcgttagactatacgacgaaggaaaaaccgcggaggaacgacgatcattccggaccacgaggcgccgcctaaagagacggaaatggcgcctctcacttttgagagaaattttcgaaccccaaataactcccctcgacaacacgttcttcctgcgacaaaaacaaagctcgctcagttcaaaagacaaccgaaaactatacccggaaatgagtctcttcaacgacagaaccgacaccgacttttacacacagtaccctacaatctaccacctcagccgagacctaatgacaaagaacaaacaattcgacattcgcgaaatctatctagccatgtaccacattgtcaaataccgtggacactttttaaacgaaagccccgtctcctcattcaaatcgagcgaaattaaactcgccgaaaacttcgaaaccctaaaccaaatcttcaatgagaggtttaacgaatcaatgttccaactcgccgtcaacgactttgacgacctcaaggcattgctcctaaacgaccaacagagcgctagcaaccgacaaaagaaagcactagggatgatctacgtcccaaacgaaaacaaaagcctcgaaaaacagaacaaagcgatcgccacagaactactaaaagcaatactgggactcaaagcaaagttcaacgtcctaacaggaatagaagtggacgatgcaaaaccatggaccctatcctttaactcagagagcttcgacgaagacatcgacaaagccgccacaaacattgatgacgactccagagagatcatcgctatactacaaggcctctactccggcatactactcgccggaatcatcccagagaaccaatccttaagcgaagcaatggtcgaaaagtacgaccaacacgcagcccatcttaaacaattgaaatcaatctacccgctactcagcatctccgacaagaaagcaatccaacaggcatataactactacatagacggccaagacaacgccaaagcctactcaagggaagacttctatgccgccaccacaaaagccctaaaaagttatcaagacaacgaaaccatcgctgagatcctcaaactcattgaactcgagcaattcatgcctaaacaacgcaccaaagataacggtgccatcccccaccaattgcaccaacaggaattagaaagaatcatcgaaaaccaacaaaagtactatccttggctcgccgaactaaaccccaacgagagtcgaagaaaaatagcgaagtacaaactggacgaactcgtagcttttagagtgccttattacgtgggcccccttatcacttccgaacagcaacagcaatcaagcaacaagaaatttgcctggatgatccgcaaagccgaggggaagatcactccatggaacttcgatgaaaaagtagaccggcaggcctcggcgaatgagttcatcaagcgcatgacaacaaccgacacttacctcttggccgaagacgtcctacccaagcaaagtctcgtgtaccaacgtttcgaagtcctcaacgaactaaacggaatcaaaatcgacgatgtcccgataacggtcgaacaaaaacaacggatattcaacgacctcttcatgatgcaagccagcgtatcggtgaaaaatatacaagactacctcgttagcaaagggtactttgcgtccagacccgagataacaggattaagcgacgaaaacaaagtcataagcagactgtctacctaccacgacctgaaagcgatcctcggaggcattgtagacgaagcgaacaaacaggcagacctcgagaaatgcgtcgaatggtctacaatattcgaggacggaaagatattcgtcgaaaagctcaacgagatagaatggctaaccgacgagcagcggaagcgcttgtcgagcaaacgctaccgtggctggggccgcctcagtaacaaactcctcaaccaaatcgtaaacgaaaacggccaaaggatcatggaccttctctgggacaccaccgacaacttcatgcgcatcgtccactcggaagagttcgataaactaatatctgccgcaaaccaaacccttctttccaaaaatgacgtacaagacgtaatcaacgacctgtacacgagcccgcagaacaagaaagccctccgccaaatcctcctcgtagtctcggacatccagaaagcaatgaaaaaccaagcaccctcgaaaatactaatcgaatttgcacgcgaggatgaagccaaccccaggctgtctgtccaacgcaaacgccaagtcgaacaagtataccaaaacatttcgaaagacatcctttcagacagcgacgtaaaagccgagctgaaagacctaaccaataccgcgctcgcgaacacacgcctgttcctctatttcatgcagggtggacacgacatgtacaccggcgagaccctcaacatagatcgccttagcgaatatgacatcgatcacattctacctcaggccttcattaaagacaacagcctcgacaaccgagtactcgtctcagccaaaatgaatcgctctaaaagcgaccaagtaccactgaacgactataccgaagaaagatttggatccaagatgcgtgtccaatgggagcagatgctcagagccggcctcataaccaaacgcaaatacgacaatttaaccctaaacccagaccgaatctcgaagtacgctatgaaaggattcatcaaccgtcaactcgtagaaacgcgccaagtgatcaagctagtcaccaatctcttaatggaccactacgaggacgacgaggtacaactaattaccgtcaagtccggactaatccaccaaatgcgagagatgttcgacttccccaaaaaccgtaacctaaacaaccaccaccacgcattcgacgcatacctaaccgcatttgtcggtatctacctcctcaagcggtaccccaaactaacgccatttttcgtctacggctcgtaccagaaaaacaacacgaacgacaagtggcgcaacttcaacttcctaaatgacctcaaaaaggaggaagtcatcgattcagactcccacgaagtcatctggaacaaagcacaggggctagtagagctagacaagatctaccagttcaagaagatcctagtaacgagggaagttcacgaaaacacgggcgcgctctacaaccagaccctatactccgccaaagacgacaaagcatccggacaaggcggcaaacaactcatccccgccaaacaagaccggcccactgcgctatacgggggatacagcgggaagaccgtggcctatatgtgcatcgtgcgtattaaatccaagaaagaagacacctacaaagtatgcggcgtcaagacatcctgggtagccgaactagaacgactctccgacagcaatgaacagctagccagcttgaaggcgaaactgatgccaaaattcaccaaaaacaagaaacaaaaaggcaaaactattcaagtcacagaagactttgagatcattgtaccccgcgtactcatcaaccaacgcttctacgacaacggtcaagaaatcactctaggaagcgcaacctacaagcacaatgaacaagagctaatgctaaataagaaagccgtaaaattacttaatggacaacttagcctcgtggaagcagaaacactggcaccccaagtctacgacgagatattaaaacaagtcatgaaatacttccctctctatgacacaaaccaatttagaaccaaacttaaaatgggcaaagagcaattcataaaactaccatggaaaaacaagtgggacggcaacaaactcatacacgtcggccaacagaccgtcctagaccgaatactcattggattgcacgcaaacgccgcggttagcgatctaagcaccctaaaagtaacgaccccatttggcaaactccaacagccctcagggattgccctatcgctaaacacaaaaataatctaccaaagccccaccggcctattcgagagacgcgttgccctccgcggactctga

SEQ ID NO: 6601 - RNA, 4110 nt, synthetic construct
  misc_feature 1..4110: note = Cas9 variant
  source 1..4110: mol_type = other RNA
atggataaaccctacaacataggcctagacattggcagccactcaataggatggacagtcgtcgacgacaactccaaactcgtacgaatcaaaggaaaattggggtacggtgtcagacttttcgacgaaggcaagacagctgaagagagacgtcagttccgcacaacccgccgccgcctcaaacgacgcaaatggcggctgcgacttttacgcgaaattttcgaacctcacatcgcgcccctcgacgagacattcttcctgcgacaaaaacagtcaaacctagtaccgacccaaaagaaactcccccaattatcactcttcaacgaccggagcgacgccgagttctaccacaaataccccacgatataccacctccgaaacgccctcatgacagaaaaacgccagttcgacctacgcgaaatatacctcgcgatacaccacatcgtgaaatatcgaggacacttcctaaacgccgctcccgccgcctccttcaaatccggcaaattcgacctcgaaaataaatttgaccaactaaatctcctcttcgcttccgcctattcagacctcgacttcacacttcgcacagataacgtggatcaggtcaaagcgatcctcctaaatgaagacttatccgccagcacgcgccaacgtcaagcactccccctcatctaccaaacttccgcggaccaaaaagccgccaagaaactcacgaaatccctagcaaccgaactcctcaaagctatactaggcctaaaggcaaaattcgacgtcctcacaggaatagaaacagacgacaccaaagcatggaggctaactttcaacgccgaagacttcgacgacaaactaaacgaactcaatgtcacagacaacgaagcagcaacacaaataatcgagatccttcgcgaactgtactcctccatcctcctggcggcaatcgtccccgagaactataccctctcacaagcaatgatggcaaaatacaacgcacacaaacaacacctctccctactgagacaagtaaaaaccaccttaccagcaaagaagcagaaagaactgcaggccgcctacgacgactacatcgatcaacacctcccacttgacaaattttatgcgaagttgacaaaagtcctacccaaagaaaaggacacagataatccccaaataatacagatactcaacctaatagacctagaccaattccttccgaaacagcgaacaaaagacaatggagcaataccccaccaattacaccaacaagaactcgatcagataatagacaaccagaaggcctactacccatggctagcgcaactaaaccccaacgagaaacgacagaaaatagcgaagtacaagctggacgaactggtcgccttccgcgtgccttactacgtcggtccgttaatcgaggccaagactcaacaaaagacctcaggcgccaactttgcatggatgatacgaaaggaacccggtacaacaacgccaatcaccccatggaatttcgacgaaaaagtcaaccggcaggcatcagctaacgaatttatcaaacgcatgaccacgacagacacgtacctcctgggcgaagatgtactccccaaacactcgctcctataccaacgcttcgaagtcctcaacgaactcaacggaataaaaatcgaccaaaagcgcgtcacggtccgccaaaagcaagccatctttaacgacctgttcctcaaacaaccgaacgtcacagtgaagaaactccaacaatacctccaagcgaagggcgaatatgcctccgcaccaataataaccgggctgtcagaccccaagaaatttaattcgcagctgtctacgtatcacgaatacaagaagatattcggcggcctcatagatgatccggataagcaagcggactttgaaaaatgcatcgaatggtccacaatcttcgaggactctcagatactaaaagacaaactaaaggaaatcaattggctaaccccggaacaacgacacaaagtcgcaaacaagcgctatcagggatggggccgcctatccaagaaactcctcacccagctggttgattataacggccaacgcattatcgacatcctgtggaataccaccgataacttcatgcaaatcgtccactcggaagcgttcgacaaagctataatcaaagaaaaccaggccctccttacgcaatacaacccacaggccgtcatcgacgacctttacacgtcaccccaaaacaaaaaggcacttagacagattctactcgtcgttaacgacatacaaaaagcattaaagggacaagcgccaagccgcatccttatagagttcgctcgcgaggggcaagaaaacccccggttgtcaacccaacgcaaacaacaggtggaaaacgcatacaaagaggcctcggacgccctcctatccagcgccgaggtgcgacaagaactcaagggcctggataacaaagcactggcaaacacccgactcttcctctacttcatgcaaggaggccgcgacatctatacaggaaagagtctaaacatagacgacctatcaaagtacgatattgaccacattctgccacaagccttcatcaaagataactcactagacaacagagtcctggtgtccgctaagatgaaccgctcaaagtccgaccaagtacccctcaacgatttcgccgaaattcgatatggaaaacagatgcgacaacagtgggagaaaatgctgcgagccggcctcatcacacgaaagaaataccacaacttaaccctcaaccccgaaagcatcaacaaatacacagcaaaagggttcataaaccgtcaactcgtcgagacccgccaagtcaccaagctagcaacgaacctcctcgtggaccagtacgctgaggacgacgtccagctcattaccgtcaaaagcaatctcacccaccaaatgcgtgaagagtttgacttccccaaaaatcgcaacgtcaataaccaccaccatgcgtttgacgcctacttaacagcattcgtcgggctgtacctactcaaaagatacccaaaactagctccttacttcgtatacggtgactaccagaagggcgccagccaaaactccaagtggcgcaactttaacttcctgggtaacctacaccgggagaaagtagtcgacaagaacaccggcgaaatcatatggcagcgcgacgccgggctaggcgaacttaaccgcatctacaatttcaaaaagatactcgtaacccgcgccctacgagtcaaccgaggacccatgttcaaacagacaatatataaagcagaggaggacaagtcctccggacgtggcagcaaacaactcatccccactaagaaaaaccgcccgaccgagctatatggcggttacactaataaagaaacagcgtacttatgcctcgtcaaagaaccccataaaaagggagacatataccgcatatgtagcgtcttaaacatgtggctgaccgaacttgaccgtatagcggacccaattgccaaagcccaaaaactcacggagctactcactccccaatttaccaccactaaaaagaaacaggggcaaaagattcctgtcgtcaaaccgtttaaagtcgtaatccccaaaatactaataaaccaacgcttcttcagccgtggccaggagctcacggtcgcctccccaatgtacatgcacaatgagcaagaactcttcctcaacaagaaaactataaaacttctaaacggccaattagccaaaaacgaagcccacgaactcgcccccaaaatctaccaacagatcctcgaccaggtcaatgactatttccccctctacgacatgtacaaatttcgtgataccctcaacgcgtcaaaagaaatcttcgtcaacctgccctggcaggatcaaagacaggataagaaaatcagccaatcaggtcaaaaatccatccttaacaaaatactcatagggctacacgcaaacgccgcccgcattaaactaacagagctcaactttaaaagcgactttggcctcctctcccaacgctccggcatagccttctcccctgacgaccaaataatatatcagtcgccgaccggactattcgaaaggcgcgtaaccctcaaagacctgtga

SEQ ID NO: 6602 - RNA, 4110 nt, synthetic construct
  misc_feature 1..4110: note = Cas9 variant
  source 1..4110: mol_type = other RNA
atgaaagtgaacaactaccacatagggctagacataggaacctcctcgataggctgggtggccatgggggaggacgggaagccgttacgcgtgaagggaaaaacagcgataggcgcccgcctcttccgcgaaggaaaccccgccgccgatcgacgcatgttccggaccactagacgccgcctaaaccgccgcaaatggcggctaaaactcctagacgaaatcttcgacccgtacatcacaccggtggactctaccttcttcgcacgcctcaagcaatcaaactggagccccaaagacagccggaaagcgttcaaagatagtactctcttccctgacctcacagacaaacaataccacctcgactaccccaccatctaccacctaagacacgcactgatgacacaggacaagcaattcgacataagaatggtctacctagcgcttcaccatatagttaaatataggggcaactttctcaattcgaccccggtcgacagcttcaaggcctcaaaagtaaatttcgacgatcagttcaaaaagctcaacgaactgtataccgccatcaatcccgaagaatccttccaaatcaacttcgccaactcagagaaaatcggacaacaattcctagacccctcaataagaaaatttgacaagaaaaagcagatatcaaaaatagtcccagtcaccatggacgacaaagcagtcgacaaacttaacggcaaaatcgcttcagaaatagtgaacgccatcctaggctacaaatcaaagctcgacgtggccgtacagtgcgatccagaagatagcaagccgtgggccgtaaaattcgacgacgaagacatagacgctaagctacagaaaatattgccggaaatggacgaaaaccagcaatctattatcggaatcatacaagacctctactctcaagttacactgaaccaaatcgtcccgaatggcatgtccctcagcgagtccatgataaagaaatacaacgaccaccacgaccacctcaagctatacaagaaactgatcggacagatctccgactcaaagaagaaaaccgccctcaagaaggcctacgaccagtacgtagggaacgacggtaaggtaatcgaacaggacgacttctacagcagcgtcaaaaagaacctggacgattcggagctctcaaaacaaataatggacctcatcgacgcggacaaattcatgcccaaacaaagaacgtcccagaatggagtaatcccccaccaactacatcaacgagaactcgatgaaataatcgagcaccaaagcaaatactatccctggctagcagaatctaacccgaataaacacgacctacacctcgccaagtacaaaatcgaggaactcgtagccttcaggattccgtactatgttggccctatgatcaccccagaggaccaaaagaaaagcggcgcagccgtgttctcatggatgaaaagaaaggaacctggccaaataaccccatggaattttgaccaaaaagttgatcggatggaatcagccaacaaatttataaagcgcatgacaaccaaagacacatacctaataggtgaggacgtcctccccgacgaatccctcctctacgaaaagttcaaagtgctcaacgaactcaacatggtgcgagtaaacggagactcactcaaagtcgccgacaaacaagccatctaccaagatctgttcgaaaactataaacacatcagcgtcaagaaaatgcagaactacatcaaggacaaaaccggcctcccaaacaatcccgacattagcggactatccgaccccgaccacttcaacaacagtctgggaacctacaacgactttaagaaactcttcggcgacaaagtagacgatcccgatctacaagacgacttcgagaaaatcgtcgaatggtccaccgtattcgaagacaagaagatactccgcgctaaacttaacgagatctcctggctctcggacaaacaaaaagacgacctagaatcatccaggtaccaaagatgggggcgtctcagcaagaaactactaaccggcatagtaaacgaccaaggggaacgaatcatagatgagctgtggaatacaaacaaaaacttcatgcagatccagtcggacgacgatttcgccaaacggatccacgaagcgaatgcagaccaaatgaaagccacagacgtcgaagacgtactcgccgacgcctacacctcaccccaaaacaagaaagccatacgccaggtcgttaaagtcgtcgacgacatccaaagggccatgggcggcgtcgctccaaaattcatctccatcgagttcacacgctccgaagacagaaatcccaggcgcaccatcagcagagaaaggcagctagaagacacccttaaagacaccgccaaaacgctcgtcaaaagcatgaaccccgacatcttatcagaactcgacaacgcgagcaaaagcaagaaaggtctgacggaccgtctatacctttactttacccaactcggccgagacatgtatacaggcaaacccatcaacatagacgaaatctcgaactacgacatcgaccacatcctaccacaagccttcattaaagacgactcccttagtaaccgagttctcgtcagcaaagcagtaaacaacggcaaatcagcaaacgtccccctcaaactcttcggagtcaaaatggcgcatttctggaaacaactcgcagaagccgggctaattaacaaacgcaaactcaaaaacctacaaaccaacccagacacaatttccaaatttgcgatgcacggcttcatacgacgacagctagtcgaaacgagccaagtcatcaaactcgtcgcaaatattctcggggacaaataccgtaacgatgacacgaaaataatcgaaataacagcgcggatgaaccaccaaatgcgggatgagttcgcgttcatcaaaaaccgggagatcaacgactaccaccatgccttcgacgcttacctcacagccttcctcggccgctatttgtaccaccggtacattaaactaagaccatactttgtctacggcgacttcaagaagttccgcgaagacaaggtaacaatgagaaacttcaattttcttcacgacctgaccgacgacacccaagcacgtatcgcagacactgaaaccggggaggtaatctgggaccgagaaacttccataaaacagctgcgggacgtataccactacaaattcatgttgatcagccaggaagtctataccctccgaggcgccatgtttaaccagacaatctaccccgccgacgaagccggcaggaagaagctcatccccacaaaagcggacaaggccgtggacgtctatggaggttatagcggctccaacgacgcgtacatggccatcgtgcggatccacgacaagaaaggcgacaaatacaaggttgtcggtgtccccatgcgcgcactcgaccgccttaacgcggccaaaaacgtatccgatgccaaatacgaccaagtcctcaaagatgtcctaacaccacaatttactaaatcaaagaaatcccgcaaaactggagaaatttcgcaaaccgtcgaagatttcgaagtagtgctaggaaaagttatgtacagacagctagtcatagatggcgacaagaaatttatgctgggatcgagcacctaccaatacaacgcaaaacagcttgtcctctccgacgaaagcgtaaaaaccctcgcaagcaaagggaaactcgacgaagcacaagagagtgcagcctacgacaacgtgtacgatgagatcctagacaaagtggacaggtacttcgccctgtacgatcaacgaaactacaggaccaacctgcacgaaggagaacaaaaattcatcggcctacccctccacgacaccttcgacggctccaagaaagtggcgaacggcaaacgggaaaccatctctgacatactaaacggactacacgccaacgccacgatgaccaacctgaaagtactcggcatatcctcccccttcgggatgttccagtcccatgggcccataaacctaaacccagaaaccataatactgtgccaaagccccaccggactgttcgagcggcgaatcattctacgggacctatga

SEQ ID NO: 6603 - RNA, 4113 nt, synthetic construct
  misc_feature 1..4113: note = Cas9 variant
  source 1..4113: mol_type = other RNA
atgaagaaacgcaactataacataggacttgacataggcacttctagcataggatggaccatcgtcgacgataacgcacagattatgagagccaaagggaaaaacggctacggcgtgcgcatcttcgccgagggcaaaaccgcggcagatcggcgagggttcagaacgacccgcaggcgactaaaacgccgaaaatggaggctgcggctactccaagagttctttgaaccatatatcctaccaatagacgaaaacttcttcatgcgacaaaaagaaagcaatctggtcccgcaagacccaaacaaacatttcaaaggaagtatacttttcaacgaccgcacagaccaggagttccacgaacagtatcccaccatataccacttgcgatatgcactaatgaccgaacatcgacaattcgacgtacgggaaatatactgggcaatccaccacatagtgaaataccggggacacttcctgaacagcacacttgccagtaagttcaagggcggcgaactccgcctagcagacaaatttgagagcctgaacaaactcttcctccgagtccaagcagaaaccggattcgaactatctgaggacaacgtagacaagataaaaaccgttcttcttgataacggtaaatcccgccttgacagacaaagggaggtactaaagatagtctaccttacaagcgaggacaaagacaccgaaaagaaacgaaaagccgttgccacagagttcataaaagcagtactcggcctaaaaacgaaactctttatcgtactagccaaaaatcccactgcggaaaccgactggaaattcagtttcgatgccgaagacatagacgacaaactcgactcgatttccgaacaactaaccgacgatgaccacgaaatcgttgaactaatatcagaaatacacagcatcatcaccctaactggcgtcgtacccgaagggatgggcctgagcgaatccatgatagccaaatacgaccaacaccaattggacctaaagaaactaaaatccctcatgcgcgacctcgacgtaaaacaagcccgcaaattacaagacgcatacgacgagtatatagacggcctgaaaccaagcgaggaggcattctattcagcggtgagcagcgtcatacagaagatggacgacccccgtgccaaaaagataacagcagagatcgagctggaagagttcatgccaaaacagcgaacaaaagcgaacggacagatcccccaccagctacaccaacaagaactcgaccaaataatcgaaaaccagaaagaatactatccctggctggccgaagaaaaccccaacaagagagaacacaacgccgcaccccacaaactagacggactggtcacattccgagtcccctactacgtcggtccgctgatagaagccagcgtgcagcaaaagacgagcaactcaaacttcgcctggatggagcgcaaggttaagaacgacaccagccgcatcacaccatggaacttcgaagaaaaagtagaccgcaatgcatctgcagaaaacttcataaaaaggatgacaaccaaggacacctacctgctcaacgaagacgttcttccgcaacaatccctcctgtaccagaggtacgaagtgctcaacgagctcaacaatgtccgcgtcaatgacaagaaacttgaaaacaactgcaaacaggacgtctacaaagacctgttcaaaaacaatacgactgtttcgatcaagaaattcaaagactatctcgtggccaactgcgaatacgccgataaccccaaaatagaaggcctggccgacgaatcgatcttcctctcctcgctaagcactgaaaacaaattcaaagacatattcggagcgcaaatagacgacccgaactatttcgaagactttgagcacatcatcgaatgggctaccatcttcgaagacaataaaatcctccgcgccaagctcgacgagatttcatggctcaatgagagtcagaagaaagaactagcgaaactccggatgcgcggatggggccgactttccaggaagctaattgccgaaataaccgacgagaacggtagccggatcatagaccttctctgggaacacatggacaacttcatggtcgtagtaaaccaggacgtcttcaaagagaaaattgtagccgaaaacaaacaggtcttcaaagagcttaacccactggacataatcaacgagcagttcacctccccgcaaaacaaaaaggcactccgtcaaatcctattagtcgtcgccgatatacagaaggccatgaacggtgtcacgccctccaacatcttcatagagttcgctcgtgaagacgaacgtaatccacggcgaagtatacagcgcctacgccaagtggaaaatatgtatcgagacatctccgatacggtactagccgacccagaagtcaggaacgagctaagtaacataaagaacaccgagctcgcacgggacagggtctttctctacttcctgcagggcggcagagacgtgtacaccggcgagccactcaacatagacaaactatcggagtacgacatcgaccacatactcccacaagcattcatcaaagacaactccctcgacaatcgcgtactcgtcagcgcgagcctaaaccgctcaaaaagcgactcggtgcccctggacgacttcacctcggaaatgttcgggcgtaaaatggagcccctctgggaacaaatgcaacgcgccgggctaatctccaagaagaaactagccaatctgaaattcaaccccgaaaacatcaataaatatacccgaaacgggttcataaacagacagctagtggaaactagacaggtcataaaactagccgcaaacatcctgaaagaccactatggcgaggaaactgaaatcgttaacgtcaaagcaggactcacccaccaatttcgcaaggacttcgacttcccgaaaaatcgaaacgtaaacaactatcatcacgccttcgacgcatacctgactgcactggtaggcacgtacttactcaagaaataccccaaactcgagagctacttcgtatacggcaaattcaaaaagggcgatggaatcacgaacctgaagaacttcaacttccttcatggtttcaacaaaccaggaaagataatcaacaaagaaacaggagaaatcctgtttgaccgagataaacagctcgggtacatgaactcaatctacgacctacgaaaagtgatcgtaacccacgaactctccactcgacacggagccatgtacgaccaaaccctctacaaggcatccgacgacaaagacagcggcagaggagggaaacagctcatacgcaagaaagacaacctcccgaccgaaatctacggcggatacacagggagcacagacgcattcatgtcgataatccgcatgaaaaagaaagataagctctattacaaagtcataggcgtgcccactcgagtcgcgcatgaggtcctccagtcagacggtaaaatcaacatcttcaccctcaacaaattcatagaacaaaaactcaccaaagaaaaagtaaacaaaaagaccggcgcgatcacccgcatcacggactggttcgagctcgtcattgccaaggtcatgtacggccaagtgattgatgacggaggccaacccttcatgttaggctcgagcaccctcccctacaacgtgagagaactataccttgccaaagacctcgttaaagtaatcaacaaaggtagcacatcgaaatccagctacctcgatgtatacgacgaactcgtcaagagcctcaataaatatttccccatgtacgaccgtaacatgttccgccagaaaatcaccgacgcaagagacaaattcgaaaagttaccaaagagagacaaagtatcaaacggaaaactccaacaaatagggcaagttacgatcatagaccgaatactcattgggctccacactaacgctggcgtcagcaacctcaaagacctaggaatcgccaccccgtttggattcatgcaacaaggaaacggaatctcactcacctccacggccaaaatcatctaccaaagctcgaccggcctgttcgaaaagtccaaagccctagacgacctaaacccgttagcgtga

SEQ ID NO: 6604 - RNA, 4113 nt, synthetic construct
  misc_feature 1..4113: note = Cas9 variant
  source 1..4113: mol_type = other RNA
atgaacaaaccatacagcattggcctagacatcggcaccaattccgtgggatggtcaataataacggacgactacaaagtcccagcgaagaaaatgagagtactgggcaacacagacaaagaatacatcaagaaaaacctcataggcgcactgctattcgacggcggcaacactgcagcagaccgaaggctaaaacgaactgcccgacgacgctatacccgccgtcgaaatcggatactatacctccaggaaatcttcgccgaagaaatgagcaaggtagacgattccttcttccaccgactggaagacagcttcctagtcgaagaagacaaaagaggctccaagtatcccatattcgcaacaatgcaagaagaaaagtactatcacgaaaaattccccaccatataccacctccgcaaggagctagccgacaagaaagaaaaagcagatctccgcctgatatacttagcactcgcgcacataataaaattccgaggacactttcttatcgaagacgatcgattcgatgtccgcaacacggacatccaaaaacaataccaagcctttctagaaatattcgacaccaccttcgaaaacaacgacctactctcacagaacgtggacgtcgaagccatactaaccgacaaaatctccaagtcagccaagaaagaccgcattcttgcccgatacccaaaccagaaaagcaccggaatctttgccgagttcttaaaactgatcgttggaaaccaagccgactttaaaaagcactttaacctcgaagataaaactccgctgcagttcgccaaagactcctacgacgaagacctggaaaacctcctcggtcaaataggcgatgagttcgccgacttattcagcgcggccaagaaactgtacgactccgtcctcctcagcggcatcctcaccgtcacagacttatcgaccaaggcacccctgtcggcatccatgatccagcggtacgacgaacaccgagaagaccttaagcaactgaagcaatttgtcaaggcgtccctcccggaaaaataccaggagatcttcgctgattccagcaaagacggatacgctggctacatcgagggcaagaccaaccaagaagccttctacaagtacctaagtaaactactcacgaagcaagaaggctccgagtatctccttgagaaaatcaagaacgaagacttcctccgaaaacagcgtactttcgacaatggtagcatcccccatcaggtccacctaaccgaattgcgcgccatcatcagacggcagtccgaatactacccattcctgaaagagaacctagacagaatcgagaaaatactaacattccgcatcccctattacgtgggaccactagcacgcgaaaaatcagacttcgcatggatgactcgcaaaacagacgactccatccgcccctggaacttcgaagatcttgtcgacaaagaaaagtcggcagaagccttcatccaccgcatgacaaacaacgacctctacctccccgaagaaaaagtactaccaaaacactccttaatctacgagaaattcacagtctacaacgagctaacaaaagtgagattcctagcagaggggttcaaagacttccaattccttaacaggaaacaaaaagaaaccattttcaactccttattcaaggagaagcgcaaagtcacggaaaaagacattatcagcttcctaaacaaggtagacggctacgaaggaatagccatcaaaggcatagagaaacaattcaacgcctcgttatccacctaccacgacttgaagaaaatcctaggaaaagacttccttgacaacaccgacaacgagctaatcctcgaggacatcgtgcaaacactcacactattcgaagacagagaaatgatacgtaaaagactcgacatctacaaagacttcttcaccgaatcgcagctaaagaaactctatcgacgccactacaccggatggggccggttaagtgctaaactcatcaacggcatacgtaacaaagaaaaccagaaaacgatcctcgattatcttatagatgacggcagtgcgaaccgcaactttatgcagctgatcaaagacgcgggtctctccttcaaacccataatagataaagcccgcaccgggtcccactcagacaatctgaaagaggtagtcggtgagctcgccggatcccccgccatcaaaaagggaatactccaatcactcaaaatcgtagacgagttggtcaaggtcatgggctacgaacctgaacagatcgtcgtcgagatggccagagagaaccagaccacagcaaaagggctctcccgactacgacaacgactgacaacactccgggagtcgttagcgaacttaaagtcaaacatccttgaagaaaagaagccaaaatacgtcaaggaccaagttgagaaccatcacctaagcgacgaccgactattcctttactacctgcaaaacggtaaggacatgtatacagacgatgaactcgacattgacaacctctcccaatacgacatcgacctcatcataccacaggcatttatcaaagacgactcaatcgacaaccgagtcctcgtaagttcagccaaaaatcgcggcaagtcggacgacgtgccctcagttgagatcgtaaaggactgtaaggtattctggaaaaagctcctagacgcgaaactaatgagccaacggaaatatgacaacctcacaaaggccgagcgaggcggactgaccagcgacgacaaagcaaggttcatccaacgccaactcgttgagacccggcaaattacgaagcacgtcgcacgaatcttagatgaacggttcaacaacgaactagacagcaaaggacggcggatacgaaaagtaaagatagtcaccctgaaatcgaatctagttagcaacttccgaaaggagttcggcttctacaagatccgtgaagtcaacaactaccatcacgcccacgacgcttatctcaacgcggtggtcgcaaaggccatcttaacgaagtacccccaattggaacccgagttcgtctatggcgactacccaaaatacaactcatacaaaacccgcaagtccgccacagagaagctctttttctactctaacataatgaactttttcaaaactaaagtgactcttgcggacggtaccgttgtggtcaaggacgacatcgaagtaaacaatgacaccggggaaatcgtctgggacaaaaagaaacacttcgccaccgtccgaaaagtactaagctacccacaggtaaatatagtcaagaaaacagaaatccaaactggcggcttctccaaagaaagcatactcgcccacggcaacagcgacaaactaataccaaggaaaacaaaggatatttacctagaccctaagaaatacggtgggttcgactcccccatagtggcctactctgtcctagtggtagcggacataaagaaaggaaaagcccagaaactcaaaaccgttaccgaactactaggaattacgatcatggaacgctcccgattcgagaaaaatcccagcgctttcctagaaagtaagggctacctcaacataagagacgacaaactcatgatccttccgaaatactccttattcgaactcgaaaacggacgtagacgcctactcgcgtccgccgacgaactccagaaaggaaacgaactcgccctccccacgcaatttatgaagttcttatacctcgccagtcgatataacgaactaaaaggcaaaccagaagagatagaacaaaaacaagagttcgtagtccagcacgtttcctacttcgacgacatactgcaaatcatcaacgacttctccaaccgggtcatcctggccgacgccaacttagagaaaatcaacaaattgtaccaagataacaaggaaaacataccagtggacgaactagcaaacaacatcataaacctcttcacattcacatcgctcggagcccccgcagccttcaagttcttcgataagatcgtcgacagaaaacgctatacaagcacgaaagaagtgctaaacagcaccctcattcatcagtccatcacgggactatacgaaacgagaatagacctcggaaaactaggagaagactga

SEQ ID NO: 6605 - RNA, 4113 nt, synthetic construct
  misc_feature 1..4113: note = Cas9 variant
  source 1..4113: mol_type = other RNA
atgaccaagaaaaactattccatcggcctagacatcggaactaactccgtcggttgggccgtcatcaccgacgactacaaagtaccagccaagaagatgaaggtgctcgggaacacagacaagaaatatataaagaaaaatctccttggggccctactctttgacagcggcgaaaccgccgaggcaacgcgccttaaacgaacagcacgacgccgctacacccgacgcaaaaacagactacgatacctccaggaaatattcgccgaagaaatgacgaaagtggacgaatctttcttctaccgcctagacgagtccttcctgaccacggacgagaaagactttgaacgtcacccaatcttcggcaataaagcggaagaagacgcctaccatcagaagttcccaacaatctaccacctccggaactacttagccgactcgtcagagaaagcggaccttcgattagtatacctggctctagcccacatgataaaatacaggggacacttcttaatcgagggaaagctgaatgccgaaaacaccgacgtccagaaactcttcacagactttgtcggcgtctatgaccgcaccttcgacgacagccacctctccgaaataaccgtagacgtagcgagcacactcacagaaaagatctcgaaaagccgccggctcgagaatctcattaagtattaccccacggagaaaaagaacaccctgttcgggaacctcatagcgctcgccctagggctgcaaccaaacttcaagatgaacttcaaactctcagaagacgcgaaactccagttttccaaagacacgtacgaagaagacctggaagaactcctgggaaagataggtgatgactacgcagacctcttcactagcgcgaaaaacctatacgacgcaatcctgctctccggtatcctgacagtggacgacaacagcacaaaagccccgctcagtgcctcaatgataaaacggtacgttgaacaccacgaagacctcgaaaagctaaaggaatttatcaaagcaaacaagagcgagctgtaccacgacatattcaaagacaaaaacaagaacgggtacgcggggtacatagaaaacggagtgaagcaggacgaattttacaaatacctcaaaaacacgctatctaaaatagacgggagcgactacttcctagacaagatcgaacgtgaggacttcctcagaaaacagagaaccttcgataacgggagcatcccccaccagatccacctccaagagatgcatgctatactacgacgacaaggcgactactaccccttcctcaaagaaaaacaagaccgaatcgaaaagatattaacgttccggatcccctattacgtggggccactcgttcgaaaagactcacgcttcgcctgggccgagtacagatccgacgagaaaatcaccccatggaatttcgacaaagtcatagataaagaaaagagcgcggaaaaattcatcacgagaatgacgctcaacgacctgtacttaccagaagaaaaggtgctcccaaaacactcccacgtctacgagacgtatgcagtatacaatgaactaaccaagataaaatacgtaaatgaacaaggcaaggaatccttcttcgactccaacatgaagcaggagatcttcgatcacgtctttaaggagaaccgaaaagtgacgaaagaaaaactactaaattacctcaacaaagaatttcccgaataccgcatcaaagacctcatcggactggataaagaaaacaaatccttcaacgctagcctcggaacataccacgacctcaagaaaatcctggataaagccttcctagacgataaagttaacgaagaagtcatagaagatataataaaaacccttaccctgttcgaagacaaagacatgatccacgaaagactacaaaagtactccgacatctttaccgcaaaccaactgaagaagctagagcgacgtcactacaccggttggggccgactttcatacaagttgatcaacgggatacgtaataaggagaataacaaaaccattttagattacctcatcgatgacggcagtgccaataggaacttcatgcaactgataaatgacgacacgctgccgttcaaacagattattcagaaatcccaggtcgttggggacgtggatgacattgaggccgtcgtccatgatttaccgggcagccccgcaatcaagaaaggcatcctccaaagtgtaaaaatcgtagacgaattagtaaaagtcatgggagataaccccgacaacatcgtaatcgagatggccagagaaaaccaaacgaccaaccgcggacgttcccaaagtcaacaacgcctcaagaagctacaatcatccctcaaagaactgggcagcaacatcctcaatgaagagaagccgagttacatagaagataaagtcgagaactcccacctccagaacgatcaactattcctctattacatccaaaacggcaaagatatgtacacaggcgatgaactcgacatagaccacctatccgactacgacatagaccacataatcccacaagcgttcataaaggacgacagtatcgacaaccgagtcctcacctcatcggccaaaaacaggggcaagtctgacgacgtaccaagcctcgacatagtccgagcacgaaaagcagaatgggtgcggctgtacaaatccggactcatcagcaagcgcaaattcgacaacttaaccaaagcagaacgaggaggcttaaccgaagcagacaaagctggcttcatcaaacgccaactcgtggaaacccgacaaatcacaaaacacgtcgcgcaaatcctcgacgcccgcttcaacaccgaacacgacgagaatgacaaggtaatccgcgatgtaaaagtcataactctaaaatccaacctcgtcagccaattccgaaaagacttcgagttctacaaagtccgagaaatcaacgactaccaccatgcccacgacgcctacctcaacgcagtagtagggaccgccctactcaagaaataccccaaactcgctagcgagttcgtctacggcgaatacaagaaatacgacatccggaaattcatcacaaactcttccgacaaagccacggccaaatacttcttctacagcaacctaatgaacttcttcaaaaccaaagtaaaatatgccgacggcacagtcttcgaacgaccgataatagaaaccaacgccgacggcgaaattgcctggaacaaacaaatcgactttgaaaaagtcaggaaagtattaagctacccccaggtgaacatcgtgaaaaaggtagaaacgcaaacaggcggattcagcaaggaatccatcctcccaaaaggtgactctgacaagctgatcccacgaaaaaccaaaaaggtctactgggacaccaagaaatacggcggtttcgacagccccacagtagcatactccgtctttgtagtagctgacgtcgaaaaagggaaggcaaagaaactcaaaacagtcaaagagctcgtcggaatcagcatcatggaacggagcttcttcgaagagaatcccgtagagttcctcgaaaataaagggtaccacaacatccgagaagacaagctgatcaaactaccgaaatactcactcttcgaatttgaaggcggacgtcgacgcttgctcgcatccgcatccgaactccaaaaaggcaacgaaatggtattgcccggctacctcgtcgagctgctctaccacgcccaccgagccgacaacttcaactccacagagtatctgaattacgtaagtgaacacaagaaagagttcgagaaagtattaagttgcgtagaagacttcgcaaacctctacgtcgacgtagagaaaaacctatctaaaatacgggcagtcgccgactctatggataacttctccattgaagaaatcagcaactctttcatcaacctcctcaccctaaccgccctcggtgcaccggccgacttcaacttcctaggcgagaaaatcccccgcaaacgctacacgagtaccaaagaatgcctaacagccacgcttattcaccaatcaataactggactgtacgaaacacggatcgacctttcaaaacttggagaagaatga

SEQ ID NO: 6606 - RNA, 4113 nt, synthetic construct
  misc_feature 1..4113: note = Cas9 variant
  source 1..4113: mol_type = other RNA
atgaagaacgcaaacaaggtaaccggcaaatactacctgggattcgatatcggcaccaacagcgtagggtgggcggttacagacgaaaactacaatctgtgcaagttcaagaagaaaagcatgtggggaataaggttattcgaagacgccaaaacggcggaagaaagacgcggacaacgcgcatctcgcaggagactgcaacggcggaaacaacgcatcgacctcttgcaggagatatttgcggaagagatcaacaaagtggacgaaacgtttttcataagactgaacgagagccgactgcacctcgatgacaagacagttagcgagaagcatccactatttattggaagcgaatatagcgaaaaagagtactaccgcgaataccccaccatatttcacctcagaaaagaactgatggagtcgagcgaacctcacgatatcaggctagtctacctcgcgatccaccacatactaaagaacagagggcacttcctaatcgacggagaactaagcaaagccaactcgttcgatgcagcattctaccagatgaaggaggtgctgtgcaacgagctagatctcgaaattgacggagaaaacaccacagaagtggagagaacactgcgggaccggaacatctcgaagtcggacaaggtaaagctactggccgcgctcctagcaatgaaccaaaacgaaacggagtcaaaggagacgaagaaaaagatcgaaaacatctgcaaactactcgcaggaaacaagggagacatatccaagatatttggacaaacaccagaaggagtcgagaagacaagtttcagcttcggggaagcggactacgacgaatcgataagaccaaatcttgaggagtccatcccagaccagtgcttcgtaatagactcgataaaggcgctgtacgactggaacgtcctcgccgatatactgaacgggcagacatacctgtcttgcgccaaggtaaaccaatacgagacgcacaaaaataacttaaaggagctaaaactgctagtaaacagatactgcagccgagaggagtacaagcggttcttcaagagcgcggtcgagaaggcgaactatagtaactacatcgggagcgccaagcagggaaacaaaatcatagacgtaaagcgctgcgccgaggaggacttctacaaagagctaaaaatcctcttatcaaagatagagccagaggaagcggaccgcgaactctacgaacggatcaagcgagaggcggaggagggcagcctgctcccactccagcgcaacaaagacaacagcgtagtgccaaatcaaatgcacaaggcagaactagcattaatactagaaaacgcagggagttacctgggcttcctaaacgagaaggacgaagacggcctctccccagcagagaaaatcatcgaactcttcagcttcaggataccatattacgtaggaccactaagcgacagacacaaagaccgaggctcaaacgcgtggatagtcaggaaagcagaaggccgtatcctgccatggaacttcgatgagaaggtcgacagagagaaaagtaatgaagccttcatagaacgcatgacaaacaaatgcacgtacttgctcgggaaggacgtagtagcgaagaacagcctgatctacagccacttcatggtcctgaacgagctaaacaacctgagcgtatgcggtaacaagatcagcgtccaagtcaagcaggatatataccgcgaattgttccaaagacacacgaaggtgagcaaaaagatgctactccagtactgcagggagaagatgatgaacaaagacctagaagaggaagacctgtcgggcttcgacggcgactttaaagccaaattatcctcatacctcgacttcgagaaaaaggtattcggggcaaaaatggaagaagaccggattcgtaagatcaccgaagacatcatccgatggaagacaatctacggagacgacggtaagatgctacaggcagtcgtagaaaaggaatatcccggggaactagattccgaccaactaaaagccgttaagcaattccgatatagcggatggggcaacttctccgaagagttcctaaacggcatcgtaggcacagaaaagccgaccggacagatgttcacgatcatcgaagccctctggcaaactaattgtaacctaatgcaactcctcagcaaaaacttcacattcatggaagaaatcgaaaaacacaaccgcgaactggcaggccaaatcaccgatataagttacgacaaattggtaaaggacctatacataagcccagcgaacaagcgagcagtctggcaaacggtgcggatcgcggaagaagtcaagaaaatcatgggatgcgaaccagcgaagatattcgtcgaaatggcccggggcggagaaaaggaaaagaagcgaactatcagcagaaagaagaaactgctcgagctctacgcagcatgcaagaaagacgcacgagactggaaccgcgaaatagaagaccgagacgagcgagagttcaatagcgacaaactctacctctactacacccagatgggaaggtgcatgtacagtggtgaaagaatagatctccacgagctaatgagtgcaaacagcaagtgggacatcgaccacatctacccgcaaagcaaggtgaaagatgatagccttgataaccgcgtgctctcactgaagaaaataaacaatgagaaaggcaacaagccgctcagcagagacatacaacagtcacagcaaaagtggtggacggaactgctacagctcgagttcataaccaagaaaaagtacgaccgcctaatgcacagaggggaattatccgaggaggagctaagcggattcatcaaccgtcaactcgtagagaccaggcagtcaaccaaggcggcggcggaactactggggaggatgtacaacaacagcaaggtggtctatgttaaagctccgctagtatcgcagttcagaaaagacgacctcaacatattaaaatcccggctggcaaacgactaccaccacgcaaaagacgcgtaccttaacattgcagtcggcaacgtgtacaacgaaaagttcacagacaacccactaaggtggatcgagaagcacgcgggcgaaaattactcaataaaccgggtcttcgactacgacatcgtagcaggagacggggcgccagtatgggcggcgccactacgagacgagaaaaacaaactccgcaagaacgaagtcggagaaaagtacggaggaacaatcgacgtaatacgtaagacggtgaagcgcaacgacgtactatacacagagcatacctactgcggcaagggagaactcttcaacgcaacaattgctaagaaagacggaggagccgagattcccttaaaggcaggactccagacggggaagtacggtgggtataagtcccccaacacaagctatttcgcagcaatcgagttcgacggcaaaaagggagaacgagtcaagaacataatggaagtacccgtgtacatcgcgaatatcctgctgcacgacatcgacgcatacatacgctattgcgaaacagtgaaaggcctaaagaacgtaaaaatactgagaccctgcataaagaaaaatgcactgatcagtgtcgacggataccccatgagaatacgaggtgcgaacgagaaaaacattctcctgaaaaacaacctacaaccaatattcggtcggcatgaagaaacggtacgccgcattgagaagtatgtagaaaagaaccaagagttcgaagtagacgaaaagtttgacggcctcaacgaggcgaacttaactgacctatacgacgacatcaccgaaaagctatgcggcccctacgtcgaacggccaagtaaccaaggagagtacctaatggagaatagggaaaaattcctgaacataagcctaaaagaaaaggccaaattactcgcccaaatgatcaaactggtcagatgcgatacggaaacgaaagccgacctgcgaagcataggcgcctccaagaacgccggcgtcataagcgtaaacaaaaacacgctgggaggcaaaaggctgatcctaatcaaccaaagcgtgacaggcctgttcgaaaaccggatcgaactctga

SEQ ID NO: 6607 - RNA, 4113 nt, synthetic construct
  misc_feature 1..4113: note = Cas9 variant
  source 1..4113: mol_type = other RNA
atgaacaaaccatacagtataggactggacatcggcaccaacagcgtgggatggagcatcataacagacgactataaggtccccgctaaaaagatgagagtgctcgggaacacagacaaagaatacatcaagaagaacctcattggagccctactattcgacggagggaacacagcagccgaccggcgcctcaaaagaaccgcacgccgccgctacactcgccgacgcaatcggatcctgtacctccaagaaatcttcgccgaagaaatgtcaaaagtggatgacagcttcttccaccgtctggaagactccttcctagtcgaagaggacaaacgcggctccaaataccccatcttcgccaccatgcaggaagaaaaatactaccacgaaaaattccccacaatctaccacctccgcaaggagttagccgacaagaaagaaaaagcagacctacgactgatctacctggcccttgcacacataataaaattccgaggccacttcctaatagaagacgaccgtttcgatgtccgaaacaccgatatccaaaaacaataccaagcgttcctcgagattttcgacaccaccttcgagaacaatgacctgctcagccaaaacgtcgacgtagaggcaatcctcaccgacaagatcagcaagtccgccaagaaagaccgcatcctcgcccgctatcccaaccagaaaagtacaggcatctttgccgagttcctcaaactcatagtcggtaaccaagcggacttcaagaaacacttcaacctcgaggacaaaacgcccctccaattcgccaaagactcatacgacgaagacctagaaaacctcctaggccaaatcggagacgaatttgcagacctgtttagcgccgcgaaaaagctatacgattcagttcttctgagcggcatactcaccgtcaccgatctgagcaccaaagcaccactctcagcctccatgatccaacgctacgacgagcaccgtgaggacctaaaacaactgaaacaattcgtcaaggcgagcttacccgagaaataccaagaaatcttcgccgacagctccaaagacggctacgccgggtatattgaagggaaaaccaaccaagaggcgttctacaagtacctctccaagctcctcacaaagcaagagggaagcgaatacctcctggagaagatcaaaaacgaagacttcctccgcaaacaacgtacattcgataacggctcgataccccaccaagtacacctcacagaactccgtgctatcatcagacgacaatcagaatactatccattcctcaaagaaaaccttgaccgcattgagaaaatactcacattccgcatcccatattacgtcggccccctcgcccgagaaaaatccgacttcgcttggatgacccgcaaaaccgacgactcaattcgcccctggaacttcgaagacctcgtagacaaagaaaaatccgccgaagcgttcatccatcgcatgacgaacaacgacctatacctgccagaagaaaaggtgctcccgaagcactccctgatttacgagaagttcaccgtttacaacgaacttaccaaagtccgcttcctagcggaaggcttcaaagactttcaattcctgaaccgtaaacagaaggaaacgatattcaacagcttattcaaagagaaacggaaagtcaccgaaaaggacatcatcagcttcctcaataaggttgacggttatgaaggcatagccataaaaggtatcgaaaaacaatttaacgcctcactctccacctaccacgacctgaaaaagatcctcggaaaggatttcctagacaacacagacaacgaactcatcctagaagatatagtgcagaccctcacactattcgaagacagagagatgatccgcaaaagactcgacatctataaagatttctttaccgagtcccaactgaagaaactatacaggcgccactacaccggctggggcaggctctcggctaaactaataaacggaatcagaaacaaagagaaccagaaaaccatcctagactatctaatcgatgacggctctgctaacaggaacttcatgcaactcatcaaagacgccggactctcgttcaagcccatcatcgacaaggcgcgaaccgggagccactcggacaaccttaaggaggtcgtaggagaactggcagggagccccgccattaagaaaggaatcttacaatcactaaagatcgtggacgaactcgtcaaagtgatgggctacgagcccgaacaaatagtcgtggagatggcaagagaaaaccaaaccaccgccaaagggctatcccgctcacgccaacgactaaccacgctacgagaatccctcgctaaccttaagtcaaacatcctagaagagaagaaaccgaaatacgtgaaggaccaggtagagaatcaccatctcagcgacgaccggctattcctctactacctacaaaacggcaaggacatgtacacagacgacgagctcgacatagacaacctgtcacagtacgatatcgatcacatcatcccgcaggccttcataaaagacgacagcatagacaaccgggtgttagtctctagtgctaaaaatcgcggaaagtccgacgacgtccccagcgtggaaatcgtcaaagattgtaaggtattctggaagaaactcctcgatgccaaattaatgtcccaaagaaaatacgacaacctgacaaaggcagaacggggcggcctaacatccgatgataaagcgcggtttatccaaaggcaactggtagagaccagacagatcaccaagcacgtagcacgcatcctcgacgaaagattcaataacgaacttgactccaaaggcagacgaatccgcaaagtaaaaatcgtaaccctgaagtccaacctcgtctcaaattttcgcaaagagttcgggttctacaagatccgcgaagtcaataactaccaccacgcacacgacgcctatctcaacgcggtagtcgccaaggccatccttaccaagtacccgcagttggaacccgaatttgtctacggagactacccaaagtacaactcctataagacccgaaagagcgcaacagaaaagctgttcttttactcaaacatcatgaacttcttcaaaaccaaagtgacgctcgccgacggcaccgtcgtagtcaaagacgacatagaagtaaacaacgacaccggggagatcgtatgggataagaagaaacacttcgcgaccgtacgaaaagtgctatcatacccccaggtcaacatcgtgaagaaaacagaaatacagaccggcggcttctccaaagaatccatcttagcgcacggtaactcagacaaactcatcccgcgcaagaccaaagacatctacctagatcccaagaaatatggcggctttgacagcccgatagtagcctacagcgtactcgttgtcgccgacattaagaaaggcaaagctcaaaagctgaagaccgtaaccgaactgctcggcatcaccatcatggagcgctcccgctttgagaaaaacccgagcgcattcctcgaatccaagggctacttgaacatccgcgacgacaaactgatgatcttacccaagtacagcctattcgaactggaaaatggacgccgacgcctactagcctcagccggcgaactacaaaaagggaacgaattggccctgccgacgcagttcatgaaattcctgtatctagcctcacggtataacgagctaaagggaaaacccgaagagattgaacaaaaacaagagttcgtcgtacaacatgtctcctacttcgacgatatactccaaatcattaacgactttagcaacagggtcatcctcgcagacgcaaacctagagaaaatcaacaaactctaccaagacaacaaagagaatatccccgtagacgaacttgcaaacaacataattaacctcttcacctttaccagcctaggcgctcccgccgctttcaaattctttgacaagatcgtagaccgcaaaaggtatacaagcacgaaagaggtactgaactcgacactaatccaccaatccataaccggcctatatgaaacacgcatagatctcggcaaactaggagaggactga

SEQ ID NO: 6608 - RNA, 4113 nt, synthetic construct
  misc_feature 1..4113: note = Cas9 variant
  source 1..4113: mol_type = other RNA
atgacaaaaatcaaggacgactatatagtaggcctggacatcgggaccgactcctgtggctgggtagcgatgaacagcaacaatgacatcttgaaactccaaggaaaaacagcaatagggagccgcctcttcgaagggggaaagtccgcagcagaacgccgccttttccgcacgactcaccgaaggataaagcgacgacgatggcgcctgaaactactcgaagagttcttcgacccatacatggcggaagttgacccgtacttctttgcccggctgaaggaatcaggtctttcgcctctcgacaagcgcaaaaccgtcagcagcatagtatttccgacctccgcggaagacaaaaagttctacgatgactacccaacgatctatcacctccgctacaaactgatgaccgaagacgaaaagtttgacttacgggaagtgtacctagcaatccatcacattatcaagtaccgcgggaacttcctctacaacacctcagttaaggacttcaaggcctcaaaaatagacgtgaagtcctccatcgagaaacttaacgaactctatgaaaacctcgggctggacctaaacgtcgagttcaacataagcaacacggccgaaatcgaaaaagttctaaaagacaaacaaatcttcaaacgcgacaaagtgaagaagatagccgaactgttcgccatcaagactgacaacaaagagcaatccaaaagaatcaaagacatatctaaacaagtggcaaacgccgttctgggctacaagacccgtttcgacacaatcgctcttaaagagatctccaaagacgaactctcagactggaacttcaaactctcagacattgacgccgacagcaaattcgaggccctaatgggcaacttagacgagaacgaacaagcgatcctgctcacgataaaggagctatttaacgaagtcacactcaacgggatcgtagaagatggaaacacactctcggagagcatgatcaataaatacaacgaccaccgcgatgaccttaaacttctaaaagaagtaatagagaaccacattgaccgcaagaaagccaaggaactagctctcgcatacgacttgtacgtcaacaaccgccacggccgactcttgcaagccaagaaaaagctcggaaaaatcaagccacggtcaaaagaagacttttacaaagtcgtcaacaagaaccttgacgacagtagagcttccaaagaaattaagaagaaaatcgaacttgacagcttcatgccgaagcagaggaccaacgctaacggagtcataccgtaccagctccagcaactagagctggacaaaatcatcgaaaaccaatccaagtactaccccttcctaaaagagataaatcccgtgtcatcgcacctaaaagaggccccctacaaactagacgaactgatacgcttccgagtcccctactacgtcggaccactgataagcccaaatgaaagcacgaaagacatccagaccaagaaaaaccagaacttcgcatggatgatacgaaaagaggagggccgaataacaccctggaacttcgaccaaaaggtcgacagaatagagtcagcaaacaagttcataaaacggatgaccaccaaggacacctatctgttcggcgaggacgtacttccagcaaacagccttctctaccaaaagtttacagtcctaaacgagctcaacaacatccgcatcaatggcaagcgtataagcgtggacctaaaacaagagatctatgagaacctattcaagaaacacaccaccgtaaccgtcaagaaactcgagaactaccttaaagagaaccacaacctagtcaaagtagagatcaaaggcctagcagacgagaagaaattcaactcaggcctcaccacctataaccgcttcaaaaatttaaatatattcgacaaccaaatcgacgacctcaaataccgcaatgacttcgagaaaataatcgaatggtcgaccatattcgaagacaaatccatctacaaagaaaagttgcgcagcatcgactggctaaatgaaaaacaaatcaacgccctaagcaacatccgcctccaaggctggggccgcctaagcaagaaacttctggcgcagctgcacgaccacaacggccaaaccatcatcgaacagctatgggactcacaaaataacttcatgcagatagtgactcaggcagacttcaaagacgcaatcgccaaagccaaccaaaacctactcgtcgcaacctctgtagaagacatcttgaacaacgcttacaccagcccagcaaacaagaaggccatccggcaagtgatcaaggtcgtcgacgacatagtgaaggccgcctccgggaaagtgcctaaacaaatcgcgatagagttcacccgcgacgcagacgaaaacccgaaacgttcacaaacacggggatcaaaactacaaaaggtgtacaaggacctctccaccgagctagcatcaaaaaccatcgccgaggaactcaacgaggcgattaaggacaaaaagctagtacaggacaaatactacctgtacttcatgcaattgggccgagatgcgtacacaggagaacccataaacatcgacgagatccaaaaatacgacatagatcacatcctcccgcagtccttcatcaaagacgacgccctcgacaatcgcgtcctagtgagccgtgccgtcaataatgggaaatcggacaacgttcccgtcaagctattcggcaatgaaatggccgctaacttaggaatgactatccggaagatgtgggaggaatggaagaacataggcctcatcagcaaaacgaaatacaataaccttttgacagatcccgaccacattaacaaatacaagagcgcgggcttcatacgacggcagctagtggagacctcacaaatcattaaactggtctccaccatactccaatcgcgctacccaaacaccgaaatcataacagtcaaggcgaaatacaaccattacctccgcgaaaaattcgacctctacaagagcagagaggtgaacgactaccatcacgccatcgacgcataccttagcgcaatctgcggaaacctcctgtaccaaaactaccccaacctccgcccgttcttcgtatacggacagtacaagaaattcagcagtgatccggacaaggaaaaggagatatttaacaaaacccggaaattctcgttcatatcccaaatcctcaagaataagtcggaaaactcgaaggaaattgcagaaaagctcaaaagggcctaccagttcaagtacatgctagtgtcacgagaaacggagacaaaagatcaggaaatgttcaaaatgaccgtatttcctagagagacacccggtaacctcataccgaaaaagaaaggcatggctcccgagatttacggcggatacaccaaaaactcagacgcctacatggtcatcgtgaaaatcgacaaaaagaaagagacggagtatcgcatactgggcatccccacccgggagctcgtaaacctcaagaaagctgaaaaagaagaccattacgaatcctacttaaaagaaatcctagccccgcgcatactatacaataaaaacggcaaacgagacaagaaaatcacttcattcgagatagtgaagtccaaaatcccctacaaacaggtcattcaagacggagacaagaaattcatgctcgggagcagcacctacgtctacaacgcaaaacagctcacgctgtccaccgaatcgatgaaagcaatcaccaacaacttcgacaaggactcggacgaaaatgatgccttaataaaggcctacgatgaaatccttgacaaagtcgacaaatatctcccccttttcgacataaacgcattccgcaagaaactccattcaggccgcgaaaaattcgttgaactgtcactcgaagacaagaaagacattatcctaaaagtgctcatcggcctacacgacaacccagcaacctcagacctgaaaaccttagggttttcctccacagaactaggaaaaatgcagaaaaacagcgggatcgtactcagcggcaacgcgaaactcatctaccaatcaccgactggcctattcaagaaatccgtaaaaataagcgacctgtga

SEQ ID NO: 6609 - RNA, 4113 nt, synthetic construct
  misc_feature 1..4113: note = Cas9 variant
  source 1..4113: mol_type = other RNA
atgactaaaatcaaagacgactacatcgtggggcttgacatcgggaccgactcctgcggatgggtcgccatgaactccgacaacgacatcctaaaactccaagggaagaccgccattggctcccaccttttcgaggcaggcaagtcagccgcagaccgccgtctattccgcaccactcaccgccgaatcaagcgacgccgctggcgactcaaactccttgaagagttcttcgacccatacatggccaaagtggacccgtacttcttcgctcggctcaaagaatccggcctctcacccctggacaagcgcaaaaatgttttctccatagtattcccaacagcagccgaagacaagaaattctacgatgactatccgacaatctaccacctccgatataaactgatgacggaagacgaaaagttcgacttacgcgaagtgtacctagcaatacaccatataatcaaataccgtggcaacttcctatacaacacctccgtcaaagacttcaaagccagtaaaatagacgtaaaatcatcaatcgaaaaactcaatgaactctatgagaacctaggcctcgacctgaacgtagagttcaacatctctaacaccgccgaaatagaaaaagtcctcaaagataaacaaatatttaagcgagacaaggtaaagaaaatagccgaactgttcgcgattaaaaccgacaacaaagaacaaagcaaaaggatcaaagacatctcgaagcaggtagccaacgcggtcctcgggtacaaaacccgatttgacactatcgcactgaaagaagtctctaaagacgagctaagcgactggaacttcaagctctctgacatcgatgccgactccaaattcgaagcactcatgggcaatcttgacgaaaacgaacaggccatcctcctcaccatcaaagaactcttcaatgcagtaacgctcaacggcatcgttgaagacgggaataccctctcagaaagcatgatcaacaaatacaacgaccacagggatgaccttaaactactcaaagaagtcatcgagaaccacatagatagaaagaaagccgtcaagctagccttggcctacgacctatacgtcaataaccgacatgggcaactcatacaggccaagaagaaactcggtaaaatcaaacccggctcaaaagaggacttctataaagttgtcaataaaaaccttgatgacagtcaggcgtccaaagaaatcaaaaagaagattgaactagactccttcatgccaaagcaacgaacaaacgcaaacggcgtcatcccataccaacttcaccaacttgaactcgacaaaataattgaaaaccaaagcaaatactacccctttctcaaagaaataaaccccgtctcatcccatctgaaagaggcaccctacaaactcgacgaactcatacggttccgagtcccttactatgttggccccctcatatcaccaaacgaatcgacgaaggatatacaaacgaaaaagaaccagaacttcgcatggatgatacgcaaagaagaaggacgcatcaccccctggaacttcgatcagaaggtcgaccgaatcgagagcgccaacaaattcatcaaaaggatgacaacaaaagacacatacttattcggcgaaaacgtactgcctgctaactcccttttatatcaaaaattcacagtgctcaacgagctcaacaacatccgcatcaacggaaagcggatctctgtggacctcaaacaggaaatctacgagaacctcttcaagaaacacacgaccgtaaccgtcaagaaactcgaaaactacctgaaacagaaccacaacctcgtcaaagtggagatcaaaggcctcgctgacgagaagaaattcaactcaggcctcacaacctacaaccgcttcaaaaatctcaatatatttgacaatcagatcgacgacctcaaataccggaaagacttcgagaaaataatagaatggtccaccatcttcgaggacaaaagcatttataaagaaaaattgcgttccatcgactggctcaacgaaaaacaaatcaacgcactgtccaacatccgcctacaggggtggggccgcttatcaaagaaacttttagcacagcttcacgaccacaacggacaaaccatcatagaacaactgtgggactcacaaaacaacttcatgcaaatagttacccaagccgacttcaaagacgcgatcgcgaaagcgaaccaaaacctactcgtcgccacctccgtcgaagacatattaaacgacgcctatacgtcccccgcaaacaagaaagcaatccggcaggtcatcaaagtcgttgatgacatcgttaaagcagccagcggaaaagtgccaaaacagatagccatcgagttcacaagggacgcagacgacaaccctaaacgcagccaaacccgaggctcaaaactccagaaagtatataaagatctgtcaaccgaactagcatcaaaagcaatagccgaggaactaaacgaagcaataaaagacaagaaactcgttcaagacaaatactacctctacttcatgcaactagggcgcgacgcctacaccggagaacccataaatatcgacgaaattcaaaagtatgacattgatcacatactaccccagagtttcatcaaggacgacgcactggataatagggtccttgtctcaaaagcagtgaacaacgacaaaagcgacaacgtacccgtgaaactcttcggaaacgaaatggccggcaacctcggcatcaccatacgcaaaatgtgggaagagtggaagaacatcggcctaatatccaaaaccaaatacaacaacctcctcacagaccccgaccacatcaacaaatacgagtcagctggattcatacggcgccaactcgtagaaacctcgcaaataatcaagctcgtatccacgatcttacaaagtcgctacccaaatactgagataataacagtcaaggccaaatataaccactaccttcgagaaaaatttgacctttacaaatctcgagaggtcaacgattaccaccacgctatcgacgcatatctttccgccatctgtgggaacctcttataccaaaactacccaaatctccgaccctttttcgtctacgggcaatacaagaaattctcgtccgaccccgacaaagaaaaagaaattttcaacaaaactcgaaaattcagctttatctcccaaatactaaagaacaaatcggaaaactccaaagaaatcgcagaaaagttgaagcgcgcgtaccagttcaaatacatgctcgtctcccgcgagactgagacgaaagaccaagaaatgtttaaaatgaccgtattcccgcgcgagaccccaggcaatctgatacccaagaaaaagggcatggcgaccgagatctacggcggatataccaaaaactcagacgcatacatggtcattgtcaagatcgacaagaagaaagaaaccgaataccgcattctaggtatccccacacgcgagctagtcaacctaaagaaagcagagaaagaagatcactacgagtcataccttaaagagattcttgccccacgcatactatacaacaaaaacggaaaacgagacaagaaaatcaccagtttcgaaatagtcaaatccaaaataccctacaagcaggtcattcaagacggcgacaagaaattcatgctcggcagctccacctacgtatacaatgcaaaacaacttacactctccactgaatcaatgaaagcgataactaacaacttcgataaagacagcgacgagaacgacgccctcattaaagcctatgacgaaatcctagataaggttgacaaatacctccccctctttgacatcaacgccttcaggaaaaagctacactcagggcgagagaaatttgtagagctttccctagaagacaaaaaggacatcatccttaaagtgctcataggactacacgacaatccggcgacgtccgacctgaagaccctaggattctccagcaccgaactggggaaaatgcaaaagaacagcggcatcgtcctctccggaaacgcgaagctcatataccaaagcccaaccggcctcttcaaaaagtcagtaaagataagcgatctgtga

SEQ ID NO: 6610 - RNA, 4113 nt, synthetic construct
  misc_feature 1..4113: note = Cas9 variant
  source 1..4113: mol_type = other RNA
atgaacaaaccctactccataggactcgacataggaaccaactcagtaggctggtccatcataaccgacgactacaaggtacccgccaagaaaatgagagtcctcgggaacaccgacaaagaatacataaagaaaaaccttatcggcgccctactattcgacggaggcaacacggccgcggaccgccgcctaaagagaacggcccggcgacgatacacgcggcgacgcaaccgtattctctacctacaagaaattttcgcagaggaaatgtcaaaagtagacgactccttcttccatcgactcgaggactctttcctcgtggaagaggacaaacgggggtccaaatacccgatcttcgccaccatgcaggaagaaaaatactaccacgagaaatttccgaccatctaccatctgcgcaaagaactggcagacaaaaaggaaaaggccgacctacgcctgatctatctcgcacttgctcacatcatcaagttccgcggacacttccttatcgaagacgatcggttcgacgtgcgcaacacagatatccagaagcaataccaagcctttctggagatcttcgacaccaccttcgaaaataacgacctcctcagtcaaaacgtagacgtagaagcaatactaaccgacaagatatccaaaagcgcaaagaaagaccgaatcctggcccggtacccaaatcaaaagtcaacaggtatattcgcagagttccttaagctcatcgtaggcaaccaggcagactttaagaaacacttcaacctcgaagataaaacaccccttcaatttgcgaaagactcatacgacgaagatcttgaaaacctacttggtcaaataggagacgagttcgcagatctattctcggcagccaaaaagctctacgacagcgtcctcctgagcgggatactcaccgtaacagacctcagcaccaaagcgccactctcagctagcatgatccaacgttacgacgaacatcgcgaagacctcaaacagctaaagcaattcgtcaaagccagccttccagaaaagtatcaggaaatctttgccgactcttcaaaagacgggtacgccggttatatagaaggaaaaacaaaccaagaagccttctacaagtacctgagcaaacttctcacaaaacaagaaggatccgaatacctgttagagaaaatcaagaacgaagatttcttacgcaaacaacgaaccttcgacaacggcagcatcccccatcaagtacacctgacagaactacgcgccatcatccgacgtcagagcgaatactaccccttcctcaaagagaacctggaccgcatcgagaaaatattaacatttcgcatcccttattacgtcggccccctagcccgagaaaagagcgacttcgcatggatgacacgcaaaaccgatgactctatacgcccatggaacttcgaagatctggtagataaggagaaaagtgccgaagcgtttattcaccggatgacgaacaacgacctatacctacccgaagaaaaggtactccccaaacactcactgatctacgaaaaattcacagtatacaacgaactcacaaaagtacgctttctggctgaaggcttcaaagacttccaattcctaaacaggaaacagaaggaaaccatatttaacagcctgttcaaggaaaaacgaaaagtcactgagaaggacatcatctctttcctcaacaaagtcgacggctatgagggcatcgcgatcaagggcatagaaaagcagttcaacgcctccctgagcacctaccatgacctcaagaaaatcctcggtaaagactttctcgacaacactgacaacgagctgatactcgaagatatagtacaaaccctcacactgtttgaggaccgcgagatgatacgcaaaagattagacatttacaaagacttctttaccgaatcgcaactgaagaaactataccgacgccactacaccggctggggccgcctcagcgccaaactaataaatggaatcagaaataaagaaaaccagaaaacaatcttagactacctaatcgacgacggatccgccaacagaaacttcatgcaactaatcaaagacgcagggcttagcttcaaaccaatcatagacaaagcacgtaccggttcgcatagcgacaacctaaaagaagtcgtgggcgagctggcaggctcgcccgccatcaaaaagggtatactacagtccctcaaaatcgtcgacgaacttgttaaagtgatgggctacgagcccgagcagatagtagtggaaatggcccgcgaaaatcaaaccacagcgaagggccttagccgaagcagacaacgcctcacaacgctaagagagagtctcgccaacctcaaatcgaacatactcgaggaaaagaaaccgaaatacgtgaaagaccaggtcgaaaaccaccatctcagcgacgaccgactcttcctgtactacctgcaaaacggcaaagacatgtacacagacgacgagctcgacatcgacaacctgagccaatacgacatcgaccacatcatcccacaagccttcattaaagacgactccatcgacaaccgcgtgctggtaagctccgccaaaaaccggggaaaatctgatgacgtgccctctgtcgaaattgtaaaagactgcaaggtcttctggaagaaactgctagacgccaagctaatgagccagcgaaaatatgacaacctcacaaaggccgagcgaggcggcctgacatctgacgataaagccagattcatccaacgacaactcgtcgaaacgcggcaaataaccaaacacgtcgcgcggatcctagacgagcgcttcaacaacgaactcgacagcaaaggccgccgcatacgcaaggtcaaaatcgtcacgctcaagagcaacttagttagtaacttccgcaaagagtttggtttctacaaaatccgcgaggtaaacaactatcaccacgcccacgacgcatatctaaacgctgtcgtcgcgaaagcgatcctgaccaaatacccgcaacttgaaccagagttcgtatatggagactaccccaagtacaactcatacaaaactcgaaaatctgctacggagaagttattcttctacagcaatattatgaacttctttaaaacgaaggttaccctagcagacggcacagtcgtcgtcaaggatgacatagaagttaacaacgacactggcgaaatagtatgggacaaaaagaaacattttgcaacagtacgcaaagtcctcagctacccgcaggtcaatatcgtgaagaaaacagaaatacaaacaggtggcttcagcaaagaatcgatactggcacacggcaatagcgacaaactcatcccccgcaaaacaaaagacatctacctagaccccaaaaagtacgggggatttgactcacccaaggtagcatactcagtgctcgttgtggcagacataaagaaaggcaaagcgcaaaaactgaaaacagtcacagagctgctaggaataaccataatggaacgctcgagattcgagaaaaacccgagcgccttcctcgaatccaaggggtaccttaacatccgggacgacaaactgatgatcctccctaaatacagcctgttcgaactcgaaaatggcaggcgacgccttctcgcctcggccggagaactccaaaaaggtaacgaactcgccctcccgacccagttcatgaaattcctataccttgcctcccgatacaacgaactaaaagggaagcccgaagagatagaacagaaacaagagttcgtcgtgcaacacgtatcatactttgacgacatacttcagataataaatgacttttcaaaccgcgtaatcctagcggacgcgaacctagagaaaatcaacaagctctaccaggacaacaaggaaaacatccccgtagacgaactggccaacaacatcatcaatctttttacatttaccagcctcggtgccccagcggccttcaaatttttcgacaagatagtagatcggaagagatatacttccacaaaagaagtacttaactccaccctcatccacaaatcaatcacggggttgtacgaaactcgaatcgacctagggaaactgggcgaggactga

SEQ ID NO: 6611 - RNA, 4113 nt, synthetic construct
  misc_feature 1..4113: note = Cas9 variant
  source 1..4113: mol_type = other RNA
atgaacaaaccctactcgatcgggctagacattgggactaacagcgtgggatggtccataataacggacgactacaaagtccctgccaaaaagatgcgcgtgctggggaatactgacaaagaatacatcaagaaaaacctgatcggagccctcctatttgacggcgggaatacagccgccgaccgtcgactcaaaagaaccgcgcgacgacgatacaccaggcgccgaaaccgtatcctatacctacaagaaatcttcgcggaggaaatgtcgaaagtcgacgactccttcttccaccgtctcgaagacagtttcctcgtcgaagaagacaaacgcgggagcaaataccctatattcgcgacgctccaagaagaaaaagattaccacgagaaattctcaaccatctaccacctcagaaaggaactcgccgacaaaaaggaaaaggcagacctccggctgatatacatagcattagcacacatcataaagttccgcggccacttcctcatagaagacgactctttcgacgttagaaacacggacataagcaagcaataccaggattttctcgagatcttcaacacaacattcgaaaacaatgatctactgagccaaaacgtcgacgtggaagcaatccttaccgacaaaatttccaaaagcgcgaagaaagaccgcatattagcgcaatacccaaaccagaaatcaactggaatattcgcagagtttctcaagctaatcgtcggcaaccaggccgacttcaaaaagtacttcaacctcgaagacaagacacctctccaattcgccaaagacagctacgacgaagacctcgagaacctcctgggccagatcggagacgagttcgcagacctattctccgccgcgaagaaactttatgacagcgtcctactaagtgggatactaacggtgatcgacctgtccaccaaagcacccctatccgcatccatgatccagagatacgacgagcaccgagaagaccttaaacagctcaaacaatttgtgaaggcttccctcccggaaaaataccaagaaatcttcgctgacagctcaaaagacggctacgccggctacatcgagggcaaaaccaaccaagaagccttctacaaatatctatccaaactcctaactaaacaggaggactcggaaaacttcctggagaaaataaagaacgaagacttcctaagaaaacaacgcaccttcgacaacggatcaatcccacaccaagtccacctgacagaactaaaagccatcatccgacgccagagcgaatactaccccttcctgaaggagaaccaagacagaatcgaaaagatcctcactttccgaatcccatactacatcggtccattggcacgagaaaaatcagatttcgcatggatgacccgaaagaccgacgactctatccgcccctggaacttcgaggacctggtagacaaggaaaaatctgccgaggccttcatccaccgcatgacaaacaacgacttctatcttccagaagagaaagtcctccccaagcactcactcatctacgaaaaattcacggtctacaacgagctgacgaaagtccggtacaagaacgaacaaggagagacctacttctttgactccaacataaaacaagaaatctttgacggggtctttaaggagcaccgcaaagtatccaaaaagaaactcctcgatttcctagccaaagaatacgaagagttccggatcgttgacgttattgggctcgacaaagaaaacaaagccttcaacgcctccctgggtacataccacgacttagagaaaatactggacaaagacttcctcgacaaccccgacaacgaatcaatcctcgaagatatagtgcaaacccttaccctcttcgaagaccgggaaatgattaagaaaagactcgaaaactacaaagacctattcactgaaagtcagctgaagaaactataccgccgtcactacacaggctggggacggctatccgccaaactcattaacggcatccgagacaaagaaagccagaaaacgatcctagattacctcatagacgacggccgaagcaaccgcaactttatgcaactgatcaacgacgacggcctttccttcaaatccataataagcaaggcccaagccggttcgcacagcgacaacctcaaggaagtagtcggcgaactcgccggcagccccgccatcaagaagggcatcttacaatcactcaaaatcgtcgacgagcttgtaaaagtaatgggctacgaacccgaacaaatagtagtcgagatggcaagagagaatcaaaccacgaaccaaggcagaagaaactcacggcagcgctacaaactactcgacgacggggtgaaaaacctggcatcagacttgaacggaaacatactcaaggaatatcccaccgacaaccaagccctacaaaacgaacgcctattcctctactacctccagaacgggagagacatgtacaccggtgaagcgctcgacatcgataacctctcacaatacgacatagaccacatcatcccccaggccttcatcaaagacgactccatcgataatagggtcttggtgtcatcagcaaagaaccgcggaaaatcagacgacgtccccagcctggaaatcgtcaaggactgcaaggtcttctggaagaaactactagacgcaaaactaatgtcccagaggaaatacgataaccttacgaaagccgaaagagggggactgacctcagacgacaaagcgcgattcatacaacgccaactcgttgagacccgacagataaccaaacacgtagcacgcatcctcgacgaaagattcaacaacgaactcgacagtaaggggcgcagaatacgcaaggtaaagatcgtcacactaaagtcgaatctcgtgtcgaacttccgcaaggagttcggtttctacaagatacgggaagttaacaactaccaccatgcacatgacgcctacttaaacgcggtcgtcgcaaaagccatcctcaccaagtacccacagttggaaccggagttcgtttacggtgattaccccaaatacaactcctacaaaacccgcaaatccgctacggaaaaactgttcttctactccaacatcatgaatttcttcaaaacaaaggtcaccctcgcggacgggactgtagttgtcaaggacgatatcgaggtgaacaacgacaccggtgaaatcgtctgggacaagaagaaacacttcgcaacggtacgcaaagtcctctcgtacccacaaaacaacatcgtcaagaaaaccgaaattcaaaccggagggttctcaaaagagtccattctcgctcacggtaattccgacaaactgataccccgaaaaaccaaagatatctacctcgatccaaagaaatacggcgggttcgacagcccaattgtagcctactcggtgttagtggtcgccgatataaagaaaggtaaagcacagaaactgaaaacggtaactgaactactcggcatcacgattatggaaagatcacgattcgagaaaaacccatccgcatttctcgaatccaagggctacctcaacatccgcgcagacaaattgattatcctaccaaagtatagcctcttcgaactcgagaacggacgaagaagactactcgcttccgctggagaactacaaaaaggaaacgaactcgcccttcccacgcaattcatgaaattcctctacctcgcttcccgatataacgaatccaaaggaaagcctgaagaaatcgaaaagaaacaagagttcgtcaaccagcacgtttcatacttcgacgacatcctacagctcatcaacgacttttcaaaacgtgttatcctcgccgacgcaaacctagagaaaatcaacaaactgtaccaagacaacaaggaaaacataagcgtcgacgaactggccaacaacattataaacctattcaccttcacctcccttggcgcgccggccgcctttaagttctttgacaaaatcgtcgaccggaagcgatatacctccacaaaagaggtcctcaattcgaccctcatccatcagagcatcacaggcctctacgaaactcgcatcgacctcggcaaactcggagaggactga

SEQ ID NO: 6612 - RNA, 4113 nt, synthetic construct
  misc_feature 1..4113: note = Cas9 variant
  source 1..4113: mol_type = other RNA
atgaacaagccctacagcataggactcgatataggcacaaattcggtaggatggtccataatcacagacgactacaaggtcccagctaagaaaatgcgagtactcggcaataccgacaaagagtacatcaagaaaaatctcatcggagccttgcttttcgacggcggaaacacggccgctgaccgccgcctcaaacgcactgctcgccggcgttacactcgacgccgaaaccgaatcctatacctccaagagatttttgcagaagagatgtcaaaagtcgatgactcgttcttccaccgcctagaagacagcttcctcgttgaagaagacaaacgcggatcaaagtacccaatattcgcgacactccaagaagaaaaggactaccacgaaaagttcagcaccatatatcacctccgcaaggagctcgcagacaagaaggaaaaagcggacctccgcctcatctacatcgcgctggcacacatcataaagttcagaggtcacttcctaatcgaggacgactcattcgacgtccgcaacaccgacatctccaaacaatatcaggatttcctcgaaatattcaataccacatttgaaaacaacgacctactcagtcaaaacgtggacgtggaagcaattctcaccgacaaaattagcaaaagcgctaagaaagaccgtatcctcgctcagtacccaaaccagaaaagtactggaatcttcgcggagttcctcaaactcatagtgggcaaccaagccgacttcaagaaatatttcaacctcgaagacaaaacgcccctacaatttgccaaagactcatacgacgaagaccttgaaaacctcctcggtcaaataggagacgagttcgcagatctcttctcagccgcaaagaaactctacgactccgtattgctctccggcatcctaaccgtaatagacttatctacaaaagcgccactgtcagcctcgatgatccaaagatacgacgaacacagagaggacctcaaacagctcaaacaattcgtcaaagcctcactccccgagaaataccaagaaattttcgcagactcaagcaaagacggatacgcaggctacatcgaagggaaaacgaaccaagaagcgttctacaaatacctatcaaaactccttacgaaacaagaagacagcgagaacttcctcgagaaaatcaaaaacgaagacttcctacgcaaacaaaggacgttcgacaacggatccataccacaccaggtacacctcacagaactcaaagcgataatacgtcgccaatccgaatactacccgttcctcaaggaaaatcaagacagaattgaaaagatcctaacatttcgcatcccttactacatcggccccctcgcacgcgagaaatccgactttgcctggatgacccgtaaaaccgacgacagtatacgaccctggaacttcgaagatctcgtagacaaagaaaaatcagcagaggcgttcatccaccggatgacaaacaatgacttctatctgccggaagagaaggtactgccgaaacattcactcatttatgaaaagttcaccgtctacaatgaacttacaaaagtgaggtacaaaaacgaacaaggcgagacctacttctttgacagcaacataaaacaggagatattcgacggggtatttaaggaacacagaaaagtgtccaagaagaaacttttagacttcctcgccaaagaatacgaggagttccgtatcgttgatgtgataggccttgacaaagaaaacaaagcattcaatgcctcactgggcacctaccacgacctggaaaagatactggacaaggactttctcgacaaccccgacaatgagtccatcctggaagatatcgtccagacactcacactattcgaagatagggagatgataaagaagagactcgaaaactacaaagatctgttcacggaatcccaattgaaaaagctgtaccggcgacactacactggatggggacgcctaagcgccaagctcatcaacggaatccgcgataaagaatcgcagaaaaccatactcgattacctaatagacgatggacgcagcaaccgcaatttcatgcaactaattaacgacgacggactgagcttcaagtcaatcatctccaaagcccaggcagggagccacagcgataacctcaaagaggtcgtaggtgaacttgctggatcaccagcgatcaagaaaggcatactacaaagcctcaaaatcgtagacgaactcgtgaaggtcatgggatacgaaccggaacaaatcgtggtagagatggcaagggaaaatcagacgaccaaccaagggcgccgcaactccagacaacgctacaaactgctcgacgacggtgtcaaaaacctcgcatcagacctcaatgggaacatcctgaaagaataccccacagacaaccaggcactccaaaacgaacggctatttctatactacctccagaacgggcgcgatatgtacaccggcgaagccctcgacatcgacaacctcagccagtacgacatcgatcacataatcccccaagcatttataaaagacgactcaatcgacaatagagtcctggtgtcttctgcgaagaaccgaggaaagtcagacgacgtcccaagtctcgagatagtgaaagactgcaaagtattctggaagaaactcctcgacgcaaaactaatgagccaacgaaaatacgacaacctcaccaaggccgaacggggaggcctcacaagcgacgacaaagcccgattcatccagcgccagttagtggaaactcgccaaatcaccaaacacgtagcacgtattctcgacgaacgctttaacaacgagctagacagcaaggggcgacggatccgaaaggtcaaaatagtaaccctcaaaagtaacctcgtaagcaacttccgcaaagagttcggattctacaagatacgcgaagtgaacaactatcaccacgcccacgacgcctacctcaacgccgtcgtcgcaaaggccatactcactaaatacccccaactagaacccgagttcgtttacggagattacccgaaatacaactcctacaagacccgcaagagcgccaccgaaaaactgttcttttattcgaacataatgaactttttcaagacaaaagtgaccctagcagacggcacagtcgtggtgaaagacgatatagaagttaacaacgatacaggagaaatagtatgggacaagaagaaacacttcgcgaccgtacgaaaagtcctctcctacccacaaaacaacatcgtaaagaaaaccgaaatacaaaccggcgggttctctaaggaatccatcctcgcacacggcaactcagataaacttatcccccggaagacaaaagacatctacctagaccctaaaaagtacggcggcttcgactcaccgatagttgcctacagcgtgttagtcgtagccgacattaaaaagggaaaagcccaaaagctgaaaaccgtcaccgagctcctaggcataacaatcatggaaaggagcaggttcgaaaagaacccatccgcattcctagaatcgaaaggttacctgaacatacgagacgacaaactcatgatcttaccaaaatactcactcttcgaactagagaacggacgccgccgactactagcatcggccggagaactgcagaaagggaacgagctggctctccccacccaattcatgaaatttttatatctagcgtcccgctacaacgaaagcaaggggaaaccggaagagattgaaaagaaacaagagttcgtaaaccaacacgtaagctacttcgacgacatcctccagctaatcaatgacttttccaaaagggtcatcttagcggacgcaaacctggagaaaatcaataaactataccaagacaataaagaaaatataagcgtagacgaactagcaaacaatataatcaacctattcaccttcaccagcctaggggcaccggcagctttcaaatttttcgacaaaatcgtagaccgcaaacgatacaccagcaccaaggaagtcttaaattccaccctcatccatcaatcgatcaccggtctatacgagaccagaatcgacttgggcaaactgggcgaagactga

SEQ ID NO: 6613 - RNA, 4113 nt, synthetic construct
  misc_feature 1..4113: note = Cas9 variant
  source 1..4113: mol_type = other RNA
atgaacaaaccgtactcaatcggactcgacatagggacaaactcagtaggctggagcataatcacggacgattacaaggtcccagctaaaaagatgcgcgtactcggcaacaccgacaaggaatacattaaaaagaacctcataggagccctcctattcgacggcggaaataccgccgcagaccgcagactaaaacgaaccgcaagacgacgatatacgcgtaggcgcaaccgaatactgtacctccaggaaatattcgccgaggagatgtctaaagtggacgactctttcttccaccgcctggaagattcattcctcgtcgaggaagacaaacgcggctccaaatatccgatcttcgccacaatgcaagaggaaaagtactaccacgaaaagttccccaccatataccatctccgaaaagaactagcagataagaaagaaaaagctgacctacgccttatctacctggcactggcccacatcatcaagttccggggccatttcctcatcgaagacgacaggtttgacgtaagaaacacagacatccaaaagcaatatcaagcattcctcgagatttttgacaccaccttcgagaacaacgacctcctctcacaaaacgtagacgttgaggccatacttacagacaagatctccaagtctgccaagaaggatcggatcctcgcgcgctacccaaatcaaaaatcaaccggaatcttcgccgagttcctcaagctcatagtagggaatcaggccgacttcaaaaagcacttcaacctggaggacaaaacaccactccaattcgcaaaagactcatacgacgaggacctggaaaacctactggggcaaatcggggacgagttcgccgacctattttcagcggccaagaaactctacgactcagtcctactcagtggaatcttaaccgtcacggacctatcaactaaagccccactatccgcttcaatgatccaaaggtacgacgaacaccgtgaagacctcaaacagctaaaacaatttgtaaaggccagccttccggaaaagtaccaggagatattcgcagactcctctaaggacggctacgccggctatatcgaaggcaaaacaaaccaagaagccttctacaagtacctaagcaagctacttacaaagcaggaaggctctgaataccttctagagaaaataaagaacgaagacttcctacgaaaacagcgcacgttcgacaacggatcaatcccccatcaagtgcacctcacagaactgcgcgccatcatacgacggcaatcggaatattacccgctcttaaaggaaaacctagaccgaatagagaaaattctgacattcaggataccctactacgtaggaccactagcccgtgaaaagtcagacttcgcatggatgacacgcaagaccgacgacagcatccgcccatggaacttcgaagacctagtagataaagaaaagtccgccgaagccttcatccacagaatgacgaacaacgacctataccttcccgaagaaaaagttctaccgaagcatagcctaatctacgagaagttcaccgtatacaacgagctaaccaaagtacggttcttagccgagggcttcaaagacttccagttcctaaatcgaaaacaaaaagaaaccatatttaacagcttattcaaggagaagcgaaaagtaaccgagaaagacataatatcgtttctcaacaaggtggacggatacgaaggcatcgcaattaaaggtatcgaaaaacaatttaacgccagcctcagcacataccacgatctaaagaaaatcctgggaaaagacttcctcgacaacacagacaacgaactgatcctggaagacatcgtgcagaccctaaccctcttcgaagaccgagaaatgattaggaaacgactagacatctacaaggactttttcaccgagtcacaactcaagaaactgtacagacggcattacacgggctggggacggctctccgcaaagctcatcaacggcataaggaacaaggaaaatcagaaaacgatcttagactacctgatcgacgacggcagcgccaatcgcaacttcatgcaactaatcaaggacgcaggcctctcattcaagccaatcatcgacaaagcgagaaccggcagccacagcgacaatctgaaagaagtcgtcggcgagctcgcaggctcgccagcaatcaaaaagggcatacttcaaagcctgaaaatagtcgacgaactggtaaaagtcatgggctacgaaccagagcagatagtggtggagatggcccgcgaaaaccaaaccacagcaaaaggcctatcccgctcacgacagcgtctaacgacactacgcgaaagccttgcaaacctcaagagcaacatattggaggagaagaaacccaaatatgtcaaagatcaggtagagaaccaccacctgtctgacgaccgcctcttcctttactaccttcaaaacggcaaagacatgtacaccgacgacgaactcgacattgacaacctctcacaatacgatattgaccacatcatcccccaagccttcataaaagacgactccatcgacaatcgggtactggtctcctccgccaaaaaccgaggcaaatccgacgacgtcccgagcgtggaaattgtaaaagactgcaaagtcttctggaagaaactgctggacgcaaaactcatgtcacaacgtaaatacgacaacctcacgaaagccgaacgaggcggactaacatcggacgacaaggcccgattcatccagcgacagctcgtcgaaacgcgccaaatcacaaaacatgtagcccgaatactagatgaacgctttaacaacgaactcgacagcaagggtcgtagaattaggaaagtcaaaatcgtgacattaaagtccaatctcgtgagcaactttcgaaaggagttcggattctacaagatccgagaagtaaacaactatcaccacgcccacgacgcatacttaaacgctgtcgtagcgaaagccatacttacaaagtacccgcagctagaaccagagttcgtatacggcgactacccgaagtacaactcctacaaaacccgcaaatcagcgacggaaaaacttttcttctacagcaatataatgaacttcttcaaaacaaaagtcacgctagcagacggcacggtcgttgtgaaagacgacattgaggtcaacaacgacaccggagaaatcgtgtgggacaaaaagaaacattttgcaacagtccgcaaagtcctctcatacccccaggtaaacatcgtgaaaaagacggaaatccaaacgggtggtttctcgaaagaatcaattctagcccacggaaacagcgacaaactgataccacggaaaaccaaagacatctacctcgatcccaagaaatacggcgggttcgactcacctatcgtcgcctactccgtcctagttgtcgccgacatcaagaaaggcaaagcacaaaaactaaaaactgtgaccgaactgctcggtataactataatggagaggtcgcgattcgagaaaaatccctccgccttcctggagtccaaaggctacctcgacatccgagacgacaaacttatgatactgccaaaatactcactcttcgaactcgaaaacggccgccggagactactcgcgagtgcgggagaactccaaaaaggaaacgaactggcgctgccgacgcaattcatgaaattcctctacctggcatctcgctacaacgaactaaaagggaaaccggaagaaatcgaacagaaacaagagttcgtcgtacagcacgtatcctacttcgacgacattctacagataataaacgacttctccaacagggtcatattagccgacgcaaacctagaaaagattaataaactttaccaggacaacaaggaaaatatcccggtcgatgaactagccaataacataatcaacctcttcacattcacctccctgggtgcgccagcagccttcaagttcttcgacaaaatagtcgaccgcaaacggtacacctcaacaaaagaagttctcaactccaccctgatccaccaaagcatcacaggactctacgagacgcgcatagaccttgggaagctcggagaggactga

SEQ ID NO: 6614 - RNA, 4113 nt, synthetic construct
  misc_feature 1..4113: note = Cas9 variant
  source 1..4113: mol_type = other RNA
atgaagaaaccgtactcgatcggcctagacatcggcaccaacagcgtgggctgggccgtcgttactgacgactacaaagttcccgccaaaaagatgcgcgtgttcggagacacggatcgctcacacatcaagaaaaacctgctcgggacccttctgttcgacgatggaaacaccgcagagagccgccgcctcaaaagaaccgccaggcgccgttacacacgccggcggaaccgcatactataccttcaggaaatcttcactgaatccatgaacgaaatagacgagagcttcttccaccgcctggacgactccttcttagtgccagaagacaaacgcggcagcaaataccccatcttcgccaccttgcaagaagaaaaagaataccacaaacagttcccaacaatataccacttaaggaagcaactcgctgactcaaaagaaaagtccgacgtgcgcctcatctacctagcactcgcacacatgataaaataccgaggccacttcctctacgaagaaacattcgatatcaagaacaatgatatacagaaaatattcaacgagttcatcaacatctacgacaataccttcgagggctcgtccctgagtggccaaaacgcacaggtcgaagccatattcactgacaaaatatctaagtccgctaaaagggaacgtgttctcaaactattccccgacgaaaagagcaccggcctattcagcgagttcctcaaactcatcgtcggcaaccaggccgacttcaagaaacatttcgacctggaagaaaaagcgccactacaattctcaaaagacacctatgatgaggaactcgagaatctcctcggccagatcggcgacgacttcgctgaccttttcctaatcgccaagaaactctacgatgcaatcctcctttccgggatcctcacggtgacagacccaagcacaaaagcacccctaagtgcctcgatgatcgaacgctacgaaaaccaccaaaaagacctcgccgcactgaaacaattcattaaaaacaacctcccagagaaatacgtagaagtcttttcagatcaatcaaaggacggatacgccggatacatagacggcaaaacaacacaggaggccttctacaagtacatcaagaacctcctaagcaagtttgaaggagccgactacttcctagacaaaatcgaacgcgaggacttcctacgcaaacagcgcacgtttgacaacggtagcatcccccaccaaatccatctgcaagagatgaacgcaatcctacgccggcaaggagaacattacccgttccttaaggagaatagggagaaaatcgaaaagatactaaccttccgaatcccgtactacgtcggccccctggcccgcgacaatcgagatttctcttggctaacccgcaactcagacgagccgattcgcccatggaacttcgaagaggtagtagataaagcgagaagcgctgaggacttcatccaccgcatgaccaactacgatctctacctcccggaagaaaaagtcctccctaaacattccttactatacgagacgttcgctgtctacaacgaactaacaaaggtgaagttcatcgcagaaggcctccgcgattaccaattccttgactcaggccagaagaaacaaatcgtaaaccaactctttaaagagaaacgaaaagttacagaaaaagacatcatccattacttacacaacgtagacggttacgacggaatagaactgaaaggaatcgaaaaacaattcaatgccaacttatccacctaccacgaccttctgaaaatcaccaaagacaaggagttcatggacgacccaaagaatgaagaaatcttagaaaatatagtgcatacactcacgatattcgaagaccgcgaaatgatcaaacaacgcctcgctcaatacgacaccctgttcgacgaaaaggtaataaaagccctcacccgccgtcactacactggctggggtaaactttcggccaaactgatcaacggcatcagagacaaacaatccggtaaaaccatactggactacctaatagacgacgacaaaatcaaccgaaatttcatgcaactgataaacgacgacggtctgagcttcaaagagattatccaaaaagcccaggtcgtagggaagacagacgacgtcaaacaggtagtccaagagctaccaggaagccccgccattaagaaaggaatactacagtcaatcaaaatcgtagacgaactcgtaaaggtcatgggctacgccctagaatcaatcgtaatagaaatggcacgggaaaaccagacaaccgcccgcggcaagaaaaactcccaacaacgctataagcggattgaagacgcactaaagaatctagcacccggcctagactcgaatatattaaaagaaaaccccaccgataacatccagctgaaaaacgatcgactattcctttactacctccaaaacggcaaagatatgtacacgggcaaaccattggacataaaccaactctcaagctacgacatcgaccacataattccccaagcgtttataaaagacgattccatcgataatcgcgtacttacatcaagcaaggacaaccggggcaagagcgacaacgtcccctccctcgaggtagtccagaaaagaaaagcgttctggcaacagctactagattcgaaattgatttcggaaagaaaatttaacaatctgacaaaggcagaacgcggtggactcgacgaacgagacaaagtaggcttcatccgccgtcagctcgtggagactcaacaaatcaccaagaacgtagcgcagatcttggacgccagattcaacacggaagtcaaggagaagaatcagaaaatccggactgtcaaaatcatcacacttaaatccaacctagtctctaactttcgaaaagagttcgggctctataaggtacgcgaaatcaacaactaccaccacgcacacgatgcctacctaaacgcggtcgtagcgaaggccatactcaagaaatatccaaaactcgaacccgagttcgtctatggcgactaccagaaatacgacctcaaaaagtacatatcgcgcttcaaaccctccaaagaaatcgaaaaggccacggaaaaatacttcttctactccaacctactcaatttcttcaaagaagaagtattgtacgcagacggcaccatccgaaaacgagaaaacatcgaatactctaaagacactggtgagatcgcttgggacaaagagaaagacttcgccaccatcaaaaaggtactgtcctacccgcaggtcaatatagtcaaaaagcgcgaagtccaaaccgggggcttctctaaagagtcgatcctgcccaagggaaactctgataagctaatcccacgcaaaactaaggacatcttatgggatactacaaaatacggcgggttcgacagccctgtaatcgcatactccatactcctcatcgcagatatcgaaaaaggcaaagcaaagaaactcaaaaccgtgaaaacgctcgtgggaattaccatcatggaaaaagctgcttttgaagaaaacccaatcaccttcctggaaaacaagggctaccataacgtgcgaaaagaaaacatcctttgcctacccaaatactcactcttcgaactcgaaaacggccggagacgcctactagcatccgcaaaggaactccagaagggaaacgaaatcgtccttcccgtctgcttaaccaccctcctataccactcgaaaaacctacacaagctggacgagcccgaacaccttgaatacatccagaaacaccgaaacgagttcaaggacctactcaatctcgtatccgagttcagccagaaatacattcttgccgaagccaacctcgagaaaatcaaggacctttacgcagataacgaacaggccgacatagaaatactggccaattctttcatcaacctgctaaccttcaccgctcttggagccccagcggcgttcaaatttttcggcaaagacgtcgaccgtaaacgatacaccaccgtgtctgaaatcctgaacgccacactgatccaccaatcaataaccgggctttatgaaacaagaatagacctatcaaagctcggcgaggaatga

SEQ ID NO: 6615 - RNA, 4113 nt, synthetic construct
  misc_feature 1..4113: note = Cas9 variant
  source 1..4113: mol_type = other RNA
atgaagaagccatactccataggcctggacattggcaccaacagcgtcgggtgggccgtaataaccgatgactacaaagtccctgccaagaagatgaaagtactaggaaacacagacaaaaactacattaaaaagaacctcctaggggcactcctcttcgacagcggaaacaccgcagaagatcgtagactgaaacgtaccgcacgtcgccgctatacccgccgtcgaaacagattactctacctgcaagacatattttctgacgaaatgaacaaggtagacgagagcttcttccaccggctcgaagacagctttctggtatctgaagacaaaagaggagaccaccacccgatcttcggtaacgtcgtagacgaagtcaagtaccacgaacagttcccaacaatctaccacctccgcaaatacctggctgacactcccgaaaaggccgacttacgactcgtgtacctcgcactcgcacacatgatcaaatttcgcggacactttctaatcgacgacccaaaactggacgtcaagaacaccgacagccaggaactcttcagccaattcctcaccgcatacgacgtgacccaggaggactcccacctcgccgacgtcaagatcaacatatccgacatcatcacagagaaaatgaacaaatcacgcaaagtagaagccctactatttcacttcccctcccagaagaaaaacagcttcttcggcaatcttgtaagtctcgtcttcggcctactccctaactttaaaacgaacttcaatttggccgaagacgcaaaactgcaactgtccaaagactcctatgacgaagacctagagaatctcctgggccaaattggcgacgagtataccgacgtgttcgttgcagcccgcaaactgtacgacagcatcctcctctccggcatactcacagttaacgacctgtcaacaaaagccattctctcagcaagcatggtgcgacgatacgaagaacataacaaagacctcgccaaactaaaggctttcgtcaaagcgaacttcacccacgatgtattcaaagaggtattttcggacgcctccaaaaacggttatgccggctacatcgagggcaagacatcacaagaggacttctacaaatacgttaagaacctcatagggaaagttgacggctccgccgactttatcgaaaagatcgatcgcgaagacttccttcgcaaacaacgcacattcgataacggctcaatcccacatcaagtccacctagctgaaatgaaggcaatcctccgtcggcaaggagaatactacccgttcctgaaagaacacgccgaaaagatccagcaaatcctcacgttccgaataccctactacgtaggacccctagaccggcacggtcactcagacttcgcctgggccagcttcaactccgaggagaaagtcaccccatggaacttcgaagagataatcgacaaaaacaagagcgcacaggcattcattgaacgcatgactaaccaagacctctatctcccaaacgaaaaagtcctacctaagcactccccactctacgaaaaatacaccgtctacaacgaactcaccaaaataaaatatgtcactgaaacagggaccgccaaattcttcgacgccaacctaaaacaggagatctttgacggccttttcaagaaggaacgcaaggttacaaaacgaaaactactcacattcttagagaaaaactttgacgagttccgtatagtggatatccaagggctcgacaaagaaaccgaaacgttcaacgcatcgtacggaatctaccaggacctgttaaaaatcatcaaggacaaggcattcatggatgactctgaaaatgcggacatcctagaagacatcgtcctcaccctgaccctattcgaagacagagaaatgatcaaacagagactagccaaatacgccgacctctttgataagaaagtcatcgacaacctggcccgccgccgatataccgggtggggccgactgtcagcaaaactcctcaacggaatacgagacaaacgaagccgcaaaacgatcatggactacctcgtcgatgacggccgatccaaccgaaacctcatgcaactcatcacagatgacaaccttaccttcaaagatgaaatcgccaaggcccaatactccgacaactccgatgacctgcaccaagtagtacaagacctcgcggggtcccccgcaatcaagaaagggatactccagagcgtgaaaatcgtggacgagctagtgaaagtaatgggctatgagcctgagcaaatagtcgtcgagatggcgcgcgaaaaccaaacaaccgcgaaaggaagacgaaactcccaacaacgctacaaaagactcgaggaagcaattaaaaacctagatcgagaccttaactacaaaatactaaaggaacaccccaccgacaaccaagcccttcaaaacgatagactcttcctctactatctgcagaacggccgagacatgtacaccggcgagtcacttgacatcaaccgactctcagattacgatatcgaccacataatacctcaagccttcatcaaagacaacagcattgacaatagggtacttgtgtcttcagccaaaaaccgaggcaaatctgacgacgtcccctcggaggacgtcgtaaaccgcatgcgacccttttggaacaaactactcaactgcgggctcatctcccagcgaaagtactcaaacctcacgaagaaagaactaacccccaacgacaaggctggcttcattaaacgtcagctagtcgaaaccaggcaaatcaccaaacacgtagcgcgaatactagacgaacacttcaacaaagagttcgacgaagacaagaaacgcatccgaaaagtaaaagtcgtcactctcaaatctaacctagtcagcaatttccggaaagagtttgagctgtacaaggtgcgcgaaatcaacgattaccaccacgcgcacgacgcctacctcaacgccgttgtcgcaaaagcgctcctaatgaagtacccaaaactcgaaccagagttcgtttacggggaatacccaaaatacaactcctacagagaaaggaaaaccgcaacacaacgaatgttcttctattcaaacattatgaacatgttcaaaagcaaagtaaaactggccgacgaacgaatcatcgaacggcctatgatcgaagtcaatgacgagacaggtgaaatcgcctgggacaaaaccaaacatatagcaaccgtcaaaaaggtcctctcatacccgcaaatcaacatcgtcaagaaagtagaagaacagaccggcgggctaaccaacgagaccatctatccccgcggatcgttcgacaaattgttaaaccgcaaaaacacactcgaggcaagcaaatacgggggctttggtagcccaacagtagcatactgcgtactcgtagtcgcggactccaaaaacgagaacggaaaagtcaaaaagctgaagctcggctccgagctcctaggcatcacaattctagagaaaaacgacttcgaaaacaactcgctggacttcttgagccgaaaaggctaccaaggcgtccaagaaaagaagatcataaagctccccaaatattcactattcgagttccaagatgggagcagacgcatgctctcctcggtgatggcaaacgacaataaacggggcgacctacagaaggccaacgaaatgatcctcccggcctacctcgtcaagctcctctaccacgccaaacatatcaactccgtcggtgaaccggcgcacaagaactacataaacgaacattgctcagagttccaagacctcctgaactacatcagacagttcgccgacaaattcgtagacgtcgacaaaaatttgagcaaaatacggtcgctctccaagtcaatggccgaatactccgtttccgaaatatgctcatcgtttgtaaacctgctcaccctaaccgcccttggagcccccgcagacttcaaattcttcggcaccacaatcccgagaaaacggtacggctcgccccagtcgatactatccgccaccctgatacaccaaagtataaccggactctatgaaacccgaatcgatctcagcaaactcggggaagattga

SEQ ID NO: 6616 - RNA, 4113 nt, synthetic construct
  misc_feature 1..4113: note = Cas9 variant
  source 1..4113: mol_type = other RNA
atgaacaaaccgtactcgatcggccttgacatcggcaccaattcagtgggctggtccataatcacggacgactacaaggtaccggccaagaaaatgagagtcctaggaaacaccgacaaggaatacataaagaaaaacctaattggggcgctccttttcgacggcggtaacaccgcggcagaccgcaggctaaaacgaaccgctcgacgccgctacaccaggagacgaaaccgaatcttgtacctacaggaaatattcgcggaagaaatgtccaaagtcgacgatagtttcttccaccgcctcgaagacagcttcctcgtggaagaggacaaacgaggatcgaagtacccgatatttgcaacaatgcaggaggagaagtattaccacgaaaaattccccaccatataccacctccgaaaagaactcgccgacaagaaagaaaaagctgacctacgcctaatatacctagcgctggcacatatcataaagttcagaggacactttctaatcgaagacgaccggttcgacgtacggaacacggacatccaaaaacagtaccaagccttcctagaaatcttcgacaccaccttcgagaacaacgacctgctaagtcaaaacgtggacgttgaggccatactgacggacaagatcagcaagagtgccaaaaaggacagaatcctggcgcgctacccgaaccaaaagagcacaggtatttttgcggagttcctaaagctcatcgtaggaaaccaagctgacttcaagaaacacttcaacctcgaagataagaccccgctacaattcgctaaagactcatatgacgaagacctagaaaacctcctaggacagataggagacgagttcgctgaccttttctctgcagccaagaaactttacgattctgtactgctaagcggcatcctcacagttacagatctatcaacaaaagccccgctaagcgcctcaatgatccaacgctacgacgaacaccgagaagacctaaagcaactcaagcaattcgtcaaggccagcctgccggagaagtaccaagaaatattcgcagacagttccaaggacggctatgcaggctacatcgaaggaaagaccaaccaagaagccttctacaaatatctctccaaactactcaccaaacaagaaggcagcgaatacctcctagagaaaatcaaaaacgaagacttcctacgtaaacagcgcacatttgacaacggatcaataccacaccaggtccacctcactgaactccgcgcgatcatccgcaggcagtcggaatactacccctttctcaaagaaaacctcgaccgcatagagaaaattctaaccttccgcatcccatactacgtcggccccctagcccgtgaaaaatctgacttcgcctggatgacgcgcaaaaccgacgacagcatcaggccctggaacttcgaagacttagttgacaaagagaaatctgccgaggcgttcatccatcgtatgactaacaacgacctatacctacccgaagagaaggtattaccaaagcactccctaatctacgaaaaattcaccgtttataacgagctaaccaaagttcgcttcctagccgagggattcaaagactttcaatttctcaacagaaaacagaaagaaacgatcttcaacagcctattcaaagagaagcgcaaggtcaccgaaaaagacataatatccttcctcaacaaagtagacggctacgaggggatcgctataaaaggaatagagaagcaattcaacgcatccttgtccacataccacgaccttaaaaagatactaggaaaagatttcctagataacacagacaacgagctcatactggaagacatagttcaaacgctcaccctcttcgaggaccgagaaatgatacgaaagcgcctcgacatatacaaagacttcttcacggaatctcagctcaaaaagctctaccgccggcactacacgggctggggccgcctaagtgccaaactcatcaacgggattcgcaataaagaaaaccagaagacaatcctagactacctcatcgacgacggatccgctaaccgcaactttatgcaactaataaaagacgcaggcctctcattcaaacccatcatcgacaaggcacgcacgggctcccactcagacaatctaaaagaggtagtcggagagctagccgggtcacccgcaataaagaaaggtatactgcagagcctcaaaatcgtcgacgagctggtcaaagtcatgggctacgaacccgaacaaatcgtcgtagaaatggcccgtgagaaccagactacggccaaaggattatcacgactgcgccaaaggctcaccacgttacgcgaatctctcgcaaacttaaaatctaacatactagaagagaagaaacccaagtacgtcaaagaccaagtagaaaaccatcacctctccgatgaccgcctcttcctgtactatctgcaaaacggtaaagacatgtacacagacgacgaactcgacatagacaacctctcccaatacgatatagatcacataataccacaggcattcataaaagatgactcaatcgacaaccgagttctcgtctcctcagcgaaaaatcgcggaaaaagcgacgatgtgcccagcgtagagatagtaaaggactgtaaggtcttctggaaaaagctcctggatgccaaactaatgtcacagcggaagtacgacaatctgaccaaggccgaacgtggaggcctaacttctgacgacaaagcacgcttcatccagagacagctagtcgaaacccgccagataaccaaacacgtcgcgcgaatcctggacgaaaggttcaacaacgaactcgattccaagggacgacggattcgaaaagtaaagatagtcacgctaaaaagtaaccttgtcagcaacttcagaaaagagttcggcttctacaagatccgggaagtgaacaactaccatcacgcacacgacgcgtacctaaacgctgtcgtcgccaaggccattctcactaaatatccccagctagagcccgagttcgtgtatggcgactaccccaaatacaactcctataaaacccgaaagagcgccacagaaaaactcttcttctactcaaacatcatgaacttcttcaagacgaaggtaacccttgctgatggtacggtggtagtgaaagacgacatcgaagtcaacaacgacacaggagaaatcgtgtgggacaaaaagaaacacttcgccaccgtgcgcaaagtcctctcgtaccctcaagtcaacatagttaagaaaaccgagatccagaccggagggttctcaaaagagtcaatcctcgcccacggaaattccgacaaactgataccacggaaaacaaaggacatctacttagacccgaagaaatacggcggcttcgactcaccgatcgtagcatacagcgtcctagttgtcgcagacatcaagaaaggaaaagcccaaaagctgaaaacggttacagagctattagggataaccatcatggaacgaagtcgcttcgagaaaaacccatcagcctttctcgaaagcaagggatacctcaatatccgcgacgacaaactaatgatactcccgaagtactccctcttcgaactcgaaaacggaagacggaggctcctcgcatctgccgacgaactccaaaaagggaacgaactagccttacccacccagttcatgaagttcctctacctggcctcacgctacaacgaactcaaaggcaagccagaagaaatcgagcagaaacaggagttcgtcgtacagcacgtctcctacttcgacgacatactacaaatcatcaacgactttagcaaccgcgtcattttagcagacgccaacctcgagaaaatcaacaaactttaccaggataacaaagagaacatacccgtcgacgaactcgcaaataatatcataaacctcttcacatttacctctctcggcgccccggccgcattcaaattcttcgacaaaatcgtcgaccgtaaacgctacacctccaccaaggaagtcctaaacagcacactgatacaccaatccataacgggactttacgaaactcggatagaccttggcaaactcggcgaagactga

SEQ ID NO: 6617 - RNA, 4113 nt, synthetic construct
  misc_feature 1..4113: note = Cas9 variant
  source 1..4113: mol_type = other RNA
atggaaaagaataaagaatacgtaatcggcctagacatcggcaccgggtcggttggctggtcagcaatctccacggacaactaccagctcatcaggcagaaaggcaaaaaccttatcggtgtccgattattcaactcagctgaaactgcggaggaacgacgcggctatagaacgacaagacggcgtctctccagacgtcgatggagaatgtcactgctcaacgacatcttccgcccagagctcaacgaaatcgacgaaaactttctggcacggcttaagtattcgtgggtgtccccgctggaccagaaaaacccccaacttaacgagcaaggcacaaacgcctccctttacggagacatcgaggccgatcaagcctttcacagggcctacccaacaatctaccatctgcgcaagaccctgatggaggacaaccagaagcacgacctacgtgaagtatacctcgcaatacaccacatcgtaaagtatcggggacacttcctaaccccggacttcgacgcaaattcgcaaacgatagacatcaaaggactgttcaagcaactgggagacgtgagcgggagcatcgaactgcaagccgaccagacaagcacagtcatcgccgcattccaatccatactgctggacttcacgaagacgccaactgagtcgggtcggctggccgggcagctattctcagatcagaacaaggataaacaggccaaaaagcaagtagaggaactgttcaagctcctcaggggcggcaaaggaagcctcgctgacatgtttctcctcaccgacctcgacaaagtggtcaaaaaccaattaaaattcgcgttcgatgacgccgtggatgaaaacctaaaccttatcagcaatctaataaacgaggagcaatacgaactcctcctcaatatccaaaaactccgaggaaccatcatactcaaacaaatactcggcgacgacgaaaccgtatcagacgcgaaagtcagatcatatgaagaacacgcacaccagctgaaggagctaaaagcacaagtgctgaccaaagacaacaaagaaaaattcgaagaggcttatcaactcatacaaaaaggagatgccagcaggatcgacggcctcaagaaactcaaaacgatcatcaatcaagaacacgaggcgctaaggctggacaaatacgaagccgacaaactcctgaagctgatagaactcgaccagctactaccagtgcaacgatccaaacgtaatggcgaaatcccgcaccaactgcacgagttcgaactgaagaaaatcattgaaaaacaagggaggtactacccgttcttaagagaaaccttcgaacgagacggccaggagttcaacaaaatcggtcaactcgtcaacttccgcattccgtactacgtcgggccacttgtcgacccacgcctggccggcatccaatcgggcgaccagaccaaccactggatgacccagaaaaaggcgggcaagatcactccctggaactatacagaattgatcgacatcgacaaatcggctgcagagttcattaaaagaatgaccggaacggacacatacctcgtgggggaaccctccctacacaaagcctcactaatataccaagactacaacgttctccaagaactcaataacctccgatatgacggaaaaccgctgccggtagatgcaaagcaggaaatctactcgaacttacaggtgtccctaaagaacgccacgaaaaacaaaattaactccttcctaatctcagaaggttacctccaagacggcgaagaactaacaggatttgcaggcaaagaactcaaaaacaagctaagttccttccactatttcaaaaacatctttggaccagaaagaatgaacaccctgggcaccgacaacctcgagaaaataaccgaactgcaaactgtattcgaagaccgacacatgctgaaacgccaattacaaaaactcggcttcttagacgatgacgaatgcgaaaaactcgcgggcaaacacttcaccggttgggggaacctgagcaagaaactccttaacaccccggcaatcatcgaccccgaaataaatgaaaataaaatctccttaatcgacgccctatataaaggccaacgcaacctgtccttctacgtcaacaacatggacgacaaataccaattccgcgactggatcgaatcagaaaaccaatcccagcaagtagaaatcagcctagacgagaaaatcaaaaacctggcggggtcccccgccatcaaaagaggcatcactcaatctatggctgtaatccaagacataatacgtgccaataacggcatctccccaaaaaggatctacctggagttcgcacgagaaagccagaacagctaccaaccgaacagccgcatcaaacagatcgagaaaatctacgaccaaaacaagaaagaactaatgaaagtctacccagacgtattcaaagacgtccaaggcgtactcaacaacgtcgatgaaaacaacagcctttccgaaaaagccttcctctacttcatgcagttggggaaagacatgtacaccggagaagccctagatttcgacaaactatacacctacgacatcgaccacatcatcccacaagcgatgacaaaagacaatagttgggacaacaaagtcctagtaacagcaatcaaaaaccgggaaaaatccaaccaagtcctcgacaacgcgatacaagcaaaaatgcacaacttctggctgcagctcaaaaaggtgaacctactaagccagcgtaaatacgacaccctgatgaagacaaacttctcaaagggtgacgaaaagaagttcatagctaggagcctcgtagaaacacggcaaatcatcaaaaacgtcgccgaactgataaaatcagagttcgaccatgtggaagcgatacccatacgccaggaactcaccagtgacatgcgccaactcatggactataagaaaaaccggctagtaaacgactaccatcacgcccacgacgcgttgctaattgccacggtgggagaatttatgcaaaagcgcggcttcatgcagggaatgaacccctcccaaaacgtttatcacggctacacccagtacgtcaaaaagtggctcagcatggccaaaaaggcacggagcgccgaaaaacccgaacgaatcttccccttacaattcgtcgtaggatccatgcggatggcagtgcgtgacggccaggtcgacaaagtcacacacccagcgacgggcgagatctgctggaccgctgacaacgaagcgtacctccgaaaggtcctcggatacaagaacatactggttacccgaaaggtcaaaaacgccggaaaactgtaccagcgagtaacagtaaaaccaaaaggctccggggaagcccccgtaaatcaccaaaaatcagacataaacatctacggaggcgttacgagcgagcaggccgcagaactcgtactcatacgcatcaaagccaaaaacaacgctaaaaacatggtaatcaagattcccacagccatcgcgaaccaggttgccaacaaaacgacaacctacgacgcctacgttaggtcactcaacatacctaattacgcaggcatcatactggaccaaatcccgctcgggcagctagtcttcgacgagcggaccagtttctacctcgcgagcgccgaaattaaacacaacgcccgccaactctgggtaaaccaacacataaataacgtccttaccaaaaagaacatcaacgacgaagaacgcgataacatcctcaacctactcacaaacgagaaaaacctggaaagattcaaactactagaaccagacctcaaacgcgtcaaggccgccaagcagcagtgggcgtcctgcgacgaccaagaacagatgcaaatcctccgcatcatcattaacaagatgcacgacgacgcgagtccccaaatcccaggaaaaattgatcccttcaaaaactatcttgacaaacaagggaagggctggcgcgacctccgcaccaaaaagggaatgaaacttagcgacaacgccgaatttgtgtaccagagccccacagggctctaccaccgaaagatttcaatcaacgaactcctaaagcaaaaacagcttgaatga

SEQ ID NO: 6618 - RNA, 4113 nt, synthetic construct
  misc_feature 1..4113: note = Cas9 variant
  source 1..4113: mol_type = other RNA
atgaacaaaccatacagcatcggactggacatcggaactaactccgtgggctggagcataatcaccgacgactataaagtccccgctaaaaagatgcgagtactagggaacacggacaaagaatacatcaagaaaaacctaatcggcgccctcctattcgacggaggcaacaccgccgcagacagaagactgaaacgcaccgcaaggcgaaggtacacccggcgccgcaatcgcatcctctacctccaagaaatcttcgcagaagaaatgtcgaaagtggatgatagcttcttccaccgactcgaggactcatttctcgtagaagaagacaaacgtggatcgaaatacccgatcttcgcaaccatgcaagaggaaaaatactatcacgaaaaattcccgacaatataccaccttcgaaaagaacttgccgacaagaaagagaaagcggatctacggctgatataccttgccctagcccacataataaaattccgcggacacttcctcattgaagacgaccgattcgacgtccgcaacaccgatatccaaaaacaataccaagcattcctcgagatcttcgacaccacattcgagaacaacgacctgttatcacaaaacgtcgatgtcgaagcgatccttaccgacaagatctcaaagagcgcgaagaaggacaggattctcgccagataccctaaccaaaaatccaccggaatcttcgccgagttcttgaaactcatagtcggaaaccaggcggacttcaagaaacacttcaacctcgaagataagacaccccttcaattcgcaaaagactcctacgacgaagacctagaaaaccttcttgggcaaatcggagacgagttcgcggacctattcagcgccgccaagaaactatacgactcggtcctgctcagcgggatcctgacggtcacggacctatcaacgaaagccccactcagtgccagcatgatacaacgctacgacgaacaccgcgaagacctgaaacaactcaaacaattcgtcaaagcctcacttcccgaaaagtatcaagagatattcgccgacagcagcaaagacgggtacgctggatacatcgaaggcaagaccaaccaagaagcattttacaaatacctctccaagctactcaccaaacaagaaggaagcgaatatctcctagaaaagatcaaaaacgaagacttcctcaggaaacaacgcacatttgacaacggatccataccccaccaagtacacctgacagaactgcgtgcaataatacgacgacagtccgaatactaccccttcctaaaggagaacctagacaggatcgagaaaatactcacgttccgcatcccctactacgtagggcccctagcacgggaaaagtcggacttcgcatggatgacccgaaagacagacgacagcatacgcccctggaacttcgaagacctcgtcgacaaggaaaaatccgccgaagccttcatacacagaatgaccaacaacgacctgtacctccccgaggaaaaggtcctccccaagcatagtctgatctacgaaaaattcacggtatataacgaactcaccaaggttagattcctagcggaaggcttcaaggactttcaattcctaaaccgcaagcagaaggaaacaatattcaactccctatttaaagagaaacgcaaagtcaccgaaaaagacataatctcattcctaaacaaggtcgacgggtacgagggcatcgcgatcaagggcattgaaaagcagttcaacgcaagcctctcaacgtaccacgacctaaagaaaatcctgggcaaagacttcctagacaacaccgacaacgagcttatcctggaagacatcgtccaaacgctcacacttttcgaagaccgtgagatgatccgcaagcgcctagacatttataaggacttcttcaccgaatcacaactgaaaaagctgtaccgcagacactatacaggatggggccgactaagcgcaaaactcataaatggcatacgaaacaaggagaatcagaaaaccattctcgactacctgatagacgacggctctgctaaccgcaactttatgcagcttatcaaagacgcgggcctgtcgttcaaacccatcatcgacaaagcaagaacaggatcccacctcgacaacctcaaagaagtggtgggggaactggccggctccccggcgatcaagaaaggaattttacaatcactaaaaatcgtagacgaactcgtaaaagtaatgggctacgaaccagaacaaatagtagtcgaaatggctcgcgagaaccaaactacagcaaaaggtctcagccgatcacgccagcggctaacaacacttagagaatcactcgcaaacctcaaatctaacatcctcgaggagaagaaaccaaaatacgtcaaagaccaagtcgagaaccaccacctgagtgacgaccgcctatttctatattatctccaaaatggcaaagacatgtacaccgacgatgagttagacatcgacaatctatcgcaatacgacatagaccatataataccgcaagcattcatcaaggacgactccatagacaaccgggtcctggtatcgtccgcgaaaaaccgaggaaaatcagatgacgtcccgtcactcgagatagtcaaagactgcaaggtattctggaagaaacttctcgatgccaaactgatgagtcaacgcaaatacgacaacttgacaaaagctgaaaggggcggcctcacatcggatgacaaagcccgcttcatacaacgacaactcgtagagacacggcaaataacaaaacacgtcgcacgcatactcgacgagcgcttcaacaacgaactcgacagcaaagggcgccggatccgaaaagtgaaaatcgtcaccctcaaaagcaacctcgtcagcaatttccgcaaagagttcggattctacaaaataagagaagtcaacaactaccatcacgcacacgacgcatacctgaatgctgtcgtagccaaggctatcctaaccaagtacccgcaactagaaccggagttcgtttacggggactacccaaagtacaacagctacaaaacccgaaaaagcgctacggaaaagctgttcttttacagcaacatcatgaacttcttcaaaaccaaagtcaccctggcagatggcacggtcgtcgtcaaagacgacatcgaagtaaacaacgacacaggagaaatagtctgggataaaaagaaacattttgccaccgtgcgcaaagtgctctcctacccacaagttaacatagtaaagaaaaccgaagtccagactgggggcttctccaaggaatccatcctcgcacacggcaactcagacaagttaatcccacgtaaaacaaaggacatatacctcgatccgaagaaatacggcggcttcgactccccaatcgtcgcatactctgtcctggttgtagcggatataaagaaaggcaaagcccagaaactcaaaaccgtcaccgaactcctcggaatcacaataatggaacggtcgcgattcgaaaagaaccccagtgcatttctagaatccaagggctatcttaacatcaggacagataaactaatcatactcccaaaatacagcctattcgagttggaaaacggacgacgccgcctattagctagtgcaggcgaactccaaaagggaaacgaactagccctgccgacccaatacatgaagttcctctacctagcctcacgatacaacgaactaaaaggaaaaccagaagagatcgaacaaaagcaggagttcgtcgttcaacacgtctcttactttgacgatatactccaaattatcaatgacttctcgaaccgagtcatcctcgcagatgcaaatctggagaaaataaacaaactctaccaagacaacaaagaaaacattccggtggacgaactagcaaacaacataataaacctattcaccttcacgtctctcggcgcaccggccgcattcaaattcttcgacaaaatcgtagaccggaaaagatataccagcacgaaagaagtactgaactccaccctcatccaccaatcaatcacagggctatacgagacccgcatagacctggggaaactgggggaaggttga

SEQ ID NO: 6619 - RNA, 4113 nt, synthetic construct
  misc_feature 1..4113: note = Cas9 variant
  source 1..4113: mol_type = other RNA
atgaacaaaccttattcaatcggccttgacataggaactaatagtgtaggctggagcatcataacggacgactacaaagtaccggccaagaagatgagggtactgggcaacaccgacaaggaatacattaagaaaaacctaattggcgcactcctcttcgacggaggcaacacagccgccgaccgccgccttaaaagaaccgcacgccgccgctacactcgacgccgcaaccgcattttgtaccttcaagaaattttcgccgaggaaatgtccaaagtcgacgactccttcttccatcgcctcgaggatagcttcctagtcgaagaggataagcgcggcagcaaataccccatctttgcgactctccaagaagagaaagactaccacgaaaagttctccacgatttaccacctacggaaagagctcgccgacaagaaagagaaggcagacctgcgacttatctacatagccctcgcacacattattaagttcagaggacacttccttatcgaggacgactccttcgacgtccgcaacacagacataagtaagcaatatcaggactttttagaaatcttcaacaccacatttgaaaacaacgacttactgtcccagaacgtagacgtagaagcaattctcaccgacaaaatatcaaaatcagcaaagaaagaccgcatactcgcacaataccccaaccagaaatccaccggaatattcgcagagttcctcaaattaatcgtcggcaatcaggccgatttcaaaaagtacttcaacctggaggacaaaaccccactacaattcgccaaagacagctacgacgaagatttggaaaatttactaggccaaatcggagacgagttcgcggatctcttttctgcagccaagaaattatacgactccgtccttctctccggaatactaaccgtaatagatctttccactaaagcacccctttccgcctctatgatccaacgatacgacgaacaccgcgaagacttgaaacaactcaaacaattcgtcaaagcctcgctccccgaaaaataccaagaaatcttcgccgactcctccaaagacgggtacgccgggtacatagaaggcaaaacgaaccaggaggcattctacaaatacctgtcgaaactactcacaaaacaagaggacagcgagaacttcctagagaaaatcaaaaacgaagacttcctccgcaagcaaagaacattcgacaacggctccatcccacatcaggtccacctcaccgaattgaaggcaatcatacgtcgtcagtcggaatactacccattcctaaaagagaaccaagacagaatcgaaaagatccttaccttcaggatcccctactacatcggccccctagcacgcgaaaaatcagacttcgcatggatgacccgcaagaccgacgactcaatcaggccctggaactttgaagacttagtcgacaaagaaaaatccgcagaagcctttatccaccggatgactaacaatgatttttaccttcctgaagagaaggtgctaccaaagcactccctcatctacgaaaaattcaccgtatacaacgaactaaccaaggtccgctataaaaatgaacaaggcgaaacatacttcttcgactccaatatcaaacaggaaatcttcgacggagtatttaaagaacaccgcaaagtctccaagaaaaagctactagacttcctcgccaaagaatacgaggagttccggatagtcgatgtcataggtcttgacaaagaaaacaaagcattcaacgcctccctcggcacttaccacgacctagagaaaatcctagataaggacttcctagacaacccggacaacgaatcaatactggaagacattgtacaaacactaaccctcttcgaggaccgagagatgatcaaaaagcgcctcgaaaattataaagacctcttcaccgaatcgcagctcaagaaactttaccgccgacactacaccggatggggccgcctcagtgcaaaactcataaacggtattcgtgacaaagaatcacagaaaactatactcgattatctcatcgatgacggacgctccaacagaaatttcatgcaactcataaacgacgacggactatcctttaaaagcatcatatccaaggcacaagcaggaagccacagcgacaacctaaaagaggtggtcggagaactagccggttcccccgccatcaagaagggcatcctgcaatcactcaagatcgtcgacgaactcgtcaaggtaatgggctatgaaccagagcaaatcgtggtcgagatggcaagagaaaaccaaacgacaaaccaaggaagacgcaactcacgacagagatataagctcctggacgacggcgtcaaaaacctcgcgagcgatctaaatggcaacatattaaaagaataccccactgacaaccaggcactccaaaacgagcgacttttcctctattatctgcaaaacggccgcgacatgtacaccggcgaagcactagacatagacgacctctcacaatacgacatcgaccacataataccgcaggccttcataaaggatgactccatagacaaccgcgtactcgtatccagtgccaaaaatcgaggcaaatctgacgacgtccccagcctagaaatagtaaaagactgcaaagtcttctggaagaaactactagatgccaagctcatgtcgcaacgcaagtacgataacctcacaaaagccgagaggggcggcctaacttcagacgacaaagcacgtttcatacagcgccagctagtggaaacacgccaaatcactaagcacgttgcccgcatcctagacgaacggtttaacaacgaactggacagcaaaggccggcgcatccgcaaagtaaaaatagtcacgctcaaatcgaatctcgtcagcaacttccggaaagagttcggcttctacaaaatccgggaggtaaacaactaccaccacgcccacgacgcctacctcaatgcggtcgtcgcgaaagccatcctcacaaagtatcctcaactagagccggagttcgtctacggcgactatcctaaatataattcctacaaaactagaaagagcgctaccgaaaagctattcttttactccaatatcatgaacttcttcaagaccaaagttacgctggccgacggaaccgtggtagtaaaggacgacatagaagtaaacaacgacaccggggagatagtctgggataaaaagaaacacttcgccacggtcaggaaagtattaagctacccccaaaacaatatagtaaagaaaaccgagattcaaacaggaggcttcagcaaagaatccatcctagcacacggaaattccgacaaactaatccctcgcaaaacaaaggacatctacctagatcctaagaaatacgggggattcgactcacccatcgtagcatactcggtactggtcgtcgctgacatcaagaaaggaaaagcccaaaaactcaaaaccgtaacggagctactgggcatcacaataatggaacgctcccgtttcgagaaaaacccatccgcattcctcgaaagcaaaggctacctcaacatcagagcagacaaactaatcatactgcccaaatactctctctttgagctggaaaacggacggcgccgactcctagcctccgccggagagctccagaaaggaaacgaactggccttacccacgcaattcatgaaatttctataccttgcctcgcgctacaacgaatccaagggcaagcctgaagaaatcgaaaagaaacaagagtttgtaaaccagcatgtatcatattttgacgacatcctccagcttatcaacgacttctccaagcgcgtcatactagccgatgccaaccttgagaaaataaacaaactatatcaggacaacaaagaaaacatctccgtcgacgaactcgcaaataacatcataaatctattcaccttcaccagcctaggcgctccggcggcgttcaaattcttcgacaagatcgtagatcgcaaaaggtacacctccacaaaagaagtgctaaactcgacactgatccaccagtctatcacgggactttacgagacgcgaatcgacctcggcaaactgggggaagattga

SEQ ID NO: 6620 - RNA, 4113 nt, synthetic construct
  misc_feature 1..4113: note = Cas9 variant
  source 1..4113: mol_type = other RNA
atgaacaagccatacagtataggactggacatcggcacaaactcagtagggtggtcaatcattaccgacgactacaaagtaccagccaaaaagatgcgggtacttggcaacacagataaggaatacatcaagaagaacctgataggcgcactgctattcgatggcggcaatacagccgccgaccgtcgacttaagcggaccgcaaggcggcgctacacccgccgacgaaaccgcattctctacctccaagaaatttttgctgaagaaatgtccaaagtggacgactcattcttccaccgtttggaggacagcttcctcgtcgaagaagataaaagaggaagcaaatatccgatcttcgccaccctacaggaagaaaaggattaccacgaaaaattctcgacaatctaccatctgcgcaaggaactcgccgacaaaaaggagagggccgaccttcgcctgatctacatcgcgctcgcacacattataaaattccgtggtcacttccttatagaagacgactcattcgacgtcaggaacaccgatatctccaaacagtatcaggacttcctcgagatcttcaacaccacgttcgaaaacaacgacctcctcagccaaaacgtcgacgtcgaggccatcctaaccgacaaaataagcaaatccgctaagaaagacagaatcctagcacaataccctaatcaaaagtctacaggcatcttcgccgaatttctcaaactgatcgtaggtaaccaagctgatttcaaaaagtactttaacctcgaagataagaccccgctccaattcgcgaaagacagctatgacgaagaccttgaaaacctgctaggccaaatcggcgacgaatttgccgaccttttcagcgctgcaaagaaactttatgactcagtactcctatcaggcatcctcacagtcatcgacctcagcaccaaagcacccctttctgctagcatgatacaacggtacgacgaacaccgcgaagacctgaaacagcttaaacaattcgtaaaggcctccctcccggagaaataccaagaaatcttcgccgacagctccaaggacggctacgccggatacatagaaggaaagaccaaccaagaagcattctacaagtatctatcgaagctactgacaaaacaagaggactcagaaaacttcctggaaaagatcaaaaacgaagacttcctccgaaaacaacgcaccttcgacaatggatccataccccatcaggtccacctcacggaactcaaggccataatccgcaggcagtccgaatactatcccttcctaaaggagaatcaggaccggatagagaagatactaaccttccgaatcccctactacatcggaccgctcgcacgtgagaaatctgacttcgcctggatgacgcgcaaaaccgacgacagcatccgcccctggaactttgaggacctcgttgacaaggagaaaagcgccgaagccttcatacacaggatgaccaataacgacttctaccttccggaggagaaagtgctcccaaaacactcgctgatatacgagaagtttaccgtatacaacgaactaaccaaagtacgctacaaaaatgaacaaggcgaaacatacttcttcgactccaacatcaaacaggaaatcttcgacggggtattcaaagagcacagaaaggtatccaagaaaaagttactggacttcctggcaaaggagtacgaggagttcaggatagtggacgtcatcgggcttgacaaagaaaacaaagcattcaacgcatcgctcggtacttaccacgacctcgagaagatcctcgacaaagacttcctggacaacccagacaacgaaagcatactagaggacattgtccaaaccttgaccctctttgaagaccgtgaaatgatcaagaaacgactcgagaattacaaagacctattcaccgagagtcagctaaagaaactctaccgacgccactacacaggatggggccgcctcagcgctaaactcatcaacggaatccgagataaagaatcccagaaaacaatcctcgactacttgattgacgacggtcggtcaaaccgtaatttcatgcaactgatcaacgacgacggactgtcattcaaatccattatatcgaaggcgcaggcgggttcccacagcgataacttgaaagaggttgtgggcgaactcgcgggatcacccgccatcaagaaaggcatcctacagagcctcaaaatcgttgacgaactcgtgaaggtcatgggctatgaacccgaacagatcgtagtagaaatggcgcgcgaaaaccaaaccacgaaccaagggagacgcaactcgcgacaacgatacaaactactcgacgacggcgtcaagaatctcgccagcgacctaaacggcaacatacttaaagagtaccccaccgacaatcaagcccttcaaaacgaacgactcttcctctattatctgcaaaacggccgagacatgtacaccggggaggcattagacatagacgaccttagccaatacgatatagaccacataatcccacaagcctttatcaaagatgacagcatcgacaaccgggtcctagtaagctccgccaagaaccgaggtaaaagcgacgacgtgccgagcctcgaaatcgtcaaagactgtaaagttttctggaaaaagctcctagacgcaaaacttatgtcacagcgaaagtacgacaacctcacaaaggcggaaagaggcggcttaacctcagacgataaggcccggttcatccaaagacagctcgtagaaacacgccaaataaccaaacatgtcgccagaatactcgacgaacgattcaataatgagcttgacagcaaaggccgccgtattcgcaaagtaaaaatagtcacactaaaaagtaacttggtctccaacttccgtaaagagttcgggttctacaagatccgcgaggtcaacaattaccaccacgcacacgacgcatacctaaacgccgtagtagcaaaagcaatactcaccaaatacccacaactagaacctgagttcgtctacggagactacccaaaatacaactcgtacaagacgcgcaagagcgcaacagaaaaactcttcttctactccaacatcatgaacttcttcaaaaccaaggtaacactcgccgacggcaccgttgtcgttaaggacgacatagaagtaaacaacgataccggtgagatcgtatgggacaaaaagaaacactttgccacggtacgcaaagtcctctcgtacccccaaaacaacatcgttaagaaaacggagatccagaccggtgggttctcaaaagaatccatcctcgcacatggcaacagcgacaaactcatcccacgtaaaaccaaagacatctacctcgaccctaaaaagtacggaggattcgacagccccatcgtagcctacagcgtactggtggtagccgacatcaagaaaggtaaagcgcagaagttgaagaccgtcaccgagctcctcgggatcacgataatggaacgctcccgcttcgagaaaaacccctccgcgttcctcgaatcaaaggggtacctcaacatacgcgcagataagctcatcattctaccgaaatactccctgttcgaacttgaaaacggcaggcgccgactcctcgcatcggccggtgaactacagaaaggcaacgaactagcactacccacccaattcatgaaattcctatatctcgcttcccgctataacgaatcgaaaggcaagccagaagaaatcgaaaagaaacaggagttcgtcaatcagcacgtcagctatttcgacgatatactccagctaataaacgacttttccaaacgcgtcatactggccgacgccaacctcgagaaaattaacaaactctatcaggacaacaaagaaaacatctccgtagacgaattagcgaacaacatcataaacctctttacgtttacatcgctgggcgcacccgcagccttcaaattcttcgacaaaatcgtcgacagaaaacgatacacttcaaccaaggaagtgctcaactccacgctgatccaccaatcaatcaccggcctctacgaaacccggatcgacttaggcaaacttggagaagactga

SEQ ID NO: 6621 - RNA, 4113 nt, synthetic construct
  misc_feature 1..4113: note = Cas9 variant
  source 1..4113: mol_type = other RNA
atgaacaagccatactcgatcggcctcgacatcggaacgaacagcgtaggatggagcataatcacagacgattacaaagtcccagccaagaaaatgcgggttctcggaaacacggacaaggaatacatcaagaaaaatctcatcggtgcactcctcttcgacggcgggaataccgcatcggatcgccgactaaaacgcacggccagacgtcgctatacccggcgccgaaaccggatactctacctacaagagattttcgcagaagaaatgtccaaggtcgacgactccttctttcaccgtctcgaagactcattcctagtcgaagacgacaaacgaggatccaaatatccaatattcgccacaatgcaagaagaaaaagactaccacgagaaattcccaaccatctaccatctgcgtaaagaactagccgacaaaaaggaaaaagcagacctccgactcttctacctagcgcttgcccacatcatcaaattccgcggccacttcttaatcgaagacgactcgttcgacgtcaggaacacggacatccaacggcagtaccaggccttcctcgaaatcttcgacaccaccttcgaaaacaatcacctactctcccaaaacatcgatgtcgaaggaatacttaccgataagatctccaaaagcgctaagaaagaccgcatactagcccagtaccccaatcagaaatcaaccgggatattcgcggagttcctgaaactaatagtcggcaaccaagccgactttaagaaacatttcaacctcgaagacaaaacacccctccagttcgccaaagactcatacgatgaagatcttgaaaatctcctcggacaaatcggcgacgagttcgccgacctattctcagtagccaagaaactttacgactcagtgctgctgagcggcattttaaccgtcaccgacctatcaacgaaagcacccctgtcagcctccatgattcaacgatacgatgaacaccgggaagatctcaaacagctaaagcaattcgtaaaggccagtctacccgaaaagtaccaagaaatcttcacagacagcagcaaggacggatacgccggttacatcgaaggaaaaactaaccagggagccttctataaatacctatcgaaattactcacaaaacaggaagggtcagaatacttcctcgaaaagatcaaaaacgaagatttcctacgcaaacaacgcacattcgacaacggctccatcccccatcaagtccatctaaccgaactgaaggcaatcatccgacggcaatctgaatactacccattcttaaaagaaaacctggaccgaatcgagaaaatactcactttcaggatcccctactatgtcgggcccctcgctcgtgaaaaatcagactttgcatggatgacccgcaagacggacgatagcatcagaccctggaacttcgaagaactcgttgacaaagaagcctccgccgaagcgtttatccaccggatgaccaacaacgacctctacctgcccgaggagaaagtgctacccaaacactccctaatctacgagaaattcaccgtatacaacgaactcacgaaagttcgctacaaaaacgaacaaggagagacgtacttcttcgactcaaacattaaacaagagatcttcgatggcgtgttcaaagaacaccgcaaggtttccaaaaagaaactcctcgatttcctcgcaaaagagtacgaagagttccgaatcgtagacgtaatcgggctcgataaagaaaacaaagcctttaacgcctcactaggcacctaccacgatctgaaaaagatactagacaaagacttccttgacaaccctgacaacgaatccatactggaagatatcgtacagacgctgaccctattcgaagaccgcgaaatgatcaaaaagcgcctggagaactacaaagatctattcaccgagtcacaactcaaaaagctataccgccggcactacacgggatggggaaggttgtccgccaaattgatcaatggcattcgcgataaggaatcgcagaaaacaatacttgattacctaatcgacgacggaaaatccaaccgcaactttatgcaactcatccacgacgacggactcagtttcaaatccatcatcagcaaggcccaggccggcagccactctgacaatctaaaagaggtagtaggcgaactcgcagggtcccccgcgattaaaaagggcatactacaatcgctcaaaatagtcgacgaacttgtcaaagtcatgggatacgagccagagcaaatcgtcgtcgagatggctcgcgaaaaccaaacgacaaaccagggccgacggaactcgagacaacgctataagctgctcgacgacggcgtcaagaatctcgcctccgacctcaacggaaacatcctcaaagaataccctaccgacaaccaggccctacaaaacgagagattattcctatattatctccagaacgggcgagacatgtacacaggcaaggccctcgacatcgacaacctctcacaatacgacatagaccatatcattccgcaagcattcataaaggacgactccatagacaatcgagttctagtgtccagtgccaagaatcgaggaaagagcgacgacgtcccttccctagagatagtgaaggattgcaaggtattctggaagaaattgctggacgccaaactaatgagtcagcgcaaatacgacaaccttaccaaagccgaacgaggtggcctgacttctgacgacaaggcaaggttcatccaacgacagctcgtcgagacccgacagataacaaaacacgtggccaggatcctcgacgagcgattcaataacgaactggactcaaagggacgccgcattcgaaaggtaaaaatagtcacactcaaaagcaaccttgtctccaacttccgaaaagagttcggtttctacaagatacgcgaagtcaacaattaccaccatgcacacgacgcctacctcaatgcagtcgtcgccaaagctatcctgactaaatacccgcaactcgagccagagttcgtgtacggcgactatcctaaatacaactcctataaaacgcgtaaatccgcaaccgaaaaacttttcttctactccaacataatgaacttcttcaaaaccaaagtaaccctggctgacggaaccgtagtcgtaaaagacgacatagaggtcaacaacgacactggtgaaatcgtttgggacaaaaagaaacacttcgcaaccgtgcgcaaagtcctgagttacccacaagtgaacatcgtgaagaaaacagaaatacaaaccgggggattctccaaagaatctatcctagcccacggcaacagcgacaaattaataccccgcaaaaccaaagacatatatctcgatcccaagaaatatggcggatttgactccccaatcgtcgcctacagcgtcctcgtagtcgcggacataaagaaaggcaaagcacaaaaactcaaaacagtcaccgagctactaggaataaccataatggaacgatcccgcttcgagaaaaacccctctgccttcctcgaaagcaaagggtacctcaacatccgtgacgacaaactcatgatactgcccaagtacagcctctttgaactcgagaacggacgccgacgcctcctagcgtccgccggagagctccagaagggcaacgaactggcattgccaacccaatttatgaaattcctctatctcgcctctcgatacaacgaactcaagggcaaacccgaagagattgaacagaagcaggagttcgttgtccaacacgtatcatacttcgacgatatcctccagatcataaacgacttctcaaatcgtgtcatcctggcggacgccaacctcgagaaaataaacaaactctatcaagacaataaggaaaacatcagcgtagacgaactcgcaaacaacatcattaacctattcaccttcacgtcactcggagcccccgccgcattcaagttctttgataaaatcgtcgacaggaaacgatacacgtcaaccaaagaagttctcaacagcacactcatccaccagagcataacgggactatacgaaacgcgaatagacctaggcaaactcggggaagactga

SEQ ID NO: 6622 - RNA, 4113 nt, synthetic construct
  misc_feature 1..4113: note = Cas9 variant
  source 1..4113: mol_type = other RNA
atgaacaagccctactcaatcggcctagacatcggcaccaactcagtgggatggtctatcatcaccgacgattacaaagtgcccgccaagaaaatgagagtactcggcaacacagataaagaatacataaagaaaaaccttataggcgcactgctattcgacggaggcaacactgctgccgaccgacgcctgaaacgtaccgcacgaagacgctacacaagacggcgtaaccgcatcttatacctccaagaaatcttcgcagaggaaatgagcaaagtggacgacagctttttccacagactcgaagacagcttcctggtcgaagaggacaaacgaggttccaaatacccaatattcgcaactatgcaagaagaaaaatactaccacgaaaagttccccacgatatatcatctcagaaaggagctagcggacaaaaaggagaaggcagacctccgactcatctacctcgcattagcacatatcatcaagttccggggccacttcctcatcgaggatgaccgcttcgacgttcggaacaccgacatacaaaaacaataccaggcctttctggaaatattcgacacaaccttcgaaaacaacgacctcctttcccaaaacgtcgacgtcgaggccatcctcacggacaaaataagcaagtcggccaagaaagaccgcatcctagcccgatacccaaaccagaaaagcaccggcatattcgccgaatttcttaagctcatcgtcggcaaccaagcggacttcaaaaagcactttaacctcgaggataaaacacccctacaattcgcgaaggacagctacgacgaagacctagaaaacctcctggggcaaataggggatgagttcgcagacctgttctctgccgccaagaaactctacgactcagtactactctccggaatcttaaccgtaactgacctttcaacaaaagcacccctctcagcctccatgatccagcactacgacgagcatcgagaagacctcaaacaacttaaacagttcgtaaaagcctccctgcccgaaaaataccaagaaatattcgcagactcctctaaagatggctacgcaggatacatagagggtaaaacaaaccaagaagcattctacaaatacctctccaagctactcacaaagcaagaggggagcgagtacctacttgagaaaatcaaaaacgaagacttcctgcgaaagcaaaggacgttcgacaacggcagcatcccccaccaagtccaccttaccgaacttagagcaatcatccgacggcagagcgaatactacccattcctaaaagaaaacctcgaccggatagagaaaatcttaacattccgaataccctactacgtaggacccctagcccgggaaaaatcagactttgcctggatgacgcgcaaaacagacgactcaatccgcccgtggaacttcgaagacctagtagacaaggaaaaatcggcggaagcgttcatccatcggatgaccaacaacgacctatacctaccagaagaaaaagtcctaccgaagcacagccttatatacgaaaaattcaccgtatacaacgaactaaccaaagtacgtttcctcgctgagggattcaaagacttccagttcctcaatcgcaaacagaaggaaacgatcttcaactccctattcaaggaaaagaggaaggtcaccgaaaaagacatcatcagtttcttaaataaggttgacggctatgaaggcatagcaattaaaggcatcgagaagcagttcaatgcctccctatccacataccacgacctaaagaaaatactgggaaaagacttccttgacaacacggacaacgaactcatcctggaagacattgtgcaaacactaacactattcgaagaccgcgaaatgatccgcaaaaggcttgacatctacaaagacttcttcactgaatcccagctcaagaaactctaccgccgccattacacaggatggggccgactctcagcaaaactcatcaatgggattcgcaacaaagaaaaccagaaaacaatccttgactatcttatagacgacggatcagcgaaccgcaacttcatgcagttaatcaaagacgctggactgtccttcaagcccatcatcgataaggcccgaactggatcccatagcgataatctcaaggaggtcgtcggggaactcgccggcagcccagctataaagaagggcatcctacagagtctcaaaattgtcgacgagctagtaaaggtaatgggctatgaaccggaacaaatagtagtagaaatggcccgggagaaccaaaccactgcgaagggattatcccggtcccggcagcgcctaaccactttacgcgagtccctagccaacctcaagagcaacatactcgaagaaaagaagccaaaatatgtaaaagatcaggtcgaaaaccaccacctctccgatgatcggcttttcctctactacctccagaacggcaaagacatgtacaccgacgacgagctcgacatcgacaacctctcccaatatgacatcgaccacatcatcccccaggcgttcataaaagacgactcaatcgacaatagggtcctagtttccagcgcgaaaaaccgaggcaaatcagacgacgttccatcagtcgaaatagtcaaagactgcaaggtcttctggaagaaactactcgacgcaaaactgatgtcccaacgtaaatacgacaaccttacaaaagccgaacgcggtggacttacgagcgacgataaagcacgattcatccaacgccagctagtcgaaacgaggcaaatcacaaaacacgtagcgcggatcttagacgaaaggttcaataacgaattggacagcaagggccgcagaatacggaaggtgaagatcgtcaccctcaaatccaacctcgtctccaacttccggaaggagttcggtttctacaagatcagggaagtgaacaactaccatcacgcccacgacgcctacctcaacgctgtcgtcgccaaggcgatactaaccaaatacccccaactggagccagagttcgtgtacggcgactaccctaagtacaactcatacaagacacggaaatctgcaaccgaaaaactattcttctattcgaatatcatgaacttcttcaagactaaggtcaccctcgccgacggaactgtcgtagtcaaggacgacatcgaagtgaacaacgacaccggagaaatagtttgggacaagaagaaacatttcgcaaccgtccgcaaagtgctatcctaccctcaagtcaacatagtgaagaaaactgaaatccaaacaggtggcttctccaaagaatcaatcctcgcccacggcaactcggacaaactcatccctagaaaaaccaaagacatttatcttgaccctaagaaatacggaggattcgacagcccgattgtagcctactccgtcctcgtcgttgccgacatcaagaaaggcaaagcacaaaaactcaaaaccgtgacagaactcctcggcataaccataatggagcggtcacgcttcgagaaaaacccaagtgctttccttgaaagcaagggctacctgaatatccgcgacgacaagctcatgattctccccaaatactctcttttcgaactagaaaacggcagacgacggttattagcatctgccggcgaacttcaaaaaggaaacgaattagccctccctacacaatttatgaagtttctatacctagcgtctcgctacaacgagctcaaaggaaaacctgaagaaatagaacaaaagcaagagttcgtcgtacagcacgtctcttacttcgacgacatcctccaaatcataaacgatttttctaaccgtgtcatcctcgccgacgccaatttagagaaaattaataagctctaccaagacaacaaagaaaatatccctgtagacgagctagccaacaatataatcaacctgttcacattcactagcctcggcgcccctgcagcatttaagtttttcgacaagatcgtggaccggaaacgctatacatcaacaaaggaggtcttgaatagcacactcatacaccagtctatcacaggcctatacgagacccggatagatctcggcaaactgggcgaagactga

SEQ ID NO: 6623 - RNA, 4116 nt, synthetic construct
  misc_feature 1..4116: note = Cas9 variant
  source 1..4116: mol_type = other RNA
atgaaggtaaacaactaccacatcggccttgatataggaacctcatcgatcggctgggtagcaatcggcgaggacgggaaaccccttcgaataaagggcaaaactgccataggcgcgcgactattccaagaaggcaaccccgccgccgacaggcgcatgttccggacgacaaggcgccgcctaagccggcgtaaatggcgactaaagctgctcgaagaaatcttcgacccatacatcacccccgtggactctaccttcttcgccaggctcaaacagagcaatctgtcccctaaggatagcagaaaggagttcaaaggcagcatgctgttcccagacctcacagacatgcagtaccataaagactacccgacaatctaccatcttagacacgcgctcatgacgcaggacgaaaaattcgacatacgcatggtataccttgccattcaccacatagtcaaatacagagggaatttcttaaactccacaccagtcgacagcttcaaggcctctaaggtcaactttgtggaccaattcaaaaagctcaacgaactatacacggcaataaaccccgaggagagcttccagataaatctcgctaacagcgaagacatcggccaccaattcctcgatccctccatccgcaaatttgacaagaagaaacaaatacctaaaatcgtacccgtctctgtcgacgacaaagccacagacaaaataaacggaaaaattgcaagcgaaataatcaacgcaatcctgggatacaaaagcaaactcgacgtagtcgtccagtgcactcccgtagactccaaaagctgggcgctcaaattcgacgaagaagacatagatgcaaaactccagaaaatcctccccgaaatggacgagaaccaacaatccatcatcgctattctccaaaacctctattcccaagtgaccctcaatcaaattgtacccaacggcatgtcactgtccgagtccatgatcgaaaaatacaacgaccaccacgaccacctaaagctctacaagaaaataatagaccaactagccgacccgaaaaagaaagccgccctaaagaaagcctatagccaatacgtcggagatgacggaaaagtaatcgagcaagcagatttttggtccagcgtcaaaaagaatcttgacgacagcgacctctccaaacagatcatggacttaatcgacgccgagaaattcatgccaaagcagcgcaccagccaaaacggtgtgatcccacaccaactccaccaacgcgagctcgacgaaatcattgaacaccaaagcaaatactacccgtggctcgcggaaataaaccccaataagcacgacctgcatctcgccaagtataaaatagaggagctagttgctttccgcgtaccatactacgttggtcccatgatcacccccgacgaccaagccaaatccgcggaaacagttttcagttggatggaacgcaaaggtaaagaagccggccaaatcaccccgtggaactttgacgaaaaagtggatcgcaatgcgtcggccaaccgtttcataaaaagaatgaccaccaaagacacttacctaatcggggaggacgtactgcccgacgagtccctcctatacgaaaaattcaaagtactcaacgaactaaacatggtacgcgtaaacggcaaactccttaaagtcgccgacaaacaggccatatttcaagacctatttgaaaactacaaacacatcagtgtcaagaaactccaaaactacataaaaagcaaaacagggctaccgagcgacccggagatctcgggactaagcgatccagaatacttcaacaactcccttggcacgtacaatgacttcaagaaactcttcggtaacaaagtcgacgaacccgacctacaggatgatttcgagaaaatagttgaatggagcacagtgtttgaggacaaaaggatactccgcgagaaactaaacgaaatcacctggctctccgaccaacagaaagacgtcctcgagtccagccgttaccagggctggggccgcctctccaagaaactcctcaccggaatcgtaaacgaccagggagaacgcatcatagacgaactctggaatacaaacaaaaacttcatgcaaatccagtccgacaacgacttcgccaaacgtatacacgaagcaaacgccgaccaaatgaaagcagttgatgtagaagacgtcttggccgacgcatacacatcaccccaaaacaagaaagccatcagacaggtcgttaaagtcgtagacgacatccaaaaagccatgggaggcgtcgcaccaaaatacatctccatagagttcactcgctctgaagaccgcaatcctcgcaggaccatcagccgacagcgacaactagaaaacaccctcaaggatactgccaaatccctcgccaaaagcatcaaccccgaactactcagcgagctcgataacgccgccaaatcaaagaagggattaacggaccgactctacctctatttcacacagcttggaaaagatatctacactggcaagcctatcaacatagacgaaatcagcacatacgacatcgaccacatactaccacaagcgttcgtaaaggatgacagcctcaacaatcgcgtcctcgtcagcaaggccataaacaacggtaaaagcgataacgtccccgtccaactcttcggcgctaaaatgggacacttctggaaacagttggcggaagccggactgataagtaaacgcaaattgaaaaacttacagacggaccccgacaccatctccaaatacgcaatgcacggctttataaggaggcaactcgtagaaacgtcccaagtcataaaactggtcgccaacatactaggggacaaataccgaaacgacaacacgaagattatagaaataactgcacgaatgaatcaccagatgcgtgacgagttcggattcattaaaaacagggaaataaacgactaccaccacgcattcgacgcctacctaaccgcgttcctaggccgatacctataccacaggtatatcaaactacggccctacttcgtctacggcgacttcaaaaagttcaaggaagacaaagtgacgatgaggaacttcaatttcctacacgatcttaccgacgatacgcaagagaaaattgccgacgccgaaaccggtgaagtaatatgggaccgcgaaaacagcatacaacaactaaaggacgtataccactacaaattcatgctcatctcacacgaagtctacacgctaagaggcgccatgttcaaccaaactgtctacccagctagcgacgcgggcaaacgcaaactaattcccatcaaggcggaccgccccataaacgtctacggcggctactccggctctgcggacgcatacatggcaatcgttcgcatccacaacaagaaaggcgataaataccgggtagtcggcgtcccaatgcgggcccgagatcgtctagatgcggcaaagaaggtctcagacgcagactgcgaccgcgctctgaaggatgtcctaacaccgcagctcaccaagaccaagaagtcccgcaaaactggggaaattacccaagtggttgaagacttcgaaatcgtcctgggaaaagtcatgtaccggcaactcatgatcgacggtgacaaaaagttcatgctcgggtcgagcacctaccaatacaacgccaagcaactcgtcctcagtgatcaatcggtcaagaccctagcatcaaagggccgcctagacccactacaagaaagcatggactataacaatgtatacacagaaatcttagacaaggtcaaccaatacttcagcctatacgacatgaacaaatttagacataagttaaacctcggatttagcaagttcatctcttttcccaatcacaatgtcttcgacgggaacacaaaagcctcctccggaaaacgagagatcctcgaagaagtcctaaacggcctccacgctaaccccacctttggcaatctcaaagacataggcataacgaccccattcggacaactgcagcaacccaacggcatactcctcagtgatgaggccaaaatccgctaccagtctccaaccggtctcttcgaaagaaccgtcagcctcaaggacctgtga

SEQ ID NO: 6624 - RNA, 4116 nt, synthetic construct
  misc_feature 1..4116: note = Cas9 variant
  source 1..4116: mol_type = other RNA
atggacaagaaatactcaatcggtctcgacatcggcacaaatagcgtcggatgggccgtcatcaccgatgactacaaagttccaagcaagaaattcaaggtcctcggcaacaccgacaggcacagcataaagaaaaaccttattggggccttattgttcgactccggtgaaacagctgaggccacgcgccttaaacgcacagctcgcaggcggtacacgcgcaggaaaaaccgcatacgctacttacaggagattttcagctcggagatgagcaaagtagatgacagcttctttcacaggctcgaagaatccttcctcgtcgaagaggacaagaagcacgaacgacaccccatctttggaaacatagtcgacgaggtggcctatcacgaaaagtatcccacgatataccatctgcgaaagaagctagcggactcaacggacaaagcggacctacgtctaatctacctagccctggcccacatgataaagttccgcggacacttccttatagaaggcgaccttaatccggacaacagcgacatggacaagttattcattcagctggtccaaacgtacaaccaactcttcgaggaaaatccgataaacgccagccgcgtggacgccaaagccatactcagcgcccgcttaagcaaaagccggcgcctagaaaacctcatagcgcagctaccaggagaaaagagaaacggtctctttggcaacctcatcgcactgtcacttgggctaaccccgaacttcaagtccaacttcgacctagcagaagacgcgaaactacagctctctaaagatacttacgacgacgacctcgacaacctactagcccaaatcggtgaccaatacgccgacctcttcctcgctgcgaaaaacctaagcgacgcaatcctactcagtgacatactccgtgtcaactctgaaataacgaaagcacccctatccgcatcgatgataaagagatacgacgagcaccaccaggacctcacattgctcaaagcgctagtacgacaacaactgccggagaaatacaaggaaatattcttcgaccaatccaaaaatggatacgccggctacatcgacggaggggcgagccaagaagagttctacaagtttatcaaacctatcctagaaaagatggacgggacagaagagttgctcgccaaactgaaccgggaggacctactacgcaaacaacgcaccttcgataatggcagtataccacaccaaatacacctcggcgagctccacgcaatcctgcggcggcaagaggacttctaccccttcctgaaagacaatcgcgagaaaatcgaaaagatcctcacattccgcataccgtattatgttgggccgctcgcaagaggcaattcccgattcgcctggatgacacgaaagtcagaagaaaccatcactccgtggaattttgaggaggtcgtagacaaaggggcgtcagcacagagcttcatagaacgaatgaccaactttgacaaaaacctacccaacgaaaaagtcctgcccaagcacagtcttctgtacgaatacttcacggtatacaacgagctgacaaaagtaaagtacgtcaccgaaggcatgcgaaaacccgagttcctatcagggaagcagaaagaagcgattgtggacctcctgttcaagaccaaccggaaagtcaccgtgaaacagctaaaggaagactactttaagaagatagaatgcttcgattccgtagaaatctcaggcgtcgaagatcgtttcaatgcaagcctcggcacataccacgacctactaaaaatcatcaaggacaaggacttcctggataatgaagaaaacgaggacattctagaggacatagtcctaacactaacattattcgaagacaaagagatgatagaagaacgactgaagaaatacgccaacctgttcgacgacaaagtaatgaaacaacttaaaagacgccactacacaggttggggccgcctatcacgtaaactgatcaatggcatacgtgataaacagtcgggcaaaaccatactagacttcctgaaatcagacggtttcgcgaaccggaacttcatgcaactcataaacgacgacagcctgaccttcaaggaagccatacagaaagcacaagtcagcggacaagggcacagtctacacgagcaaattgccaacttggcgggatccccggcgatcaagaaagggatactccaatccgtaaaagttgtcgacgagctagtcaaagtcatgggccacaaaccagaaaacatcgtaatagaaatggcgcgggaaaaccaaacaacccaaaaaggccagaaaaactcccgtgaacggatgaaacgaatcgaagaagggatcaaagaactcggctcccaaatactaaaggaacacccggtcgaaaacacacaactccaaaacgaaaaactctacctctactacctccaaaacgggcgcgacatgtatgtcgaccaagagttggacataaaccgcctctcagactacgatgtcgaccacatcgttccccagtcgttcatcaaagacgacagcatagacaacaaggtactcaccagaagcgacaaaaatcgaggaaaatccgacaacgtcccatcggaagaggtagtgaagaaaatgaaaaactactggcgccagctcctaaacgcgaaattaatcacccagcggaaattcgacaacctgaccaaagccgaaagaggtggtctaagcgaactagacaaagccggcttcatcaaaagacagcttgtcgagacacgccaaatcacaaaacacgtcgcacaaatactagacagccgaatgaacaccaagtacgacgaaaacgacaaactcatccgcgaagtcaaagtcatcaccctcaaatcaaaacttgtaagcgatttcagaaaagactttcaattctataaggtcagggaaataaacaactatcaccacgcgcacgacgcatacctcaacgcagtggttggaacggcgcttattaagaaatacccaaaactggaaagcgagttcgtgtatggagactacaaggtttacgacgtaagaaagatgatcgccaaatcggaacaggaaataggcaaagccaccgccaaacgcttcttctacagcaacatcatgaacttcttcaagacggaaatcaccctcgcaaacggggaaatccgtaaacgccccctgatcgaaacgaacgaagaaaccggcgagatcgtatgggacaaaggccgggatttcgcaaccgtcagaaaagtcctatccatgcctcaagtgaacatagtcaagaaaacagaagttcagaccggcgccttaacaaacgaatcgatatatgcacgcggctcgttcgacaaactaatctcacgaaaacaccgattcgagtcctcaaagtacggaggattcgggtcccccacggtcacatacagcgtattagtagtggcaaaatctaaagtacaggacggaaaggtcaaaaagattaaaacaggaaaagaactcattgggatcacactcctcgacaaacttgtattcgaaaagaaccccctaaaattcatcgaagacaaaggctacggaaacgttcaaatcgacaaatgcatcaagctaccaaaatattctctcttcgagttcgaaaacggaactagacgaatgctcgcctccgtcatggccaacaacaactcccgcggcgacctccaaaaagccaacgaaatgttcctcccggccaaactcgtcaccctcttataccacgcccacaagatagaaagttccaaagaacttgaacatgaagcatacattttggaccactataacgatctctaccaactgctcagctacatagaaagattcgcaagcctctacgtcgatgtagagaaaaacatcagcaaagtcaaagagctctttagcaacattgaatcctactcaataagtgaaatctgcagctctgtaatcaacctgctcacactaaccgcttcgggcgcccccgccgacttcaagttcctcggaaccaccatacccagaaagagatacggcagcccccaatcaatcctaagctcaacgctcattcaccagtccatcacaggactctacgagacccgaatagacctgagccaactgggcggcgactga

SEQ ID NO: 6625 - RNA, 4116 nt, synthetic construct
  misc_feature 1..4116: note = Cas9 variant
  source 1..4116: mol_type = other RNA
atggacaaaaagtactccataggactagacataggcacaaactctgtaggatgggcggtaatcaccgacgattataaggtaccatccaagaagttcaaagtcctcggcaacacagaccgacactccataaagaaaaacctcataggcgcccttctgttcgactccggcgaaacagccgaagccacacgactaaaacgcacggctcgccgccgctacacccggcggaaaaatcgaatcaggtacctgcaggaaatattcagctccgaaatgagcaaagtggacgattcattcttccacagactcgaagaatccttccttgtcgaggaagacaagaaacacgagcggcaccccattttcggaaacatagtggatgaggtagcctaccacgagaaatacccaacgatatatcaccttcgaaagaaacttgcagactcaaccgacaaagctgacctgcgactaatctacctcgcccttgctcacatgatcaaattccgcggccacttcttgatcgaaggcgacctcaaccccgataactcagacatggacaaactattcatccagctagtacagacatacaaccaactcttcgaggaaaaccccattaatgcctcacgagtagacgccaaggcgatcctatcggcaaggctgtctaagagccgacgcctcgaaaatttaattgcccagcttccgggtgagaaaagaaacggactattcgggaacctaatagccctgtctctaggcctaacacccaacttcaagtcaaatttcgacctggccgaggacgcaaagctccaactgagcaaagacacatacgacgacgatctcgataacttgctcgcacaaatcggagaccaatatgcagacctctttcttgcagcaaagaacctatccgacgccatcctactgtcagacatcctgcgggtcaactccgaaattaccaaagcaccactgtccgcgtcaatgatcaagcgctacgacgagcaccaccaagacctcaccctcctcaaagcactcgtccgccaacaactgccagaaaaatacaaggaaatcttcttcgaccaatcgaaaaacggatacgctggctacatcgacggcggtgcctcgcaagaagaattttacaagttcataaaacccatcttagagaaaatggacggcacggaagagttactcgcaaagctcaaccgagaggacctcctccgcaagcaacggacctttgacaacggaagcatcccgcaccagatccacctaggcgaactacacgcaatactcagacgccaagaggacttttaccctttcctaaaggacaaccgcgaaaagatcgagaaaatactaacgttccgcattccctactacgtgggccccctagcgcgcggcaacagccggttcgcgtggatgacccgaaaatcggaagaaacaataaccccctggaactttgaagaagtggtagacaaaggcgccagcgcccagtcattcatcgaacgcatgaccaacttcgataaaaatctccccaacgagaaagtcctcccaaaacacagcctactctatgaatacttcaccgtctacaacgaactcacgaaggtcaaatacgtcaccgaaggcatgcgcaaaccggagttcctcagcgggaaacaaaaagaggccatcgtcgaccttctgtttaaaacaaaccgcaaggtaactgtcaaacaactaaaggaggactatttcaaaaagattgagtgcttcgacagcgtcgagatctcaggagtagaagatagatttaacgcctcactcgggacgtaccacgacctattaaaaatcataaaagacaaggacttcctcgacaacgaggagaacgaggacatactcgaggacatagttctcacactaacattatttgaggacaaggagatgattgaagagaggctcaagacgtacgcccacctcttcgacgataaagtcatgaagcagctgaaacgccgacactatacgggatgggggagattaagccgcaaacttataaacgggatcagagataagcagtccggcaagacgatcctcgacttcttaaaatccgatggcttcgcgaaccgcaacttcatacaactaatccacgatgacagtctcacattcaaggaggccatccagaaagctcaagtaagcggccaagggcactccctccacgagcagattgctaatctcgcaggcagcccggcaatcaagaaaggcatcctacagagcgtcaaggtggtcgacgaactggtgaaggtcatgggacacaaacctgaaaacatagtcattgaaatggcccgggaaaaccaaaccactcaaaaaggacagaagaatagccgcgaacgaatgaagagaatagaagaaggcatcaaggaactgggctcccaaatactcaaagagcaccccgtagaaaacacccaactacagaatgagaagctctacctctattatctacagaacggcagggacatgtacgtagaccaagaacttgacataaaccggctatcggactacgacgttgaccacatagttccgcaatcgttcataaaagacgacagcatcgataacaaagtcctcacaagatccgacaaaaacagaggaaaatccgatgatgtcccaagtgaagaagtcgtcaaaaagatgaaaaactattggcggcaactcctcaatgccaaactaatcacacagcgcaaattcgacaacttaaccaaagccgagcgcggcgggctgtcagaactagacaaggccgggttcatcaaaaggcaactcgtagaaacccgtcaaataaccaagcacgtagcacaaatcctcgactcacggatgaacacgaaatacgacgaaaacgacaaacttatccgagaagtcaaagtaatcacactcaaatcaaaactcgtctcggacttcaggaaggatttccagttctacaaggtccgagagatcaacaactaccaccacgcccacgatgcctacctaaacgcagtagtaggcaccgcgctaatcaaaaagtacccaaaactcgagagcgagttcgtttacggcgactacaaggtctacgacgtcagaaaaatgatagcgaagtcggaacaagaaatcgggaaggcaacagccaaacgtttcttctattcaaacataatgaacttcttcaagacggaaataaccctcgcaaacggcgaaatacgcaaacgaccattgatcgaaaccaacgaggaaaccggtgaaatagtctggaacaaagggagagacttcgccaccgtcagaaaagttttatccatgccccaggtaaacatcgtcaagaaaaccgaggtccaaacgggcgccctcaccaacgaatcaatatatgctaggggctcattcgacaaactcataagcagaaaacaccgattcgaatccagcaaatacggaggcttcggatcaccaaccgtcacatactcagtcctagtggttgccaagtcaaaagtccaggacggcaaagttaagaagataaaaactggaaaagaacttatcggcatcactctcctcgacaagctagtctttgagaaaaaccccctcaaatttatcgaagacaaaggatacggcaacgtccaaatagacaaatgcatcaaactgcctaaatactcgttgttcgaatttgaaaacggaacacgacgtatgctggcgtccgtaatggccaacaacaacagccgaggcgacctacaaaaagcaaatgaaatgttccttccagcaaaactcgtgacactcctttaccacgcccacaaaatagaatcatcgaaagaattagagcacgaagcgtacatcctcgaccactacaatgacctctaccaactgctatcgtacatcgaacgcttcgcaagcctctacgtagatgttgagaaaaacatctcaaaagtcaaagaactattctcgaacatcgaaagctacagcatctccgaaatatgctcaagcgtcataaatcttcttaccttaacggccagtggcgctcctgcggacttcaagttcctcggaaccacaataccgagaaaacgatacgggagtccccaaagtatcctgtcctcaacactaatccaccaatccataacgggcctctacgaaacacgtatcgacctcagccaactgggaggcgactga

SEQ ID NO: 6626 - RNA, 4116 nt, synthetic construct
  misc_feature 1..4116: note = Cas9 variant
  source 1..4116: mol_type = other RNA
atgaacaacaacaactattcaatcggcctagacattggaactaacagcgttggatgggccgttatcacagacgactacaaggtaccatctaagaaaatgagagtcctcggcaacacagataagaggttcatcaagaaaaacctgatcggcgcattactatttgacgaaggcacgaccgccgaggaccgacgccttaaacggacggcacggcgccgctacacgcggagaaagaaccgactacgctacctccaagagatatttgcagaggagatgtccaaagtagactcctcgttctttcaccgactagacgactccttcctcgtacccgaagacaaaagcggatcgaaatacccaatatttgccaccctcgctgaagagaaagagtaccacaagaaattcccgacaatctaccatctccgcaaacacctggccgactcaaaagagaaagcagacctaaggctcatctatctcgcactagcgcacataacaaaataccgcggtcactttctatacgaagaggccttcgacatcaaaaataatgacatacagaaaatatttaacgagttcataaacatttacgataacaccttcgagggcagctcgctgtctggacaaaacgcccaagtcgaggcaatcttcacagggaaaatatcaaagtccgtgaaacgtgagcacgtcttaaaactattccccgatgaaaagagcacaggactattttccgagttcctcaaactgattgttggcaatcaagccgacttcaaaaagcacttcgacctcgaagaaaaggcttccttacaattctcgaaagacacgtacgacgaggacctggaaaacctcctcggacaaatcggagatgacttcgccgatctcttcctcgtagccaagaagctctacgacgcgatcctacttagcggaatcctaaccgtaaccgaccccagtacaaaagcacccctcagtgcgagcatgatagaacgctatgagaaccatcaagaggacctggcagccctcaaacaattcatcaaaaacaacctacccgaaaagtacgcggaagttttcagtgaccagtccaaagacggatatgctggctacatagatggtaaaaccacccaggaagccttctacaagtacatcaagaacctcctctcaaaattcgaaggcgcagactacttcctcgataaaatagaaagggaggatttcctcagaaagcagagaaccttcgacaacggttccattccgcaccagatccacctccaagaaatgaacgcaatactgcgacgccaaggcgagcactaccccctcctaaaggaaaacaaagaaaagatagagaaaattctaacattccgaataccatactatgtgggccccctagcccgtggtaaccgagacttcgcatggttgacgcgcaactcggaccaagcgatccgaccctggaatttcgaagaaatagtagacaaagcgagttctgcggaatccttcataaacaaaatgaccaactacgacctgtatctccctgaggaaaaagtcctaccaaaacactctctactttacgaaacgtttgcagtgtacaacgaactgacgaaagtgaaattcattgccgagggactgcgcgactaccaattctttgactctggtcagaaaaagcaaatcgtcaatcaactattcaaagaaaaacgtaaagtcacggagaaagacattatacactacctccacaacgtcgacggttacgacggcatagaactaaagggcatcgagaaacagttcaatgcaagcctcagtacataccacgacctactgaaaatcatcaaggacaaggagttcatggataaccacaaaaaccaagaaatcctggagaacatagtccacaccctaacgatctttgaagaccgggagatgatcaagcaacggctagcacaatacgactcaatcttcgacgaaaaagtaatcaaagccttaacccgacggcactacaccggctggggcaaactatccgccaaactcatcaacggcatctgcgacaagaaaaccggcaaaactatactcgactatctaatagatgatgggtacaacaacagaaatttcatgcagttgataaacgacgacggactctcgttcaaagaaatcatccagaaagcacaagtagtcggcaagaccgacgacctgacacaggtggtacgggagctgtccggaagtcccgcaatcaaaaagggcatcctccagtccatcaaaatagtagacgagctagtaaagatcatgggctacgctccagagtccattgtcatcgaaatggcccgggaaaaccaaaccaccgcaaaaggtaagaaaaactcacagcagcgttacaagcgcatcgaggacgccctcaagaacctagccccgggactagactccaccatctccaaagagaatcccaccgacaacatacagctccaaaacgacagacttttcctctactatctgcaaaacggcaaagatatgtacaccggcgaggcgctcgacataaaccaactttcaagctacgatatcgaccacataataccacaagccttcataaaggacgatagcctcgataatcgagtccttaccagtagcaaagacaaccgcggaaaatccgacaacgtgccaagtctcgaagtagtcaagaagcgtaaagccttctggcaacaactcctcgacagcaagctcatcagcgagaggaagttcaacaacctaaccaaagcggagcgcggcggcctcgacgaacgagacaaggtcgggttcatcaagagacaactcgtagaaacccgacaaatcaccaagcatgtagcacgcatactcgacgcacgattcaatacggaagtcagcgagaaaaaccaaaagattcgtagcgtcaaaatcattaccctcaagagtaacttagtgtccaatttccgaaaggagttcaaactgtacaaggtccgagaaattaacgactaccaccacgcccatgatgcgtacctcaatgcagtagtcgcaaaagccatcctcaagaaataccctaaactagaacccgagttcgtatacggggactaccagaaatacgacctcaaacgatacatatcaaaatcaaaagacccaaaagaagttgaaaaagccaccgaaaaatatttcttctacagcaacctactcaactttttcaaagaagaagtccactacgcagacggtacaatcgtaaaacgggaaaatatcgaatactcaaaagacaccggcgaaatcgcctggaacaaagaaaaggacttcgtgacaataaagaaagttctgtcgtacccacaagtcaacatcgtcaagaaaagagaagtccaaaccggaggattcagcaaagagtcgatcctgcccaaaggcaacagcgataaactcatcccccgcaagaccaaagacatactctgggatacgaccaagtatggagggttcgactccccagtaatagcatactccatcctgctcatagccgacatcgagaaaggaaaagcaaagaaactcaagactgtcaaaacccttgttggaataaccataatggaaaaagcagcattcgagaaaaacccaataacattcctggaaaacaaggggtaccataacgtcagaaaagaaaacattttatgcctcccaaaatattcactattcgagctagaaaacggcagacgtcgccttctggcatcggccaaagaactacagaaagggaatgaaatcgtcctccccgtctacctgaccactctattgtaccacagcaaaaacgtccataaattagatgaaccagaacaccttgaatacatccaaaagcacagatacgaatttaaggacttgctcaacctggtatccgagttctcgcaaaaatatgtactagctgaagccaacctcgagaaaataaagagcctttatgtcgacaacgaacaggcagacatcgaaatcctcgcaaactccttcataaacctactcacctttaccgcattaggagcacccgcggcctttaaattcttcggcaaggacgtcgaccgcaaacgttacaccaccgtttccgaaatcctcaacgccacactaatccaccagagcataacaggtctctacgaaacccgcatcgacctaagcaagctaggcgaggactga

SEQ ID NO: 6627 - RNA, 4116 nt, synthetic construct
  misc_feature 1..4116: note = Cas9 variant
  source 1..4116: mol_type = other RNA
atgacggagaaaaactacagcataggactcgacatcggaaccaatagcgtaggatgggctgtcataaccgacgactacaaagtccccgccaagaaaatgaaagtgctagggaacacagacaaaaagtacatcaaaaagaacctattaggcgccctcctattcgataatggcgaaaccgccgaagccacgcgcctaaaacggacggcccgccgacgttatacaagacgcaaaaaccgactgcgttacctccaagaaatattcgcagaggaaatggccaaggtcgacgaatcattcttctaccgcctggacgagtccttcctcacaaccgacgacaaggatttcgagagacaccccattttcggaaacaaggccgacgaaatcaaataccaccaagagttccccacgatctatcatttacgcaaacacctcgcagacagccacgaaaaagcagacctccgcctcatctacctagctctcgcacacatgataaagttccggggccacttcttaatcgagggagagctgaacgccgaaaatacggacgtccaaaaactcttcgaagcctttgtcgaggtatacgatcgcacgtttgacgacagtaacctaagtgagatcacggtcgacgccagctcaatactgacagaaaagttctccaaatcacgccgccttgagaacctgataaagcactaccctacagagaaaaagaacaccttgttcggaaacctagtagcactcgcactgggcctccaacccaacttcaaaacgagctttaaacttagcgaagatgctaaactccaattctccaaagacacatacgaagaggacctggaggaactcatcggcaaaatcggcgacgaatacgccgacctattcaccagcgcgaaaaatctatatgacgccatcttactttccggaatcttaaccgtggccgacaacaccacaaaagcacctctatccgccagcatgatcaagaggtacaacgaacatcaggtcgacttgaaaaagttaaaagagttcatcaaaaacaacgctagcgacaaatacgatgaaatatttaacgacaaagacaaaaacggttacgcaggctacatagaaaacggcgtcaagcaagatgagttctacaaatatctgaagacgaccttatccaaaatcgacggttccgactacttcctcgataaaatagaacgagaagacttcctccgcaagcagcgcacattcgacaacggttccatcccccaccagattcacctccaggaaatgcacgcaatcttgcgcaggcaaggcgaacactacgccttcctcaaggaaaaccaagcgaagatagagaaaatcctaacattcagaatcccgtactacgtcggcccactcgccaggaaaaacagccgcttcgcatgggcggaataccacagcgacgagaaaatcaccccatggaatttcgacgaaatcattgacaaagagaaaagcgccgaaaaattcataacccggatgaccctaaatgacctatacctgcccgaagaaaaggtcctcccaaagcatagcctagtgtacgaaacctacacggtctacaacgagctaaccaaggtaaaatacgtaaatgaacagggaaaatcaaacttctttgatgccaacatgaaacaagagatctttgagcacgtctttaaggaaaaccgaaaggtgaccaaggacaagttcctcaactacctgaacaaggagttccccgaataccggatacaggatctcatcggcctggacaaggaaaacaaatcatttaacgccagccttggcacataccacgacctcaagaaaatcctcgacaagagctttctcgacgacaaaaccaacgaaaccataattgaggacatcatccaaaccctcaccctcttcgaggaccgcgatatgattcgccaacgcctacaaaaatactccgacatcttcacgccacagcaactcaagaaactagaacgacgacactacaccgggtggggccggctgtcgtataaactaatcaacggaatacggaacaaagaaaacggaaaaagcatcctggactatctcatcgacgacggctacgcaaaccgcaactttatgcaactgatcagcgacgacaccctaccttttaaacaaatcataaaagatgcgcaaataataggcgacatcgacgacgtgacctcggtcgtacgtgaactaccaggaagcccagccatcaagaaaggcatacttcaaagtgtaaaaatcgtcgatgagctcgtcaaagttatgggccataaccccgacaacatcgttatcgagatggcgcgagaaaatcaaaccacaaaccgaggacgcaaccaaagccagcaaaggctcaaaaagctacaagacagtctcaaggaactgggcagcaacatcctgaacgaagagaagccaagctacatagagggaaaagtggagaacaaccacctacaagacgaccggcttttcctatactacatccaaaacggcaaagacatgtatacaggcgacgaactcgacatagaccacctgtccgactacgatatcgaccacatcataccgcaggcattcataaaagacgactctatcgacaaccgggtgctaacgtcctcagccaaaaaccgcggaaaatcagacgatgtgcccagtctagacatagtccatgaccgaaaagcagattggatacgactgtacaagtcggggctgataagcaaacgaaaattcgacaacctaacaaaagcagaaagaggaggcctgaccgaaaacgacaaggccggatttatcaaacgacaactcgtagagactcgacagatcaccaagcacgtagcccaaatactagacagcagattcaacaccgagcgcgacgaaaacgacaaagtaatacgcaacgtgaaagtcataacgctaaagagcaacctcgtgtcccaatttcgcaaagacttcaaattctacaaagtcagagagataaatgactaccatcacgcgcacgacgcctacctaaacgccgtagtcggtacggccctgcttaagaagtaccccaaactagccccagagttcgtctacggagaatacaaaaagtacgacatacgcaaattcatcacgagctccggcgataaagcaaccgccaagtacttcttctactccaatctcatgaatttcttcaaacgcgtgataagatacagcaacggcaaggtcgtcgtaagacctgtcatcgagtgctctaaagacactggcgaaatcgcctggaacaagcagaccgacttcgaaaaggtacgtagagtactcagctatccccaggtcaacatagtgaagaaagtagagacccagaccggaggattttcgaaagagagcatcctacccaaaggcaacagcgacaaactaataccccgaaaaacaaagaaattccgatgggacacaccaaaatacgggggattcgattctccgaatatagcatactcagtattcgtaatcgccgacgtggaaaaagggaaagcgaaaaagctgaagacagtaaaggagctagtaggcatatcgatcatggaacgtagctcctttgaagaaaacccggtggtattcctcgaaaagaaaggatatcagaacgtccaagaagataaccttataaaactccccaagtacagcctatttgagttcgaaggtgggcgacgccgattactagcctctgcaagcgaactacaaaaaggaaacgaagtggtcctctcccggcatctcgtcgagcttctataccatgcccaccgcgtaaactcatttaacaactcagaacatctcaagtacgtttcagaacacaagaaagagttcggagaagtcctatcctgcgtggaaaacttcgccaaatcatacgtcgacgtagagaaaaacctcggcaaaatacgcgccgtcgcagacaaaattgacaccttcagcatcgaagacatttcgatatcgttcgtcaacctcctaacactaaccgcactcggagcccccgccgacttcaactttctaggcgagaaaataccgcgcaaaagatacacgagcacaaaagaatgccttaatgccaccctcattcaccagtccatcaccggactatacgaaacgcggatagacctatcaaagctaggcgaagaatga

SEQ ID NO: 6628 - RNA, 4116 nt, synthetic construct
  misc_feature 1..4116: note = Cas9 variant
  source 1..4116: mol_type = other RNA
atgaacttacgcaacgtagaatcctaccaagtaggactggacatagggacaggcagtgtaggctgggcggtgctagacgacaacggggacctctgcaggttcaaaggcaagcctacatggggaagccgtgtgttccctacagccgagacggcagcggaagcaagagtgcacaggggacaacgacgacgctacgaccgacgcagacagagaatcgatctgctccagcggttcttcgcggatgaagtggccaaagtggacccagagttcttcatacggctcaatcaagccagactgcaccccgaaaaccgggacccagcccacgccgattaccgctggccgctattcaacgggagcaacttcaccgaaaaagactactaccgccaattcccaacaatctaccacctccgagcacacctactcaagagcgacgaaccggccgacataaggctagtctacctggcgttgcacaacatagtcaagcaccgagggaacttcctgcaccaagacaacccatccttaagcgcaaggaatgctaacgtaggcgacgccgtagaagcactctgtcttgcactggacgaatggtgcggcgcgcacgacgtagaatgcgcctgcgacgaagcagctctcgcagaagcactcggtgacgccagcctccgaccaggtgagaaaagggagcgggcggaagcagcactcggagtcgaaaaagcccacaagaaactcgccaaagccgtatcatcagcagttgtaggatacgcagcagagtttggacacgtgttcttcgcagagagcgaaggaagcaaattcgcactaagcaacgacgagaaagtagaagcctacgtctgtccagacgaaggaagagacctctttgacgcaatgagagcagtacattccagttacgtgctgatgggtatattaagcgaagcacaaggcgaactcctctcagtatgcaaagtcggcgaatacgaaagatataaaagagatctggagacgctcaaaagcctcgtccgcgcgtatgggccagaaagatacgacgagttcttctgcggccccttctacgaaggtaccagagactacgaccctgggaaagcccaggggtatacaaaatacaatctaggggccagcaaactcagccacgaagacttcctcaaagaagtacagaaactcctaaaagacataggcgcccaggcagacgaacgatacgcggacatcgaacgagccatagaagcaggagcgttcctaagaaggctcaaaaccagcgataacgggaccataccgtaccaactacacttggaggaaatggacgccattatagagcggcaagcagccttctaccccttcctagcccaagaaaaagataaactgaaaagcctagtgagctttcgcataccctactacgtagggccactaacacagaaaaacgcagcacgagacggaaaaggcgaagcgcgcttcgcgtggtcatcgagaaaacccggcatggaagacgcaagggtatacccatggaattgggaagacgtcatagacaaagaccaatccgccgaggacttcatacgacggatgaccggtacgtgcacatacctaaaaggcgagcccgtcctcgctagatgcagcctcgactacgaactattctgcgtgctgaacgaactagcaggagcaaggtggacacaagacggggacaagagctatcgattcgacgcagcagacagactaggtattgtagaagacctcttcaaaaagcggaagcgggtaacgtacgaggcagcagaaaagtggctggcacgaacacatggcccagaatccggaaaatcagccggaggggcctaccatgtaagcggcggccaaggagaagatgcattcgaaagtcaactctcgagccactacgacttttgcaaaattctgggggtcgacgaactctctgacgcggacgaagcaatggccgaagatatcatactatggaacacagtatttgaggaccgatccatcctgaagcgaaagatcaagctggcctacggcgacagacttggagacgctcaagtacgaaaactatgccaaaagaggtacaccgggtggggacgcctaagcggagaactcttacgcggcctacgatccgcaacggacaatggaccaaaaacgatcatggacatactactggaaggggacccgaatcacgcaaggaggatgggagcagccatgaaccttatggagatacttcacgacgacctcttagagttccaagcaaaaatcgacgaacacaatagagaacgagcactggccgtgggcggaatgagcgtcgacgaggtaaccggctccccggcgctcagacgaggcatcaatcaagcactgagagtggtagacgagatagcagggatagcaggaaaaccgccagcccacatatacgtcgaggtaacaagagatgagggcgcccggaacaaagggagaaggacaacctcaagataccgtgccctcgaggcagctcttagctccatcaaagcacaatgtgcggatgtctacgcggagctaaaagaacgggatcccagagccctagacgacgagagactaacactctacttcatgcaatgcggaaaatgcatgtactcaggcgatgccctcgacataaacaagctccaaacctatcaagttgaccatatcctaccccaatcatacgtcaaggacgacagtttcgaaaacaaagttttagtgagaccagacacaaaccaaagaaagggtgacacactcctactagacgaaagactaatagcacgaatgcgaggattctggcgaacactaagggacgcggaactaataggggagaaaaagttcaacaacctaacgcgaaccagcgtatcggacgaacaaatgaagaagttcgtaagtcgacaacttgtagaaacaggacaaatggtaaaacaagtccagcaactactccaagcccgataccccgaatcagaagtacagccggttaaagctggggtatcacaccaactcagggtagggtgcgcgctagcgaaaagcagggaaattaacgacttccaccacgcccatgacgcgtacctagcctgccaggtaggtaggttcgtacaataccgccactcagccgtgtatagcgagcccgtcaaaatggccgccgtcgtaaaacaattcataaagaaacaagcagaagattaccgaagaacaagggagttacctggatcagacggttttatcgtatcctcattcatgacgccaggattcgatgtgaagacaggcgaggtcttccgcgacgcatgggatgccggagcagaaattgacagaatacggcgctgcttcgactacaaagactgcttcatatcacgcatgccagaggagacccacggggcattctgggacgcgacgatatactcacctcgagccgcaggtaagacactatccctcccactgaaaaggggactggacccaagaaagtacggtagctacagcagagaacagttcgcgtatttcttcgtgtatgaagcagtgaaaccaaagaagaaacagcgggtactagagtttgccccggtaccggtgcgggttgcttcagccttagccaacgaccccgatgcccttgaggactacgcgcgcgaattagcagaagcagaagggctagtattcgagcgcataagaaggcgaaaagtatacaaataccaacaaatcatcgtcggagatagccgactgtacgtcacaggaagagaggaggtccgcaacgcccggcaattagcctttagccaggacgaaacaaaactgatatgccggatcgaacaaggagaagaatgtgaagaaggggaattgctggacctcttccgctcgatgcagcgcaaatacctagcgtgcgcgccgcggttagcgcggctcatgaaagtagcagaaatggaggaaggcttcatagcagcaaccgccagcggcaagagagaagtactgctgtcactcacctccatcgctgcagcacaccgaaacagcattgacctcaagccgataggacgcaaagggtcgagcggacaaatgaaaataacgttcagcaaagagctaagcacgaacgggatactcttcgtagacagttccgtaaccggaatgttcgaacggcgctgccgactaggcctctga

SEQ ID NO: 6629 - RNA, 4116 nt, synthetic construct
  misc_feature 1..4116: note = Cas9 variant
  source 1..4116: mol_type = other RNA
atggaaaacaagaactatagtataggcctcgatataggcacaaacagcgtggggtggagcgtaatcacagacgattataaggtccccagcaagaaaatgaaagtcctgggtaacacagacaaacgttttatcaagaaaaacttgatcggagctctcttattcgacgaaggcaccacggccgaagccagacgcctaaaacgcactgcccggaggagatatacgcggcggaaaaaccgcttaagatacctacaagaaatcttcgcagaagagatgagcaaggtcgacagctcattcttccatcgactcgatgatagcttcttaattccagaagacaaacggggctcaaaataccccatcttcgccaccctcgcagaggaaaaggagtaccacaagcaattcccgaccatataccacctccgcaagcaactagcagattcgaaggagaaaaccgacctccgcttaatatacctcgcactagcacacatgataaagtaccgaggtcacttcctatacgaagacaccttcgatatcaagaataatgacatccagaaaattttcagcgagttcatcagcatatacgacaacacctttgaagggtcaagcctatccggacaaaacgcgcaagtcgaggccatcttcaccgacaaaatatccaagtccgcaaaacgcgaacgagttcttaaactcttccccgacgaaaagagtaccggattattttccgagttcttaaaactaatagtcggcaaccaggccgacttcaaaaagcacttcgacctgggggaaaaagcgcccctacagttctcgaaggacacctatgacgaagatcttgaaaacctcctcggccagataggcgatgacttcgccgacctcttcctagtcgccaagaaactctacgacgcaatcttactgagtgggatcctcaccgtaacggacccctccacgaaagcgccactctccgcctccatgatagagcgatacgaaaaccaccaaaaagaccttgcagtgctcaaacagtttataaagaacaaccttccagaaaaatatgacgaagtcttctccgaccagtccaaagacggatacgcgggatacatagacggtaagaccacacaagaggccttctacaagtacattaaaaacctcctaagtaaattcgagggcacagactatttcctagaaaagatcgaacgagaagacttcctccgaaaacaacgaacgttcgataacggatctatcccgcaccagatccacctacaagagatgaacgccatcctacgcagacagggagagcactaccccttcctgaaggacaacaaggagaaaatagagaaaatactcacgttccgaataccctactatgtaggacccctcgcccgcggcaaccgcgacttcgcctggctgaccagaaacagcgacgaagccatacgcccatggaacttcgaagaaatcgttgacaaagcatcgagcgccgaagacttcatcaacaagatgacgaactacgatctatacctcccagaagaaaaagtgctcccaaaacactccctactttacgaaacattcgccgtctacaacgaactcaccaaggtcaagttcatcgccgaaggactgcgcgattaccaattccttgactccggccaaaagaaacaaatagtcacgcaactattcaaagaaaagcgcaaagtgaccgaaaaggacataatccaattcctccacaatgtagacggttacgacggaatagagctgaaaggcatagagaaacaattcaacgcctccctatcaacgtaccacgacttgctcaagatcattaaggataaggagttcatggatgactccaagaacgaggaaatcctcgaaaatatagtccacaccctgaccatcttcgaggatcgcgaaatgataaagcagaggctagcgcagtatgactcgctctttgacgaaaaagtcattaaagctctcatccgccgccactacaccggatggggtaaacttagcgcaaaactaatagacggcatttgcgacaagcaaacgggcaacaccatcctagattatctgattgacgacggcaaaaacaatcggaacttcatgcaactaatcaacgatgacggactttccttcaaagaaataacccagaaagcccaggtcgtcgggaaaaccgacgacgtcaaacaagtcgtccaagaactgcccggctcccccgccatcaagaaaggcatactgcagtccatcaaaattgtcgacgagctagtaaaagtgatgggccacacacccgaatccatagtaatcgagatggcacgggaaaaccaaaccacggcgcggggcaagaaaaactctcaacagcgttacaaacgcatcgaggacgctctcaaaaacctcgcctctgggctcgacagcaacatactcaaagaacaccccacgaacaacatccagctgcaaaacgaccgtctcttcctttactacctacagaacggcagggacatgtacaccggcaaaccgctggacatcaaccaactgagcagctacgacatagaccacattgtgccgcaggcattcataaaagatgattcattagataaccgtgtcctcacatcactcaaagacaaccgcggtaaaagcgacaatgtaccttccatagaggtggtacaaaaacgcaaggctttctggcaacagctcctcgactcaaaactaataagtgaacgtaaattcaacaatctcaccaaagcagaacgtggtggacttgacgaacgagacaaagtaggttttatcaagcgccagctagtcgaaacccggcaaatcacgaaacacgtcgcccaaatattagacgcgcgcttcaacaaagaagttaacgagaaagacaagaaaaatcgcaccgttaaaatcattaccctaaaaagcaacctagtcagtaacttccgcaaagagttccgtctctataaggtgcgagaaataaacgactatcaccacgcccacgacgcatacctcaacgcagtcgtcgcgaaagccatcctgaagaaatacccaaagctggaacccgagttcgtctacggagattatcaaaaatacgatctcaaacgatacatatcccgaagccgcaaccctaaggaagttgaaaaagccaccgaaaaatacttcttttacagcaacctcttgaacttcttcaaggaggaggtacactacgccgacgggacaatcgtaaaacgcgagaatatcgaatactccaaagacaccggagagatagcgtggaacaaggaaaaagatttcgcgacgatcaagaaggttctatcatacccccaagtcaacatcgtcaagaagcgcgaggtacagacaggcggattctccaaagaatcgatactgcccaaagggaacagcgataaactaataccgagaaaaaccaaagacatcctgtgggaaaccactaagtacggaggcttcgacagccccgtgatagcatacagtatactcttaattgccgacatcgaaaagggcaaggccaagaaactcaaaaccgttaagaccctggtcggcatcacgattatggaaaaggccgcattcgaagaaaatccaatcactttcctagaaaataaaggttaccataacgttcgcaaggagaacatactttgcctgccaaaatactccctcttcgaacttgaaaatgggcggaggcgactcctagccagcgcgaaagaactccaaaagggaaacgagattgtccttccagtatacctaaccacactgctctaccacagcaaaaacgttcacaaactagacgaaccggaacacctagaatacatccaaaagcaccgcaacgagtttaaggacctcctcaacctcgtatccgagttcagccagaagtacgtcctcgccgacgccaacctcgagaaaatacaaaacctctacgccgacaacgaacaagctgatattgaaatactcgccaactccttcataaacctactaacattcacagctttaggcgcccccgcagcttttaagttctttggaaaagacatcgaccgaaaaagatacaccaccgtctcagaaatcttaaatgcaacccttatccaccaatcgataacgggactatacgaaactcggatcgacctaagcaaactaggcgaagactga

SEQ ID NO: 6630 - RNA, 4116 nt, synthetic construct
  misc_feature 1..4116: note = Cas9 variant
  source 1..4116: mol_type = other RNA
atggacaagaagtacagcataggcctggacataggaaccaactcggtcgggtgggccgtcataacggatgactacaaagtcccgagcaagaaattcaaagtactgggaaacaccgaccggcacagcatcaaaaagaacctaataggcgccttactattcgactccggagaaaccgctgaggcgacacgccttaaacgcacggcccgacgacggtacaccaggcgcaagaaccgaatacggtacctacaagagatattctcctcagaaatgtccaaagtagacgactctttcttccatcgcctagaggagagcttcctcgtcgaagaggacaagaaacatgaaaggcaccccatcttcggtaacatcgtagacgaagtggcctaccacgaaaaataccccacaatctaccatctgcggaagaaactagccgattccaccgacaaagcagacctccggctaatatacctagccctggcgcacatgataaaattccgggggcacttcctaattgagggagacctcaacccagataacagcgacatggacaaactcttcatccaacttgtacaaacatacaaccaactgttcgaagaaaaccctatcaacgccagccgcgtggacgccaaagcaatactctcggcacgcctatccaaatcccgccgactcgagaacctcatagcccaactcccaggcgaaaaacgcaacggattgttcggaaacctaattgcgctatccctaggccttacccccaacttcaaatcaaacttcgacctagccgaggacgcaaaactacagctatccaaggacacctacgatgacgaccttgacaacctactcgcgcagatcggcgaccagtacgcagacctgttcctagccgccaagaacctctccgacgccatcctcctcagcgacatccttcgtgtaaattcagaaataaccaaagcccctctctctgcatccatgataaaacggtacgacgaacaccaccaagacctaaccctcctaaaggcactggtacgtcaacaactcccggaaaaatacaaagaaattttcttcgaccagagcaaaaacggatacgcaggatacattgacggaggagccagtcaagaagagttctacaagtttatcaaacccatcttggagaaaatggacgggacagaggaactactagccaaacttaaccgcgaagacctcttaagaaagcaacgaacatttgacaacggcagtataccccaccaaattcatttaggagaactccacgccatactacgccgccaggaggacttctacccattcctcaaagacaaccgggagaagatagagaaaatacttacattccgcattccctactacgtaggtccactcgccagaggtaactccagattcgcctggatgacccgaaagtccgaggaaacaataaccccctggaatttcgaagaagtcgtggacaaaggcgcgagcgcacagtcgttcatcgagagaatgaccaacttcgataagaacctaccaaacgagaaagtcctcccaaagcactcacttctttacgaatacttcacagtctacaacgaactcaccaaagtgaaatacgtaacagagggaatgcgaaaacccgagttcctatccggcaaacaaaaggaggccatagtcgacctcctattcaaaaccaaccggaaagtgaccgtcaaacaacttaaagaagactactttaagaaaattgaatgctttgacagcgtcgaaataagcggagtcgaagaccgcttcaacgccagcctgggaacctaccacgacctactaaaaatcatcaaagataaagacttcctagacaatgaagagaatgaagacatccttgaggacatcgtccttaccttaacattattcgaagacaaagagatgatcgaggaacggctcaagaaatatgcaaacctcttcgatgacaaagttatgaaacaactcaaacggcgccactacacgggctgggggaggcttagtcgaaaactaatcaatggtatccgagacaagcaaagcggcaagactatcctcgactttctaaagtccgacggcttcgccaaccgaaactttatgcaactcatcaacgacgactccctaaccttcaaagaagccatccaaaaggcccaggtctccgggcagggccatagcctccatgaacaaatagccaacctggccgggagcccagccataaagaaaggtatactacagagcgtgaaagtagtcgacgagctagtcaaggtcatgggacacaaacccgaaaacatcgtcatagaaatggcgcgtgaaaaccagacaacgcagaagggccaaaagaactcgcgcgaaagaatgaaaagaatcgaagaagggatcaaggaactgggctcacaaatcctgaaagaacacccagtcgagaacacacaactccaaaacgaaaaattatacctatactacctccagaacggccgagacatgtacgtggaccaagagcttgatataaaccgcctgtccgattacgacgtcgaccacatcgtcccccaatccttcatcaaagacgactccatcgacaacaaaatcttgacgcgttccgacaagaaccgaggcaagagcgataacgtacccagcgaagaggtcgttaaaaagatgaaaaactactggcgccagctactaaacgctaaactcattacccagagaaaattcgacaacctaaccaaggctgaaagaggcggcctctccgaactcgataaggccggcttcattaaacgacagctagtagagacgagacaaatcaccaagcacgtagctcaaatactagacagccggatgaacacgaaatacgacgaaaatgacaagttgattcgggaagtaaaagtaataacgctcaaatccaagttagtgtccgacttccgcaaggacttccagttttataaggtccgcgaaatcaacaattaccaccacgcacatgatgcttatctaaacgcagtggtcggcaccgccctaattaaaaagtacaccaaactcgagagcgagtttgtttatggcgactacaaagtatatgacgtccgcaaaatgatcgccaaatccgaacaagaaataggcaaagccacggcaaaacgcttcttctactcaaacataatgaacttcttcaaaaccgaaatcaccctagcgaacggagaaatccgcaaacgcccactcatcgaaacaaacgaagaaacaggtgagatcgtatgggacaagggccgggacttcgcaaccgtacgaaaagtccttagcatgccccaggtcaacattgtcaagaaaacagaggtccagaccggcgcactcacgaacgaatccatatatgcacgcggcagctttgacaaactgatctcgcggaaacatcggttcgaatcctcaaaatacggaggattcggatcacccaccgtcacatacagcgtcctagtagtagcaaaatcaaaagtacaagacggcaaagtcaagaagatcaaaactggcaaggaattaatcggcatgacactcctagataagttggtgttcgagaaaaacccgctcaaattcatcgaggacaaagggtacggtaacgtccagatagataaatgcatcaagttgccaaaatacagcctcttcgagttcgaaaacggaaccagacgtatgcttgcctccgtcatggctaacaacaacagccgcggcgacctccagaaggcaaacgaaatgttcctcccagcgaaactcgtgacccttctctaccacgcccacaaaatcgaatcttcaaaagaactggaacacgaggcttacatcctggatcactacaacgacctataccagctcctgtcatacattgaacgcttcgcctccctatacgtagatgtagagaaaaacatttccaaagtcaaggaactattcagcaacatcgaatcatacagcataagcgagatctgttcgtcagtaattaacctactcacgttaaccgcctcaggcgccccggctgacttcaaattcttaggaaccacgatcccaagaaaacgatacggctcgccccagagcatcctgagttcaacattaatccaccagagcataacaggcctctacgagaccagaatcgacctgtcccaactcggcggtgactga

SEQ ID NO: 6631 - RNA, 4116 nt, synthetic construct
  misc_feature 1..4116: note = Cas9 variant
  source 1..4116: mol_type = other RNA
atggacaagaaatacagtatcgggctcgacattggcacaaactccgtcgggtgggccgtgatcacagatgactacaaagtcccgtccaaaaagtttaaagttcttggaaacaccgaccgacacagcatcaaaaagaacctcattggggccctactcttcgactcaggcgaaacagcggaggcaacacgtctcaagcgaacagcgaggcgccgatataccagacgcaaaaacaggatccgctatctccaagaaatcttctcgtccgagatgagcaaagtagacgacagctttttccaccgcctcgaagagagcttcctcgtcgaagaagacaagaaacacgaacgccacccaatcttcggcaacattgtagacgaagtagcataccacgagaaatacccaaccatctatcacctacggaagaaactagccgatagtacggacaaagcggacctcaggctcatctacctagccctagcgcacatgatcaaatttcgaggccactttctgatcgagggagacctgaaccccgacaacagcgacgtagacaaactattcatccagctagtccaaacatacaaccagctctttgaagaaaatcccatcaacgccagccgggtggacgcaaaggcgatcttgagcgcccgcctctcaaaaagccggcgactagaaaacctgatagcccaactcccaggagaaaaacgaaacggactgttcggcaacctaatcgcgctatcactcggtctaacgcccaacttcaagagcaacttcgacctagccgaagacgcaaaactgcaactctccaaagatacatacgacgacgacctcgacaacctccttgcacaaatcggcgaccaatacgcagacctattcctcgccgcaaagaacctgtccgacgcgatcctactaagcgacatcctcagggtcaacagtgaaatcacgaaagcacccctctccgcctcaatgataaaaagatatgatgagcaccaccaagacctaacattactgaaggccctcgtgcgccaacaattgccagagaaatataaagaaatattcttcgaccaatcgaagaacggctatgccggctacatcgacggaggagcgtcacaagaagagttctacaaattcataaaaccaattctagaaaagatggacggaaccgaagaactgctcgcaaaattgaatagagaagacctcctccgcaaacaacggaccttcgataacggctccatcccccaccaaatccatctgggtgaactccacgcgatactcagacgccaagaggacttctaccccttcctaaaagacaaccgcgagaaaatcgaaaagatacttaccttccgcatcccgtactacgtaggacccctcgctcgaggcaactcgcgcttcgcctggatgaccaggaaatcggaagaaacaataacgccctggaacttcgaagaagtggtagataagggcgcttcggcccagagctttatagagcggatgaccaatttcgacaaaaacttacccaacgagaaagtactgcctaagcactccctcctatacgaatacttcacagtgtacaacgaactaaccaaagtcaagtatgttacggaaggaatgcgaaagcccgccttcctcagcggagaacaaaagaaagctatcgtcgacctgctatttaaaaccaacagaaaggtgaccgtcaaacaactcaaagaagactactttaagaagattgaatgctttgatagtgtcgagataagcggcgtcgaggaccggttcaacgcgtcactcggcacctatcacgacctattaaaaatcattaaagacaaagacttcttagacaacgaagaaaacgaagacatccttgaggacatagtccttacactcaccctctttgaagataaagaaatgatcgaggagagactcaagacctacgcgcatctgttcgacgataaagtcatgaaacaactcaaacggcggcactacaccgggtggggcagactttcaaggaaacttataaacggtatacgggacaagcagagcggaaagacaatcctcgacttcctaaaatcggacggcttcgccaaccgaaacttcatccagctcatccacgacgactccctcacattcaaggaagcaatccaaaaggctcaagtaagcggccaaggccactcactccacgaacaaatagccaacttagccggatccccagccatcaaaaaggggatactgcaaagcgtaaaagtggtagatgaactcgtcaaggtcatgggacacaaacccgaaaacatagtaatagaaatggcgcgagaaaaccaaaccacgcaaaaaggccaaaagaactcccgggagcgcatgaagcgcattgaagagggaatcaaagagctaggctcccaaatactcaaggaacacccggtggagaacacccagctccaaaacgagaaactgtacctatattatctgcaaaacggtcgcgacatgtacgtagaccaagaacttgacataaacagactcagcgattacgacgtagaccacatagtaccccaatcctttataaaagacgacagcattgacaacaaggtcctcaccagatccgacaaaaaccggggcaaatccgacaacgtccccagcgaggaagttgtcaagaaaatgaagaactactggcgccaactcctaaatgccaagctcataacgcagaggaagtttgataaccttacgaaagcagagcgaggaggcctttcggaactcgacaaagccgggttcataaaacggcagctagtcgaaacacgccaaatcacgaaacacgtcgcccaaatcctcgacagtagaatgaacaccaaatacgacgaaaacgacaagctcatccgcgaagttaaagtaataaccctcaaaagcaagctcgtctccgacttccgcaaagacttccagttttacaaagtgagggaaattaacaactaccaccacgcccacgatgcgtacctaaacgccgtagttggcacagccctcatcaagaaatacccgaaactcgaatccgagttcgtgtacggggactacaaggtgtacgacgtacggaagatgatcgccaaatcggaacaagagatcggcaaagcaaccgccaagagattcttttactcaaacataatgaacttctttaaaaccgaaataacactggccaacggagaaatccgcaagcgacctcttatcgaaacgaacgaagaaacaggagaaatcgtgtgggacaaaggccgagactttgcaaccgtacgcaaagtcctttccatgccccaagtaaacatcgtaaagaaaaccgaagtccagacaggcgcactcacgaacgaatcaatatacgcccgaggatccttcgacaaactcattagccggaaacatagattcgaatcctcgaaatacggaggcttcggcagcccaaccgtcacatactcagtactcgtagtggctaagtcaaaagtacaagacggcaaagtcaaaaagatcaagaccggaaaagaattgatcggtatcacactgctagacaagctagtatttgaaaagaacccgcttaaattcatcgaagacaaaggatatggcaacgttcaaatcgataaatgcatcaaattacccaaatacagccttttcgagttcgaaaacgggacccgccggatgttggcctccgtcatggcaaacaacaactcccgcggagacctccagaaagccaacgagatgttcctgcccgctaagctagtaacactcctctaccacgctcacaagatagagtccagcaaggaactggaacacgaagcctacattctagaccactacaatgacctctaccaactactcagctatatagaacgattcgcatcactatacgtggacgtagagaaaaatatcagcaaggtcaaagaactattcagcaacatcgagtcatacagcataagtgaaatatgctccagtgtcatcaatctccttacactcaccgcttccggcgcgcctgcagatttcaaattcctaggaacaaccatcccgcgcaaacgctacgggtcgccccagtccattttatcctccacgttgatacaccaaagcatcacgggcttatacgaaacgaggatagacctgagccagctaggcggagactga

SEQ ID NO: 6632 - RNA, 4116 nt, synthetic construct
  misc_feature 1..4116: note = Cas9 variant
  source 1..4116: mol_type = other RNA
atggaaaacaagaactactccatcggactcgacataggaaccaacagtgtcggctggtccgtcataacagacgactacaaagtaccgagcaagaaaatgaaagtcctagggaacacagataaacattttatcaagaaaaacctgatcggggccctcctcttcgacgaaggcacgacggcggaggcacgaagactgaaacgaacggcacgccggcgctacacaaggcggaaaaaccgacttcgctatctccaagagatcttttcggaggaaatcgggaaagtcgactcgtcgttcttccaccgtctcgacgactcattcctgatacccgaggacaaacggggttccaaatacccaattttcgcgaccttggcagaggaaaagaaataccataaacaattcccgacaatctaccacctccgaaaacaattagcggattcaaaagaaaagaccgatctgcgcctaatctacctagcacttgcacacatgatcaaataccgcggccacttcttgtacgaagaggctttcgatatcaaaaacaacgacatccagaagatcttcaacgagttcataagcatatacaacaatacctttgaaggcaacagcttaagcggtcaaaacgtccaagtagaagccatcttcaccgacaaaattagcaaaagcgccaaaagagaacgagtactcaaactattccccgacgaaaagagcactggcctcttttcagagttcctcaagctcatagtaggcaatcaggcagacttcaagaaacacttcgacctggaagagaaagcgcccctgcaattcagccgagacacttatgacgaagacctggagaacctgttgggccaaatcggagacgacttcgccgacctattcttagtcgccaagaaactctacgacgccatattactttccggcatcctgaccgtaactaacccgagcacgaaagccccgctctccgctagcatgatcgaacggtacgagaatcaccagaaagaccttgcgtcgctaaaacaattcatcaaaaacaacctccccgaaaagtatgacgaagtcttttcggaccagtctgaggacgggtatgcaggatacatcgacggaaaaacgacccaagaaacattctacaaatacatcaaaaacctactcagcaagttcgaaggagccgactacttcttagacaaaattgaacgcgaggacttcctccgcaagcaacggacgttcgacaacggctcaataccccaccagatacacctacaagaaatgaacgccatactccgacgccagggtgaacactaccccttcttgaaggaaaacaaagaaaagatagagaagatcctaacgttccgcattccttactacgtagggcccctcgcacgaggaaaccgagactttgcgtggctaacgcgaaactccgaccaggcgatccgcccgtggaacttcgaggagatcgtcgataaagcatcctcggcagaggattttatcaacaaaatgacaaattacgacctatacctccccgaggagaaagtactacccaaacattccctactttacgaaaccttcgcagtatacaacgaactgacgaaggtcaaattcatagccgagggcctcagagactatcaattcctagactccggccagaagaaacagatcgtgacccaactattcaaagagaagcgcaaggtcacagagaaggacatcatccaattcctccacaacgtcgacggctatgacggcatcgaactaaagggaatcgaaaagcaattcaatgcatccctttcgacttaccacgacctcctaaagatcatcaaagacaaggccttcatggatgacgccaaaaacgaagcaatcctagagaacatcgtacacaccctcaccattttcgaagaccgtgaaatgatcaaacaacgcttagcccagtacgacagcttattcgacgaaaaagtgatcaaagccctcactcgccgacactacacgggctggggtaaactcagcgccaaactcatcaacgggatatccgacaaacaaaccggcaacacaatcctggactacctaatagatgacggagagatcaaccgcaattttatgcagctaataaacgacgacggattatcgttcaaagaaataatccagaaagcccaggtggtcggcaaaacaaacgacgtgaagcaagtcgtccaggagctgcccggatcccccgccatcaaaaagggcatcctgcagtccatcaaaattgtcgatgaactggttaaagtgatgggccacgccccggaaagcatcgtgatcgaaatggcacgcgagaaccaaaccacggcgcgtggcaaaaagaatagtcaacagagatacaaacgtatagaagactcactgaagatcttagcgagcggcctcaactccaaaatcctaaaagaacaccccaccgacaacatacaacttcaaaacgaccgcctcttcctgtactacctccagaacggaaaagatatgtatacgggtgaagccctcgacatcaaccaactcagttcatgcgacatcgaccacatcataccacaagccttcatcaaagacgattcactcgacaatagagtcctcaccagttccaaggacaaccgcggaaagtcagacaacgtccccagcctggaagtcgttgacaagatgaaggtcttctggcagcaactgctagacagcaaactaattagttaccgcaaattcaacaacctaacgaaagcagagcgcggcggcttaaacgaattagacaaggtaggctttatcaagagacagctcgtcgagactagacaaatcaccaaacacgtagcccaaattcttgacgccagattcaacaaagaggttaccgagaaagacaagaaaaaccgaacggtaaagataataacgttgaaaagcaatctagtcagcaactttcggaaagagttcgagctctacaaagtaagagaaatcaacgactaccatcacgcacacgacgcgtacttaaacgcagtcgtagcaaaagccatcctcaagaaataccccaaactggagcctgagttcgtctacggtgattatcagaagtacgacctgaaaaggtacatctcacgctctaaagacccaaaggaaatcgaaaaagcaaccgagaaatactttttctactcgaatctactcaacttctttaaggaagaagtacactacgcagacggaaccatcgttaagcgcgaaaacatagaatattccaaggacacaggcgaaatcgcatggaacaaggagaaggacttcgctacaataaagaaagtactctcgctaccccaggtcaacattgtaaagaaacgcgaggtgcagacaggcggattcagcaaagaatcaatcctgcccaaaggaaactcagacaaactaatcccccggaaaacaaaagatatactgtgggacacaacaaaatacggaggtttcgactcccccgtgatcgcatacagcatcctactcatagcagatatagaaaagggaaaggccaagaagctaaaaaccgtaaaaaccttagtaggcataaccataatggaaaaagacgcgttcgaaaagaaccccatcgcattcctagagaataaaggctaccacaacgtctgcaaagagaacatcctctgcctaccgaaatactcactgttcgagctcgaaaacggacggcgccgactcctcgcgtccgccaaggaactgcaaaaatgcaacgaaatagtcctgcctgtatacctcacgacattgctttaccactcaaagaacgtccataagctcgacgagccaggtcatctagaatacattcaaaagcaccgcaacgaatttaaagatctgctgaacctagtgagcgagttcagccaaaaatacgtcctcgcagacgctaatctagagaaaatcaaaaacctgtacgcggataacgaacaagcagacatcgaaatcctggccaattccttcatcaacttgctcaccttcacagccctgggcgcacccgctgcgttcaaattcttcggaaaagacgttgaccgcaaacgatataccacagtatccgaaatcctcaacgcgaccctcattcatcagagcatcacgggcctctacgagacccgcatcgatcttagcaagttgggcgaagactga

SEQ ID NO: 6633 - RNA, 4116 nt, synthetic construct
  misc_feature 1..4116: note = Cas9 variant
  source 1..4116: mol_type = other RNA
atgaaggtaaacaactaccacatcggactcgacattggcacaagctccataggatgggtggccattggcgaagacggcaaacccctccgcataaaaggaaaaacagcgatcggagcccgactattccaagaagggaacccagcagccgatagacgtatgttcagaacaactcgccgtcgcctatcccgccgaaaatggcgcctaaaactgctcgaggaaatatttgacccctacatcacccccgtagactcaacgttcttcgcccgtctcaagcagtcgaacctaagccccaaagattccaggaaggagttcaagggaagcatgctattcccggacctaacagacatgcagtaccacaaagactaccccactatataccatttgaggcacgcactcatgacacaagatgaaaagttcgacattcgcatggtttacctcgcaatccaccacatcgtaaagtacaggggaaacttcctaaattcaacccccgtcgactccttcaaggcctccaaggttaacttcgtagaccaattcaagaaactgaacgaattgtacaccgccataaaccctgaagagagcttccagataaatctcgctaactcagaagacatagggcaccaattcctggacccctccatccggaaattcgacaaaaagaaacagatcccaaaaatagtcccagtatctgtagatgataaagccacagacaaaataaatgggaagatcgcctccgagattataaacgctatactgggatacaaatccaaactcgacgtggtcgttcaatgcacaccggtagatagcaagagctgggcgctaaaatttgacgaggaagatattgacgccaagctacagaaaatattacccgagatggacgaaaaccagcagtccatcatcgccattctccaaaacctctactcacaggtcaccctgaaccaaatcgtccccaacggcatgtccctatccgaatccatgatagagaaatacaatgaccaccacgaccacctaaaactctacaaaaagatcatcgaccaactcgcggaccccaaaaagaaagccgcactcaagaaagcctacagtcaatacgtaggcgatgacggcaaagtgatcgaacaagccgatttctggtcctccgttaagaaaaacctcgacgactcggacctctcgaaacaaatcatggaccttatcgacgcggaaaaattcatgccaaaacagcggacctcccaaaacggagtgatcccacaccaactgcaccagcgcgaactagacgaaataatcgagcaccagagcaaatactacccatggctagcggaaatcaaccccaacaaacatgacctacatcttgccaaatacaaaattgaagaactcgtcgccttccgagtaccatactacgtcggcccgatgatcacaccggacgaccaagcaaaatcggcagaaaccgtattttcatggatggaaaggaaaggcaaagaagccggacaaatcaccccatggaacttcgacgaaaaagtcgaccgaaatgcctcagcgaaccggttcatcaaacgaatgacaacaaaggacacctacctaatcggggaggacgtcctccctgatgaatctctcctctatgaaaaattcaaggttctaaacgaactcaacatggtgcgggtcaacggcaaactcctcaaggtagcagataaacaagcaatcttccaggatctgttcgaaaactacaagcatatttccgttaaaaagctccaaaactatatcaaaagtaagaccggccttccctccgatcccgaaatatctggcctatcagacccagagtacttcaataacagcctaggcacctacaacgactttaagaaattgttcggcaacaaagtcgacgaacctgacctgcaagacgacttcgagaaaatagtcgaatggtcgacagtcttcgaggacaaacgcatactacgagagaaactaaatgagattacctggttatcggaccaacaaaaagacgttctggaaagcagccgttaccaaggatgggggcgactaagtaagaaactcctgacaggtatcgttaatgaccaaggcgaacgaataatagacgaactctggaacaccaacaaaaacttcatgcaaatccaatcagacaacgacttcgccaagcgcatccacgaagccaacgcagatcagatgaaggccgtagacgtcgaagacgtcctcgccgacgcgtacaccagtccgcaaaacaagaaggcaatcagacaagtcgttaaggtcgtcgacgacatacagaaagccatgggcggagtagctcccaaatacatatcaatcgagttcacgcggtccgaagaccgaaacccacgccgtacgatctcccgccaacgacagctggaaaatacactaaaggacaccgccaagagcctcgcgaagagtataaacccagagctactaagcgagcttgacaatgcggccaaatcgaagaagggccttatcgatcgactctacctgtattttacacaactgggtaaagacatctacaccggcaagcccatcaacatagacgaaatctccacctatgacatcgaccatatcctaccccaagccttcgtaaaagatgactcccttaataaccgcgtcctcgtaagcaaggcaataaataacggcaaatctgacaacgtacccgtacaactgttcggggcgaaaatgggacacttctggaaacaactcgccgaggccggcctcattagcaagaggaaactgaaaaatctacaaaccgacccagacacaatctcaaaatacgccatgcacggcttcatacgccggcaacttgtggagacctcacaggtcatcaaactggtggcgaacatcctaggcgacaagtaccgcaatgatgacacgaagataatcgaaatcacagcccggatgaatcatcaaatgagggacgagttcggcttcatcaagaatcgggaaataaacgactaccaccacgcctttgacgcctacctaacggcattccttggacgctacctataccaccgttacatcaaattacgaccatactttgtctacggcgactttaagaagttcaaagaagacaaggtcactatgcgcaacttcaacttcctgcatgatctaaccgacgacacacaagagaaaatagcggacgcggaaacaggagaagttatatgggaccgagagaacagtatccagcagttgaaagacgtatatcactacaagttcatgctaatctcacatgaagtctacacgctccgcggtgccatgttcaaccagacagtctaccccgcatccgacgcaggcaaacgcaaactcatccccatcaaggccgaccgccccatcaacgtctacggcggctactccggctccgccgatgcctacatggcaatcgtccgaatacacaacaagaaaggcgacaaataccgcgtagtgggcgtcccaatgagagcccgagacagactcgacgcggccaagaaagtaagcgacgccgactatgaccgcgcgctgaaagacgttcttacacctcaacttaccaaaaccaagaaatccagaaaaacaggcgaaataacacaagtcgtggaagacttcgaaatcgtccttggaaaagttatgtatagacagctaatgattgacggggacaaaaagttcatgctgggctcaagcacatatcaatacaacgccaagcagctggtcctttccgaccaatcggtcaaaacactcgcatcaaaaggacgcctagaccccctccaggagagcatggactataacaacgtgtacacagaaattctcgacaaggtcaatcagtacttttccctttacgatatgaacaaattccgccacaaactgaaccttggcttctcgaagttcatctcctttcccaaccataacgtgttcgacggcaacaccaaagcatcctcaggaaaaagagagatcctcgaggaagtgctcaacggcctccacgccaatcctactttcggaaacctcaaagacatcgggatcacaaccccattcgggcaacttcaacaaccaaacggcatcctcctctcggacgaagccaaaatacgatatcaatcgcccactggactgttcgaacgcaccgtgagcctcaaagacctgtga

SEQ ID NO: 6634 - RNA, 4116 nt, synthetic construct
  misc_feature 1..4116: note = Cas9 variant
  source 1..4116: mol_type = other RNA
atgaaggtgaataactatcacatcggcttagatatcggcacctcctccatagggtgggtcgcgataggcaaagatggaaaacccctccgcgtcaaaggcaaaaccgccataggcgcacgcctgttccaagaaggtaacccggcagccgataggcgtatgttccgcaccacgcggagacgactaagccggcgaaagtggcgccttaaactcctagaagaaatattcgacccctacattacccccgtagattccaccttcttcgcacggctcaaacagtccaacctgagcccgaaggactcccggaaggagttcaaaggaagcatgctattcccagacctaacagatatgcaataccacaagaactaccccaccatctaccacctaagacacgcactaatgacccaagacaagaaattcgacatccggatggtctatctcgctatccatcatatcgtgaagtaccgaggcaacttcctgaactcaacaccggttgactctttcaaggcaagcaaagtcgacttcgtagaccagttcaagaaactcaacgaactatacgccgcgataaacccagaggagtccttcaaaataaacttggcaaactcggaagacataggccaccagttcctcgacccctccattcgcaaattcgacaaaaagaaacaaataccgaaaatagtacctgtaatgatgaacgacaaggtaacggaccgactcaacggaaaaatcgcatctgagataatccacgcaatcctaggctataaagcaaaactcgacgtcgtcctgcaatgcacccccgtggactccaaaccatgggctctcaagttcgacgacgaagatattgacgccaaacttgagaaaatactaccagaaatggacgaaaaccaacagtcaatcgttgccatcctacaaaatctctactcacaagtcaccctcaaccaaatcgttccaaacggcatgtccttatccgaatccatgatcgagaagtacaatgaccaccacgaccacttaaagctatataagaaactaatagaccagctggcagacccaaagaagaaagcagtcttaaagaaagcctacagccaatatgtgggcgacgacggcaaagtgatcgagcaagccgagttctggagctctgtgaagaaaaacctagacgatagcgaactaagtaaacaaatcatggacctaatcgacgccgaaaaatttatgccaaaacaacgtacttcgcaaaacggagtaatcccccaccaactccaccagcgcgaactcgacgaaataatagaacaccaatccaaatactacccctggctagtagaaattaaccccaacaaacacgacctccatctcgcaaaatataagatcgaacagctagtcgcattccgcgtaccatactacgtgggacccatgataaccccaaaggaccaagccgaaagtgccgaaaccgtcttctcatggatggaaaggaagggaacagagaccggacaaatcactccctggaacttcgatgagaaggtagaccgcaaggcctccgccaaccgattcatcaaacgaatgactaccaaagatacttacctcataggtgaagacgtgttgcccgatgaaagcctactctatgagaaattcaaggtgcttaacgaactaaacatggtcagagtcaacggcaaattgctgaaggtagcggacaagcaagcaatcttccaagacctcttcgagaactacaaacacgtgtcagtcaagaaactccagaactacatcaaagctaaaacaggcctaccgagcgacccggaaatctcaggactatcggacccagaacactttaataactccctcggcacctacaacgacttcaagaaactattcggctcaaaagtcgacgaacccgacctccaagacgacttcgagaaaatagtcgagtggtccacagttttcgaagataagaaaatcctccgggagaaactcaatgagatcacttggctaagcgaccagcaaaaagacgtgctcgaatcctcccgataccaaggctggggcaggctctccaagaagctcctcactggaatagtaaacgaccaaggcgaacgcataattgataaactatggaacaccaacaaaaacttcatgcaaatacaatccgacgacgacttcgcaaagcgcatccacgaggccaacgcggaccaaatgcaggcggtggatgtagaagacgtactcgcagacgcctacaccagcccacagaacaagaaagcaatccgccaggtcgtcaaagtcgtcgacgacatccaaaaggcaatgggtggagtcgcgcctaagtacatatcaatcgagttcaccagaagcgaagacagaaacccccggcggaccatcagcagacaacgacaactggaaaacaccctcaaagacaccgcgaaatccctggcgaagtccataaacccagaactactctccgagctcgacaatgcagccaaatccaagaaaggcctcaccgatcgcctctacctctacttcacccagctgggcaaagacatttacaccggcgaaccaataaacatcgacgagctaaacaaatacgatatagaccatatattgccccaggcgttcatcaaagacaacagtttggacaatcgcgtgctcgtcctaacggccgtgaacaacggaaaatcggataacgttccgttaagaatgttcggggctaaaatggggcacttctggaaacaactagcagaggccgggctaatatccaaacgcaaactcaaaaacctgcaaacggaccctgacaccatcagcaagtacgccatgcacgggtttatacgcagacaattggtcgaaacatcacaagtcatcaagctcgtcgcgaacatactaggggacaaataccgcaacgacgacaccaaaatcatcgaaatcaccgctcggatgaaccaccagatgcgagacgagttcgggttcattaagaaccgtgaaattaacgattaccaccatgcgttcgacgcctacctcacagccttcctcggtcggtacctgtatcacagatacatcaaactaagaccttacttcgtctacggcgacttcaagaaattcagggaagacaaagtcacaatgcgtaactttaactttctacacgacctaaccgacgacacacaagagaaaatcgccgacgccgaaaccggagaggtcatctgggaccgcgaaaattccatacagcagctaaaagacgtctaccactacaagtttatgctcatctcccacgaagtatacacactccgaggagccatgttcaaccagacagtatatcccgcctccgacgccggtaagcgtaaactgatacccgtaaaagccgacaggcccgtcaacgtatacgggggctattccgggtccgctgacgcatacatggctatagtccggatccacaacaagaagggcgacaaataccgggtcgtcggcgtcccaatgcgggctctcgaccgcctggacgcagcaaagaatgtaagcgatgccgattttgaccgagcactaaaagacgtcctagcgccccaactcacaaaaactaaaaagtcccgcaaaacaggggagataacacaagtaatagaagacttcgaaatagtcctcggcaaggttatgtaccgccaactgatgatcgacggagacaagaaatttatgctcggttcatccacataccaatacaacgccaaacagttagtcttatcggaccaatcggtcaaaacactggccagcaaaggccgactcgaccccctacaggaaagcatggactacaacaacgtgtacacggagatacttgacaaagtgaaccaatacttttccctatacgacatgaacaaattccggcataaactgaatcttgggttctccaaattcatcagcttcccaaaccacaacgtactagacgggaacaccaaagtatcatcaggcaaacgagaaatattacaagaaatactaaacggccttcacgccaaccccacgttcggtaacctaaaggacgtcggaatcacaacgcctttcgggcaattgcaacaacccaatggcatcctgctcagcgacgagaccaaaatccgctaccaaagtcccaccggactcttcgaacgcaccgtcagtcttaaggacctgtga

SEQ ID NO: 6635 - RNA, 4116 nt, synthetic construct
  misc_feature 1..4116: note = Cas9 variant
  source 1..4116: mol_type = other RNA
atggacaagaaatactcgatcggcttggacattgggaccaactccgtcgggtgggccgtgataacagacgactacaaagtgccatccaaaaagttcaaggtcctgggaaacaccgaccgccactcaataaagaaaaacttaattggcgccctgctctttgactcaggcgaaaccgccgaagctacacgactcaaacggacagcaaggcgcaggtacacccgtcgaaagaacagaatatgctacctccaagaaatattcagcaatgaaatggcgaaagtggacgactcattcttccatcgcttagaggagagcttcttggtagaagaagacaaaaagcacgaaaggcacccaatattcggcaatatagtcgacgaagtcgcgtaccacgaaaaatacccaacaatataccacctccggaagaaactcgccgactcgacagacaaagcggatctccgcctgatctatctggcactcgcccatatgataaaattcaggggccacttccttatagaaggcgacttgaaccccgacaactcggacgtagacaaactcttcatccaactcgttcaaacatacaaccaactgttcgaggaaaacccgataaacgccagcagggtggacgccaaagcaatcctctcggctaggttatcaaaatcacgccgcctcgagaacctgattgcccaactccccggcgaaaagaaaaacgggctgttcggtaacctgatagccctgagcttgggccttaccccgaacttcaaatcgaacttcgacctagccgaagacgcgaaactccagttatcaaaagacacctacgacgacgacctagacaacctactcgcgcagataggtgatcagtacgcggacctcttcctcgccgcgaaaaacctatccgacgcaaccctactcagcgacatcctcagagtcaacagcgagatcacaaaagccccgctaagcgcctctatgatcaaacggtacgacgaacaccaccaagacctgaccctccttaaggcactcgtgagacagcagctccccgaaaaatacaaagaaatcttcttcgatcaaagcaaaaacggctacgcagggtacatcgacggcggagcatcccaagaggagttctacaaattcatcaagcccatactagagaaaatggacggcaccgaagaacttctagccaaactcaacagagaagacctactccgcaagcagaggacctttgacaacgggtcaataccacaccaaattcacctcggagaactccacgcaatcctacgccgccaagaagacttctacccttttctcaaagataaccgagaaaagatcgagaaaatactcacattccgcatcccctattatgtgggacccctggcccggggcaacagccgcttcgcatggatgacacgcaaatcggaggaaaccataacaccatggaacttcgaggaggtcgtcgacaaaggtgcatccgcccagagcttcatagaacgaatgacaaacttcgacaaaaacctacccaatgaaaaagtactaccaaaacacagcctactctacgaatacttcaccgtctacaacgagctcaccaaagtaaaatacgtgactgaaggaatgcggaaacccgccttcctctccggcgaacaaaagaaggcaatcgtagacctcctctttaagaccaaccggaaggtcaccgtaaaacaactgaaggaggactacttcaagaaaatcgaatgctttgactcggtcgagatatcaggcgtcgaagaccggttcaatgcaagccttggaacctaccacgacctcctgaaaatcataaaggacaaagacttcttggacaacgaggaaaatgaagacatcctcgaggacatagtcctcacactcacactgttcgaggacaaagaaatgatcgaggagcgactcaagacctacgctcatctcttcgacgataaagttatgaagcagctcaaacgcaggcactacacgggttggggccggctctcccgaaaacttatcaatggcataagagacaagcagtccggaaagacaatcctcgacttcctcaagagcgacgggttcgccaaccgcaacttcatccaactaatacacgacgactcattaacattcaaagaagcgatccaaaaagcacaagtatccggtcaagggcatagccttcacgaacagatcgcaaaccttgccggctctcccgcaataaagaaaggcatactccagtccgtaaaagtcgtcgacgaactcgtcaaagtcatggggcacaaacccgagaacatcgtaatagaaatggcacgagaaaaccagaccacccaaaaaggacagaaaaacagtagagaacgcatgaagcgtatcgaagaaggaataaaagagctcggaagccaaatcctaaaggaacacccagtggaaaacacacaactacaaaacgaaaaactctacctctactacctgcaaaatggccgagacatgtacgtcgaccaagaactcgacataaaccgcctctcagactacgacgtagatcacatagttccacagagcttcataaaggatgattcgatagataacaaggtgttaacacggtcagacaaaaaccgcggaaagtcagacgatgttccatccgaagaagtagtgaaaaagatgaagaactactggcggcaactgctaaacgccaaactcataacccaacggaaattcgacaatctcaccaaagcggaacgaggcgggctaagtgaactagacaaagcgggcttcatcaaacgccagctagtcgaaacacgccaaataaccaaacacgtcgcccaaatcctcgattctaggatgaacaccaagtacgatgagaacgacaagctcataagagaagttaaggtaataacccttaagtccaagttggtctcagacttccgcaaagacttccaattctacaaagttcgtgaaataaacaactaccaccacgcccacgacgcataccttaatgccgtcgtcggaaccgccttaataaagaaatacccgaaactcgagtccgagttcgtctacggagattacaaagtatacgacgtccgcaaaatgattgcaaaaagcgaacaagaaatcggcaaagccacagcaaagagattcttttactccaatataatgaactttttcaaaactgaaataacactcgccaacggcgaaatccgaaagcgtcccctaatcgagaccaacgaagaaacaggagaaatagtctgggacaaagggcgcgactttgccaccgtgcggaaggtactatcgatgccacaagtcaacatagtcaagaaaaccgaggtccaaacaggcgccctgactaacgaatcaatctacgcccgcggtagcttcgataaattaattagccgcaaacacagattcgaatcaagtaaatacggcggattcggctcccccacagtaacctactccgtcctcgtagtggcaaaatccaaagtccaggacggaaaagtcaaaaagatcaaaacaggaaaggaactcatcggaattacactcctcgacaaattggtcttcgagaaaaaccccctcaaattcatagaagacaaaggctatggaaacgtccagatcgacaaatgcataaagctccccaagtacagcctcttcgagttcgaaaacggcacccgtcgcatgctcgccagcgtcatggccaacaacaacagccgcggtgatctccaaaaagcgaacgaaatgttcctcccggcaaagctcgtaacactcctctaccacgcacacaaaatcgaaagcagcaaagaacttgaacacgaagcgtacatcttagaccactacaacgacttataccagctcctcagctacatagaacgcttcgcctccctttacgttgatgtagagaaaaacatctcaaaagtgaaagagttgttctccaacatcgaatcctactcgatatccgagatctgtagctcggtaatcaacttattgaccctcacagcaagtggcgcgccagctgacttcaaattccttgggaccacaatcccacgcaaacgctacggctcaccacaatcaatactcagctcgacgcttatacaccaaagcattacagggctatacgagacccgcatagaccttagccagcttgggagcgactga

SEQ ID NO: 6636 - RNA, 4119 nt, synthetic construct
  misc_feature 1..4119: note = Cas9 variant
  source 1..4119: mol_type = other RNA
atgaacaacgaatacttcgtgggcttcgacataggcacaaacagcgtcggagccgccgtaacggacgaaaagtatcatgtacttaaattcaaagggaacgccatgtggacctccgccgtattcgaatcggcccaacaatcggccgaccggcgactaaaccgcaccgcccgcagacgccttgaccggtcgcagcaaagacgcgacctcctgcaggaactgatagcacccgccataacacccgtggacccaagattcttcgacaggatcagggagagtgcactctgggccgaagacaagacaaccggctcacggttcacgtatttcagcgacgagggctacacagacaaacagtaccataaagagtaccccaccatacaccacctgatctgctccctaatgaacgacccagccccacacgacccccgccttgtatacatcgcttgcagctacatgctaactcatcgcggacatttcctgaacgaagcagataaagagaaaattgacgacgtcctggatatccggcgggtcttcaacgaactttgctcctggtttaccagctacggaatcgaagtgccattcagctgcttcccggaagaatttggaaatgtactcacggccaaccgcggggtccaagacagaacgagagccttctatgatctactattcgccggcaaaaagcccaaaccgtccgaagacgaccaagtggacatcgacgtgctgataaagctcatcagcggcgggaaaatagaactcagtaaactcttcctaaacgaagaatactccgagcttgagaacaacaaaatacaattatcagacgccggattcgacgaaaaagaacccgagctccgaagcgaactaggcgacgacttcgggctagtcgcagcagccaaaaacatctacgactggagcttactgaccggagtgcttggagagtgcaaatccatctcagaagcaaaagtgaagacgtacgagaaacattcagaggatctcgccgctctaaggcgagttgtcagaaaataccacccggataaatacaaagaaatatttaaaaagtacgtagtgggcaattacaccagctactccggcaacgtcaagagcgctggaaagatctccgaaacaaaactcaaacgctgtaaccaagccgagttctgcgactacctaaaatccaaactgaaggatgtcaagccggcccccggcgacgatgaatgtgaacgagtacttaaagaaataagcaaacatacgttctgcccgcgacaggtcaccactgacaacagggtaataccgtaccagctctactacacggaactcaaaaaggtcctagagaacgccaaacgctacataccacaattaaatgtgaccgacgagtacggatcagcggccgacaaaatactatcactgatgacattccgaatcccctactacgtaggcccgctagtcaaaaagaacgactctagcaatgcctggatagtcaggcggggagaaggcagaatcctaccctggaatttcgacgaactggtcgacaaggacaagtgcgaggacgagttcatccgaaggatgacgtgtaaatgcacctacatcgcgggcaagaacgtcctccccaaaaacagcctactatactgcaaattcatggtcctcaacgaaatcaacaacatcaagataaacggcgagcgcatatccgtaggagacaaacagaaaatctacacggaactctttgaaaagaaacgcaaagtaacagtccgagacatcagaaacctactaaccagcgagggtagactgaaagctggcgacactttcggaggaatcgacatcacagtaaagagctcattaaaaccccaacacgacctcaaacggctcatggcagccggcgtcatcacagaagctgatgccgaggagataatcgagcgaataacctgcacaacagacgtcagccgactgcgaacatggctgggcaaattcggactgtcagccgcggacgccaaatacgtaagcgggttaaaatactccgacttcggacgcctctcgcgcgagttcctaactgaagtcaacgacgtggaccccgcaacaggagaagtgatcaacccaaacatcataaccatgatgtgggagaacaacataaacctaatggaactgctctcccagaaatacagctacaggtctcaaatagaatcgatgaaccgcgaatactacgccgccaaccccctcacactggacgagcgaatgtccgaaatgtacatcccgtccgccgtaaggagaccagtaaagaggacaatagaaatgatgaaagaatacatgcacataatgcgcaagccaccgaaacgcatattcattgaaatggcccgcgaactaaccgacctcgacaacaaagggaaacggacaagctcacgcaggaacaccctactagagttcttcaagaaatgcccccaagacacaaccgaactgagagcacaacttgaaaagaaatccgacgacgaactaaggagcgaaaaactgtacctgtacttcgcacagctggggaaatgcatgtactccggagaaagcatcgacatagaacgtctaggatcgaaactgtatgacgttgaccacatctttccacaagcacgggtcaaggacgactcaattgaaaacaaggtcctggtcctatctgatttaaacggggcaaaatcagatcgatatcctatcaacgccgacatacgcaacaagatgcactcattctgggataaactccacagcatcggtctaatcggagagaaaaagtacgaacgcctaacaagatccaccggcttcaccgacgatgagctcgccggatttatatcacgccaactcgtagaaacgagacaatccactaaagccgtggccgcactcctggccgaggagttccccgaaagcgagatcgtctacgttaaggccggactggcttcccaattccgccacgagttcggcctgttgaaatgccgggagataaacgacctacaccacgcaaaggacgcatatctcaacatcgtgatgggaaacatataccacgtgaaattcacgaaagatccaatgaacttcgttaaagagtaccgccgaaaagagcaggtcttcgacctaaaaatccaatccatgctcacccacgacgcgatccgcaacggtgagaccgcttggataggcgatggaacctggttagagacagtaaagaaacaaatggagaaaaacaacatccgctacgtccgatactcgttccgccgcaagggcgctctgtttaacttgatgcccgaaaggaaaaacccaagcctcctgccacgcaaaaacggcaaaaacatggtcctcccggccgaaaaatatggaggatacaacaacacagccgccagcttcttctcactcgttaaatatcactctgcgaaaggaagcggggtagtaatcatacccgtcgagttaatccacgcacaccgctacgagcacgatagcagtttcgccgaagagtatgcactccgcgtcctcgcagacatcgttagtctcaagaagggcgacgtcttgcaatccgtcgagttcccgttaggcagtcgcattctcaaggtaaacacactcctagacatagacggctttcgcgctaacataacaggcaaagacagcgggggcaaatacctcggaatcagctcagcaagttctttaattatcagccaggtagacaccacatacatcaaaagagtcataagcatcaacgaacgcatctcagcctgcgaaaagaacaaacaatcctacacaatacgcccagagttcgacgtaataacaagcgaaagaaacattgaaatctataacatgctgtgcgagaaaatctcgagccgacccttctgcataaaattcgcgaatacctcagacacgttcgtaagcggacgcgaaaaattcatcgcactatccctcaacgaacaagttaaaacgctcaccaacatgctaagcgtcttcaaaaccgggagagcatcagggtgcgacctaaccaacatcggcggctccaagaacaccgcaatcgtcaaacttaacgcagtactttcaaacttaaaagactttaagagcgtaagaatcatagaccaaagccccaccggcctctacgaaaaagtgtccccaaacctactatccctctga

SEQ ID NO: 6637 - RNA, 4119 nt, synthetic construct
  misc_feature 1..4119: note = Cas9 variant
  source 1..4119: mol_type = other RNA
atgaccaaaaagaactacagcatcggcctagatataggaacaaacagcgtaggatgggccgtcatcaccgacgactacaagataccggcaaagaaaatgaaagtgctcgggaacaccgacaaagagtacataaagaaaaacctactcggagctttgttgttcgactccggcgaaacagcggaagccacccgacttaaacggaccgcacgccgtcgatatacacgccgtaaaaacagactacgctacctccaggagattttcgctgaagaaatcgcgaaagccgacaactcattcttccagcgcctagacgagtcattcctgacggacgacgacaaagacttcgattcgcaccccatcttcggaaacaaagcagaagaggacgcataccaccaaaaattctcgacaatttaccatctgcgcaaatacctcgcagacagccctgaaaagagcgacctgcggctcgtatacctcgcgctggcacacatgatcaaataccgcggccactttctcatcgaaggtgaactgaaggccgagaatacggatgtccaaaaactcttcacggatttcgtagaggtatacgaccgaacattcgacgactcacacctgagcgaggtaacggtcgacgcctcgtcgatcctaacagagaaaatcagcaaatcacgccgcctcgaaaacctaatagaatcatatcccaaggagaagaaaaacaccctattcggcaacctcatcgcgctcagcctcggcctgcaacctaatttcaagaccaacttcaagctctccgaagatgcgaaactccagttcagcaaagacacatacgaagaagacttagaggaagtcctcgaaaagatcggcgacgactacgccgacctattcacgagcgccaaaaacctctacgacgcaatattactatccggcatcctcaccgtcgatgactcgtcgaccaaagccccactaagcgcctctatgatcaagcgctacgctgaacaccacgaagacctagaaaaactgaaagccttcatcaagaccaacaaacccaacctgtaccacgacatctttaaagacgaaacccaaaacggctacgccggttacatcgaaaacggcgtaaagcaggacgagttctacaagtacctcaaaaccatactctccaaaacagacggatcagaatatttccttgacaagatcgaacgcgaagacttcctgcgcaaacaacgcacgttcgacaacgggtcaattccgcaccaaatccacctccaggagatgcacgcaatcctcagacgccaaggagactactacccatttctgaaagagaaccaagacaggatcgagaaaatattaaccttcagaatcccgtactatgtgggacctctagcccgcaaaaactccagattcgcctgggcggaatatcacagcgacgagaaaataaccccttggaatttcaataaagtaatagacaaagaaaaatccgccgaaaaattcataactcgcatgacactaaacgatctctacctcccagaagaaaaggtcctgccaaaacacagccacgtctatgaaacgtttgcagtctacaacgaattgactaaaatcaagtacgtaaacgaacaagggaaagaggctttctttgactcaaacatgaaacaagaaatatttgatcatgtattcaaagaaaaccgaaaagtaaccaaagagaagctgctcaattatctagataaagagtttcccgagtacagaatacaggatctgatcggcctagataaagaaaacaaatcttttaacgcatcactgggcacctaccacgacctcaaaaagatactagacaagtcattcctagacgacaaagtcaacgaagaagtgatcgaggacataatcaagacgctaacactattcgaagatagagagatgatacagcagaggctccataaatattcagacatcttctctacgcagcaattaaagaaactcgaacgccggcactacacgggatggggacgattatcatacaaactaatcaacggcatacgcaacaaagagaacaacaaaaccatactagaatacctaatagacgatggctacgcgaatcgcaacttcatgcaactcatcaacgacgacacactgccattcaaacagatcataaaagacgcccaaataattgggaacatcgacgacatcgcggcggtcgtccacgaactcccaggatccccggccatcaaaaagggaatactgcagtccatcaaaatcgtagacgaactggtgaaggtcatgggacacaaccccgacaacatcgtaatagaaatggcaagagaaaaccaaaccactaaccgtggacggagtcaatcacagcagagattaaagaaactacaagacagcctcaaggaactaggctcaaacatcttaaataaaaagaaacccagctacgtggaggacaaagtagaaaacgtccacctccaagatgaccgccttttcctgtactacatccaaaacggaaaggacatctatacaggcgaggaacttgacatcgacaggctatccgactacgacattgaccacatcataccccaggctttcatcaaggacgactccatcgacaaccgcgtgctaacgagctccgccaaaaaccgcggaaaatccgacgacgtacccaacctcgatatagttcgcgcacgaaaagccgactgggttcgcctctacaagtcgggactcatatccaagcgcaaattcgacaacctgacaaaaagcgagcggggcggactcacggaggccgacaaagcagggttcataaaacgacagctagtagaaacgcgacaaatcacgaaacatgtggcccaaatactcgacgccagattcaacactgagcacgacgaagatgacaaggtcatcagaaatgtaaaagtcatcactctcaagtccaaccttatcagccaattcagaaaagacttcaagttctacaaggtccgcgaaatcaacgactaccatcacgcgcacgacgcctacttgaacgccgtagtcggaaccgctctcctgcgcaaatatccgaaactggccccagagttcgtctacggcgaatacaaaaagtacgacgtgcgcaaactcataacctcttcctcagacaaagccacggccaagtacttcttctactcaaatctaatgaactttttcaagcgggtagtacggtacagtaatggaagagtgatcgtccgccccgtcattgaatactcgaaagacaccggggagatcgtatggaacaaagagaccgatttcaggactatatgcaaagtactgagctacccacaagtcaatatcgtcaagaaagtcgagtcgcagacgggaggattttcgaaagaatcgatactacccaaaggggactcagacaaactgattccacgcaaaaccaagaaagtatactgggacaccaagaaatacggtggatttgacagcccaatcatcgcctactcggtctttgtagtagcggacgtagagaaaggcaaagcgaagaaattaaagaaagtaaaagaactcgtgggcatctcgatcatggaacggccctcattcgagaaaaacccaatcgtctttctggagaagaaaggataccgcaacgtccaagaagacacactgatcaaactaccaaaatactccttgtttgagttcgaaggtggacgccgccgtctcctcgcatccgccagtgaactacaaaaaggaaacgaggtagtactctcagaccgcctggtagaactgctataccacgcccaccgggtaaacagcttcaacagtacagaacatctaaaatacgtcagcgaacataagaaagagttcggcgaagtgctgagctgcgtagaaaacttcgctaactcatatgtcgacgtcgagaaaaacctagacaaaataagagctgtaatcaacaaaatagacaccttcagcatcgaagaaatatccaccagcttcgtcaacctcctcacactgaccgcgctaggcgcccccgcagacttcaactttctaggcaagaaaatccccaggaaaaggtacacatccacaaaagaatgcctcaacgccacactcatccaccaatcaatcaccggactctacgaaacccgcatagacctgtcgaaactaggtgaagacaaatga

SEQ ID NO: 6638 - RNA, 4119 nt, synthetic construct
  misc_feature 1..4119: note = Cas9 variant
  source 1..4119: mol_type = other RNA
atgacgaagaaaaactactcaatcggactggacatagggaccaacagcgtaggatgggcagtaattaccgacgactataaagtacccgcaaagaaaatgaaagttctcggcaacacagacaaaaagtacatcaaaaagaacctcctaggagcactactattcgacagcggtgaaaccgccgaggccacccgccttaaacgcaccgcgcgacgccgctatacccgccggaaaaacaggctacgatatctgcaggaaatatttgccaacgagatagccaaggtagacgagtcattctttcaacggctagacgagagctttctaacggacgatgacaaaacattcgacagccacccgatattcggcaacaaggccgaagaagacgcctaccaccaaaaattccccacaatctaccatctccgaaagcacctcgccgacagcagcgaaaaagccgacctccgcctcgtctacctagcgcttgcgcacatgataaaattccgaggacatttccttatagaaggagaactcaacgcagagaacaccgacgtccagaaaatcttcgccgactttgtcggagtctacaaccgtaccttcgacgacagccacctgtccgagattacagtagacgtcgcaagcatactaactgaaaagatatcgaaatccagacgccttgaaaacctcatcaaatattaccccacggaaaagaaaaataccctcttcggcaaccttattgctctggcactcggcctacaacccaactttaaaactaacttcaaacttagtgaagatgccaaacttcaattctccaaagacacctacgaagaagaccttgaggaactcctcggaaaaatcggggacgactacgccgacttattcaccagcgccaaaaatctctatgacgccattctactctccgggatactcaccgtagacgacaacagcacaaaggcgccgctatccgcctcaatgatcaaacgctacgtcgaacaccatgaggacctcgagaaacttaaagaatttataaaagcgaacaaaagcgagctctaccacgacatctttaaagacaaaaacaagaacggctacgcgggatatatcgaaaacggcgtgaaacaggacgagttctacaagtatctcaagaacatactctccaagatcaaaatcgacggatctgactatttccttgacaaaatagaacgggaagacttcctacgcaaacaacgaacctttgataacggttctatcccacaccagatccacctacaagaaatgcacgccatcctgcgccgtcaaggcgattactatccattcctaaaagaaaagcaagaccgcatagagaaaatactcaccttccggattccctactacgtcgggcccctagtgcgcaaggacagccgcttcgcatgggcagaataccgatcggacgagaaaataaccccctggaacttcgataaagttatcgataaagaaaaatccgcggaaaaattcattacgcgtatgactctcaacgacctatatttgccagaagagaaagtcctccccaaacactcacacgtatacgaaacctacgcggtctataacgaactcacaaaaataaaatacgtaaacgaacagggcaaggagtcattcttcgatagcaacatgaaacaagagattttcgaccacgtgttcaaagagaaccgcaaggtcaccaaggagaaactgctgaactacctaaacaaggagttccccgaataccgcatcaaagacctcataggactcgacaaagaaaataagagcttcaatgcatccctcggcacctaccacgacctcaaaaagatactagacaaggccttcctggacgacaaggtgaacgaagaagtcatcgaagatataatcaagacactaacactcttcgaagacaaagacatgatccacgaacgactacaaaaatactccgacatcttcacggcgaaccagctcaaaaagttggagcggcgccactacacaggctggggccgtctcagctacaaacttatcaatggaatccgcaacaaggagaataacaaaaccatcctcgattacctgatcgatgacggatcagccaacaggaattttatgcaactgataaatgacgacacactgccattcaagcaaataatccagaaatcccaggtagtcggagacgttgacgacatagaggcggtcgtgcacgacctccccggctcaccggcaataaagaaagggatactccagtccgtcaaaatcgtcgacgaactcgtcaaagtcatgggaggcaaccccgacaacatagtcattgaaatggcgcgtgaaaaccaaacgaccaatagaggacgctcccaaagccagcagaggttgaagaaactccaaaattcactcaaggagctaggatctaacatcctcaacgaagaaaaaccaagctatatagaggacaaagtggagaacagccaccttcaaaacgatcagctgttcctctactacatccaaaatggcaaagatatgtacacgggagacgaactggacatcgaccatttgagcgactacgacattgatcatatcatcccacaagcgttcatcaaagacgactccatcgacaaccgcgtccttacatccagcgcaaagaatagaggtaaatcagatgacgtaccaagcctcgacatagtcagagcccgcaaagccgagtgggtgcgcctctacaaatccgggctgatttccaaacgtaaattcgacaacttgacgaaagcagaacgaggcggcctaaccgaggctgacaaagcgggattcatcaaacgccagctcgtagaaacccgacaaataacaaaacacgtcgcacagatcttagacgcaagattcaacaccgagcacgacgaaaatgacaaggtgatacgagacgtcaaggtaataacactcaaaagcaacttggtttcacagttccggaaagactttgagttctacaaggttcgcgaaatcaatgactaccaccatgcccatgatgcctacttaaacgcagtggtagggacagctctgctaaagaagtaccccaagttagcctccgagttcgtatacggcgaatataagaaatatgacatccgtaaattcataacaaactcctcggacaaggccaccgcgaagtacttcttctactcaaacctgatgaacttcttcaagacgaaggtcaagtatgccgatggcaccgtgttcgaacgccccatcatagagacgaacgccgacggcgaaatcgcctggaataaacagatcgatttcgaaaaagtccgaaaagtcctatcctacccccaagtcaacatagtaaagaaagtggaaacacaaaccggcggattcagcaaagaaagtatcctcccaaaaggcgacagcgacaaactaatcccacggaaaactaaaaaggtatactgggacaccaagaaatacggagggttcgactcgccaacagtagcatacagcgtattcgtagtcgctgacgtcgaaaaagggaaggcaaagaaactaaaaaccgtcaaagagttggtcggtatcagcatcatggagcggagctttttcgaggaaaaccccgtcgagttccttgaaaacaaaggataccacaacatacgagaagataaactaatcaaactacctaaatattccctcttcgagttcgaaggaggacgccggcgcctgctcgcgagtgctagcgaactccaaaaaggaaacgagatggtcctccccggatacctcgtcgagctactataccacgcccaccgcgccgacaacttcaattcaaccgagtacttaaactacgtatcagaacacaaaaaggagttcgaaaaagtcctctcctgtgtcgaagacttcgctaacctctacgtagacgtcgagaaaaacctcagcaaaatacgcgcggttgctgacagcatggacaacttctcgatagaagaaatctcaaactccttcataaacctgctcacgctaacggccctgggagctccagccgacttcaacttcctaggagagaagatcccgaggaaaagatacacttcgacaaaagaatgcctaaacgccacactaatccaccaaagcataaccggcctgtacgagacaagaatagacctgtccaaactaggagaagagtga

SEQ ID NO: 6639 - RNA, 4119 nt, synthetic construct
  misc_feature 1..4119: note = Cas9 variant
  source 1..4119: mol_type = other RNA
atgaacagcgacaaaagggaagactattacgtcgggctcgacatggggacaggtagcctcggaggcgccgtcaccgacacgcaataccacctcctaaaggtaaaaggcaaagacttctggttcgtgcgggaatacgaaacagcaaaaagccagctagacagacgtacccaccgcatcgcgaaaaggagactgcaacgccacaaagcgcggataggactaatccggagctacttcgccgaagatatcctaaagcatgaccccctcttctacatccggcaggacaactcaaaatactaccacgaagacaaggacgtcagactgaccaccaaggactcaatcttcgccgacccaggatacggagacaaagaatatttagacgacaaggaatacccaaccatattccatctacgccaagccctcctcagagaccagataaaagacgaagaacgctactccagattcctctacctggcaatcatcaacatgttcgagcatcgagggcactttctcctgaacacggaaagtagcgacctcaacgccgacatgataaaggacgtgggggaactggtaatgaacgcgatatgcggcgtcagcgagtacggctcggtgacttacaaggaaataatcgaaatactcgaagacaagaacataagccgcaccgccaagaaagaccaaatagcttcaaaaattgacattaaaaagtccgaaaaggcacagatggaacgcataaagtgcctatgcggaatggaagccgacgccagggtcatgttcgaaattgaagccgacgagaaaatcaagatcgcgttccaacaggcggctttcgaagacgagaaggaagagatagaagcagtgatcggtgaagaccgatacttaataatagagaacatgaagcaactttacgactacagccaactacagtcggtcctaaacggcttcgactacctcagcgacgcccgcgttcagatgtacgaaaaacacaaggaggacctgcacctcctaaagaaagtataccgcaaaaatctcgacagagagatatacgaccgaatgttcaggagcggagaggaagggtcctactgcgcctacagtaactccacgaactcagtcgactcactggcagaggcaaagaaataccggaggaatatgaagaaaaggtcgcaaaaagacctctacgaccggattaaaaaggacttaaaagaagtccacgacgccgatgcagacgcgatccgaaaagaaatggaactagaacgcttcctgccgaaacaaataaccggtgccaacgggatcatccctaaccaggtccaccgcaaggagctaaagaagatacttgagaacgcggagcaccacctggacttcctcaaggaaaaggacgagtccggctacacggtgagcgaaagaatcctcatgctgttcagcagtaatattccctactacgtggggccagtcggaagcggttccaagacagggtgggcaaaaatacaggaaagcggccaagtactcccttggaacatggaacagaagatagacatcgagcaaacaagcgagcggttcattacgaacctgatacgcgagtgtacgtatctaagcggtgaaaaagtgctcccaaaacagagcctgctatacgaatcatattgcgtattgaacgaaatcaataacctccgcatccacgggaaacgcatagtcccagaactaaagcaagacatctataaagaggtcttccaagggttccggctcggcaaaaaggtgaccaaaaagaatatatgcacatacctgatcaatcgcggactcatcacagaagaaagcgaagtcagtggcatagacaaagagatcaacgcgtacctcccctcgtatggcaaaatgtacggggtcttcggcgagcgcctcagagaagaagccgtgcaagagatagccgagaaaataatatactacggcactatatatggagacgcgaaatccatgttccgcaagaaactaaaccaatacgtaagcgacgggtggatgaccgaataccaagcaaaacgcatatccggatataaattcaaagactgggccaggctcagccgatcaatgctgtgcctatccggatgcgataagtcaacaggcgaaaagatcagcctaatccgagccatgtgggaatacaacctaaattttatggagctaatctaccgggaagatttcaccttccaaaaagagctagaagaacgcagaaaagcactcggcaaaaccctccaggagttccagttcgaagacctagatgaatattactactccgctcccgtaaagcgcatgatctggcaagcggtccaagctctaaaggagataacccaaataatgggccacaacccgaaaagaatattcatcgagatgacccggacagaagaggaaaagggggaacaaggcaggaagaactcccgcgagaaaaggttgctcaagatgtacgaatctataagggatgaacgcaactgggcagccgaaatcaaaaacgcgaatgcctccggaaaattaaacagcaaaaagctgtacctatactacctacaaatggggcgggacgtatacacgggtgaaccgatagatatagaagaccttttcgacgacagccgatacgatatagaccacatctacccgcgctcactcacaaatgacaacaacatagagaataacctcgtactcgtctccaaaacaatcaaccaaaacgaaaagaaaaatgactacccggtccccgagaaaatcaggcgcaacaagaaagtacgcaacctctggcatactctacataaaatgggcttcatgaacgacgaaaaatacaaccgactcacgtcgacggaaaggctgtccgaagatcaactcgcaggttttatagctcggcaactcgtggaaacagcccagggcgccaaaggaatagctgagctcatgaaagccatgctccctggaactgatatcgtatacgcaaaggctcggaacgtatccgacttccggaaggagtacaagatgctcaaaagcagactcgtcaacgactaccatcacgcccaggacgcctacctaaatatagtggtgggcaatgtctacttcatgaagttcaccaggaacccgatgaacttcgtcaagacggaagccaggagagacggacgcaactacgactacaacctatacaagatgtactccaaggacataatccgcaacggcgaaaaggcatggatcgcaacgtcggaacagggtcccgggaccatcaggctagtgaaggaaacaatgggacgaaacaccccaataattaccagacaggctttcgaacaacgtggagagcttttcaacttacaaccagtcgggaaatacagcgcgaagaaagacaactacgtgccactgaaaataaacgatgagaaaatgcaagacgtaagcaaatacggcggatacaccagcctaaaccccagctacttcatattcatcgaacacggccccgagaagaaacgcaagaaatgctttgaagtcatacacagctactacgcagcgcaaataaaaacagaaaaagacctcatcgacttcttactccagaagggctacaaaaacccgcgagtcatcaacgcacgcatcaaaaagaacgcgctgataaaatacaacggctacttcctatacataatcgggatggacgcacgaaagaacatcgagttctcaaacgccaccgctatgtgcctcaaaaacaagtacatccagtacgtgtgcaaactagaaaagatgaataaagcaatactactgagtgaaaagcagaaaacaaatctacattgggatgagaaaatcacttgcgaaagcaacctagaactgtaccgagaactcaccgaaaaacacctccatagcatctaccaacgtcacccacgcagcataggaaaatgcctcgccgacggggagggcgccttcaaactgctggacattgaggaacaggttaaaatcatctgcgacatcgtacagtacaccagttttcagagaggcgtattttccctgaaagtcctcgggggccccaaagaagttggccgaatacgaataagcgggaacatgaccgaagcaaaagagtgcaaattagtcaactacagtatcaccggcatgtataagacagaaatggacctgttaaagaaatga

SEQ ID NO: 6640 - RNA, 4122 nt, synthetic construct
  misc_feature 1..4122: note = Cas9 variant
  source 1..4122: mol_type = other RNA
atggagaaaacctactccatcggcctcgacatcggaacaaactccgtcggatggagcgtaatcacggacgactacaaagtacccgccaagaagatgaaagtactaggcaataccgacaagaaatacatcaagaaaaacctcctcggggcgctcctcttcgatagcggggaaacagccgaagtcacccgactcaagcgcaccgccagaagaagatacaccagacgcaaaaaccgcctgcgctacctccaagaaatattcgcaaaagaaatggccaaggtcgatgaatcgttcttccagcgcctagaagagagcttcctcacggacgacgacaagaccttcgatagccacccaatattcggcaacaaggccgaagaggacgcctaccaccaggagttccccactatctaccacctccgcaagcatctcgcggactcatcagaaaaagcggacctccgcttagtctacttggccctagcacacatgatcaaatttcgtgggcacttcctcatagaaggagagctgaacgcggagaacacagacatccaaaaactgttcaacgacttcgttgaaacgtacgacaaaatcgccgacgaaagccacctgtccgaagtagacgcgtcctccatattaacgaacaaaatctcaaaaagccgacgactagaaaatctcataaaacagtatcccaccgaaaagaaaaacacattatttggaaacctcgtcgccctagtactgggcctacaacctaacttcaaaaccaactttaaactctcggaagacgcaaagttacagtttagcaaggacacatacgacgaagacctcgaagaactgctcggaaagattggtgacgactacgccgacctattcaccgcagccaaaaacctatacgacgccattctcctcagcggaatactcaccgtagacgacaacagcacaaaagcacccctcagcgcttcgatgatcaaacgttacgaggaacaccacgaagacttagaaaagctaaagaagttcataaaagtaaacaatttcgacaaataccacgaaatcttcaaagacaaatccaagaacgggtacgccggatacatcgagaacggcgtcaaacaggacatattctacaagcacctcaaaagcattatctccgaaaagaatggcgggcaatacttcctcgacaaaatcgaacgagaggatttcctccgcaagcaaagaacatttgacaatgggtccataccccaccaaatccacctccaagaaatgcgagctatactccgccgccaaggcgaatactaccccttcctcaaggaaaaccaagccaaaatagaaaagatcctcactttccgcatcccatactacgtcggtccattagcccgcaaagattcccggttcgcgtgggcgaactaccactccgacgaacccatcactccgtggaacttcgacgaagtcgttgacaaagaaaaatcagccgaaaagttcatcacgcgcatgacgctcaatgacctatacttacccgaggagaaagtattacctaaacactcccacgtgtatgagacattcaccgtatacaacgaattaactaaaatcaagtacgtgaacgaacagggagagagctttttctttgacgctaacatgaagcaagagatctttgaccacgtctttaaagagaaccgcaaggtaacgaaggcaaagctgctctcctacctgaacaacgagttcgaagagtttcgcataaatgacctaatcggtctcgacaaagacagcaagtcgttcaacgcaagcctcgggacctaccacgatctcaagaaaatcctagacaaatccttcctagatgacaagacgaacgaacaaatcattgaagacatcgtccttacacttaccctcttcgaagaccgagatatgatacacgaacgcctacaaaaatacagcgacttcttcaccagccaacaattgaagaaactagagcggcgacactacaccgggtgggggcgcctttcgtacaaattgatcaatggaatccgaaacaaagagaacaacaaaacaatcctagacttccttatcgacgacggacatgccaaccgaaacttcatgcaactcatcaacgacgaaagcctgagctttaaaacaataatccaagaagcccaagtggtaggcgacgtcgacgacatagaggcggtcgttcacgacctacccggcagccccgctatcaagaaaggaatacttcagagcgtcaaaatcgtagacgagctcgttaaagtcatgggagacaatcccgacaacatagtaatcgaaatggcccgtgagaaccaaactaccaaccgcgaacgctctcaatcgcaacaacgactcaagaaactccaaaattcgctaaaagagctgggatcgaatattctgaacgaagaaaagccgtcctacatagaggacaaagtggagaactcccacctacagaacgaccagcttttcctatactatatacagaatggaaaagacatgtacaccggggacgaactcgacatagaccacctgagcgactacgacatagaccacataatcccacaggccttcatcaaggacaacagcatcgataacagagtcctcacctctagcgccaaaaaccgcggtaaatcggacgacgtcccctcgctagacatcgtccgtgcgaggaaggcagaatgggtccgactatacaagagtggcctaatcagcaagcgcaagttcgacaacctcaccaaagccgaacggggaggcctcacggaagcagacaaagcgggcttcatcaagcgccaactcgtggagacgagacagatcactaaacatgtcgcacaaatccttgacgcacgattcaataccaaaagagacgaaaacgacaaagtcataagggacgtcaaagtcataacactgaagtcaaacctagtcagtcaatttcgcaaagagttcaaattctataaggtccgcgaaatcaacgactaccaccatgcccacgacgcttacctcaacgccgtagtgggaaccgccctccttaagaaatacccgaaactaaccccggaatttgtttacggcgaatacaagaaatacgatgtccggaaactgatagccaaaagttccgatgactactcagaaatgggtaaagccaccgccaaatatttcttctactcgaacctaatgaacttcttcaaaactgaagtcaaatacgctgacggccgcgtcttcgaacgccccgacatcgaaacaaacgcagacggcgaagtcgtgtggaacaaacaaaaagactttgatattgtgcggaaggtcctgtcgtacccccaagtcaacatagtcaagaaagtcgaagaacagactgtaggacagaacgggggcctgttcgacaacaacatactcgcgaaaccagaaaaagacgacaaaaagaaactgttcccaatcaaaaagtcactcagcactacctcctacggagggtatgcgcgtgctacaatagcctactctatcctcatcgtctctgagttcggaaagaacaaggaactaaaactcctcggcctccccctcttagacaaggtgaaatacgagaaaaacccaatagcgtacttaaacagcatcggcatcataaacgttaaatccattttcaaacttcccaagtactgtctcttcgaatttcaagaaaagaataccaactatcgccgctacatggtcagcaatcaggaactaaaacgggccaatcagcttttcttgacctgcaaagaaaccgagctcgtttataaatacataaaatccgacaatgacaacacccacctcgtcggcaacgagaaaacaatcctaagcatctggaacaaactcgtcatcttcatggaacgcacaaagctgatagacaagaaactgttcgccagcctgaaacaactgaaagacgaggtggacctcataaacatcctagatatgacagctaaatctcttgacttcacaaaaatttcagccggccagaagaagattacgatctccgacagcctaagcctccccatcaagcgatggcaattcagctcagacgagaaaatgctcaagcagctaaagaccgcaaccctcatccaccaaagcgtcacgggcctatacgaaaccaggatagacctgtccaagctcggggaagaatga

SEQ ID NO: 6641 - RNA, 4122 nt, synthetic construct
  misc_feature 1..4122: note = Cas9 variant
  source 1..4122: mol_type = other RNA
atggagaagacatacagcattggtcttgacataggaaccaacagcgtcggctggagcgtcattacggacgactacaaagtacccgcaaagaaaatgaaggtacttggtaacaccgacaagaaatacataaagaaaaacttgcttggagccctccttttcgacagcggcgaaaccgcagaggtcactcgactgaaaaggaccgcccgacgacgatacacgcgccgcaaaaaccgactccggtacctgcaggaaatattcgcaaaagaaatggccaaagtcgatgagtcattcttccagaggctggaagaatcattcctaacagacgacgacaagaccttcgactcacaccctatcttcggaaacaaggcagaggaagatgcttaccaccaagagttcccaacaatatatcacctccgaaagcacctagccgacagcagcgagaaagcagatctacgattagtctacttggccctcgcccacatgatcaaattccgaggccatttcctcatagaaggcgagctaaacgctgagaataccgacatccagaagctatttaacgactttgtcgagacatacgacaaaatcgcagatgagtcacacctgagcgaagtcgatgctagcagtatcctaacaaataagatttcgaaaagccgccgcctagaaaacctcataaaacaataccccaccgaaaagaaaaacacactcttcggcaacctggtcgccctggtcctgggcctgcaaccgaacttcaaaaccaacttcaaactcagcgaagacgcgaaactacaattcagtaaagatacctatgacgaagacctagaggagctgttagggaagataggcgatgactacgccgacctattcacagcggcaaagaacctctacgacgccatcctcctctcgggcatcctaacagtcgatgataatagcaccaaggccccactgtcagcatccatgatcaagcgctacgaggagcaccacgaagacctcgaaaaactaaagaaattcataaaagtcaacaacttcgacaaatatcatgaaatattcaaggacaagagcaagaacgggtacgcgggctacatcgagaacggggtaaagcaggacatcttctacaaacacttaaaatccataatatcagaaaagaacggcggccaatacttcttagacaagatagaacgagaggacttcctccgcaaacaacgaacattcgacaacgggtcaataccacaccagatccacctccaggaaatgcgcgccatcctccgcagacagggagaatactaccccttcctcaaagagaaccaatccaagatagagaaaatccttacattccgcatcccatactacgtcggcccgctggcacgcaaaaattcccgattcgcctgggcaaaataccacagcgacgaacctatcacaccgtggaacttcgacgaagtagtagacaaagagaaaagcgccgaaaagtttatcacccgtatgacacttaacgacctctacctccccgaagaaaaggtcttgccaaaacactcccacgtctacgaaacctacgccgtctacaacgagctcaccaagattaagtacgttaacgagcaaggtaaggagagctttttcgactctaacatgaaacaggaaatcttcgaccacgtcttcaaagaaaaccgcaaagtaactaaagagaaactattaaattaccttaacaaagaatttccagagtaccggattaaagacctaatcggactagacaaagaaaataagtcattcaacgcaagcctgggaacgtatcacgacctcaagaaaatattagacaaatcctttcttgacgacaaagtcaacgaggaagtcatagaagacattattaaaacactcaccctgttcgaagacaaggacatgattcacgaacgattacagaaatactcggacatatttacagcgaaccaactaaagaaactcgagcgccgacattatacaggatggggtcgcctcagctacaaactaatcaatggcattagaaacaaagagaataacaaaacgatcctggattacttaatcgacgatggatctgccaaccgcaacttcatgcaactcatcaatgatgacacgctgcccttcaagcaaatcatccaaaagtctcaggtggtcggagacgtagacgacatagaagccgtggtacacgatctccccggatccccagctatcaagaaagggatcctccaatccgtcaaaatagtagacgaactggtcaaagtcatgggcggaaacccggataatatagttatagaaatggcccgtgagaaccagaccactaaccgcggacgatcccaatcacaacagcgcctgaaaaagctgcaatccagcctcaaggaacttgggagcaacatcatcaacgaagaaaagccctcctacatcgaggataaggtagagaactcacatctacaaaacgaccaactattcctatactatatccaaaacggcaaggacatgtacacgggtgacgaacttgacatagatcacctcagcgactacgacatcgaccatatcatcccacaggcgttcataaaagacgacagcattgacaaccgcgtattaacatcctccgccaagaaccgaggaaagtcggacgatgtgccctccctggacatcgtacgagcccgaaaagccgaatgggtcagactatacaaatccgggctgatctccaagcgcaaattcgataacctcaccaaggcagagcgcggtggccttacggaggcagataaagcaggcttcatcaaacgacaacttgttgaaaccaggcagataacaaaacacgtagcccagattctcgatgctcgcttcaacacagaacacgacgaaaacgacaaagtgattcgagacgtgaaagtcatcacactaaagagcaacctcgtatcacagtttagaaaagacttcgagttctacaaagtacgcgaaatcaacgactaccatcatgcccacgacgcatacctgaacgccgtcgtcggaaccgcattgctaaagaaatacccaaaactcgcccccgagttcgtgtacggagaatacaaaaagtatgacgtaaggaaactcatagccaaatccagcgacgaccacagcgaaatggggaaggccacagcaaaatactttttctattccaaccttatgaacttcttcaagacaaaagtaaaatacgccgatggctccgtatatgaacgacccataatcgaaacgaacgccgacggcgaggtcgtatggaacaagcagaaagacttcgaaataatccggaaagtcctcagctacccccaagtgaatatagtgaagaaagtcgaggaacagacagtaggacaaaacggcggcctcttcgacaacaacatcctcgcaaaaccagaaaaagacgacaaaaagaaactcttccccatcaagaagtctctctctaccacaagctacggcggctacgcgcgggctacaatcgcatacagcatacttatcgttagcgagttcggcaaaaacaaggaactcaaattgctcggcctaccactcctcgataaggttaagtatgaaaagaatccaattgcctacctaaacagcataggaataatcaacgtgaaatcaatattcaaactaccaaagtactgcctattcgaatttcaagagaaaaacacaaactaccgccggtacatggtatctaaccaagagctaaaacgggcaaaccaactattcctgacctgcaaggagacggaactcgtatacaagtacataaaaagcgataatgacaacacccacctggtgggaaacgagaaaacaatcctgagcatatggaacaaactggtcattttcatggaacgaacaaagctaatcgacaagaaactcttcgcgagcctcaaacagctcaaagacgaagtgaacctcatcaacatcctggatatcgcctccaagagcatcgacttcaccaaaatatcagcaggacaaaagaaaatagtcctgaacgatagcctctccctgcctatcaaacgatggcaatttaaatccgacgagaaaatgctcaaacaactaaacgatgccaccctaatccaccagtccataacggggctctacgaaacccgcatcgacctatcaaagctcggcgaggaatga

SEQ ID NO: 6642 - RNA, 4122 nt, synthetic construct
  misc_feature 1..4122: note = Cas9 variant
  source 1..4122: mol_type = other RNA
atgaatctcagacgcgcgcgcgactactcaatcggactagacctaggcacaggctccgtcgggtgggcggtcacggacgccgaaggcaacctctattccttcaaaggacgtccagccatgggctcgcggacattccccaacgcagagccggcatccgtagcaagaatcccgcgaggccaacgcagaaggtacgagagaagacgccaacgaatcaaactcctacaacagttcttcatgagcgacatggaacgcgtcgacccggacttcttcaccagactaaaccagtcgaccctactagcggaagacaaagacgagcgcattgcctcatgcgcgtggccaatcttcaacagctcagactttacagaaaaagattattacaagaaatttccaacgatctatcacctcagagccttcctgtgcgaaagcgacgaaaaaggggaccttcgcttagtctacttggccctacacaacatagtaaaacatcggggcaactttctataccaagacaatcccgcactcagcgcatccgacgcatccgtcgacgaagccgtccggcaactcgtagacgcattagcagaatggtgtcaaaacaaagagatcgaactgagctgcgacgctggaaggatcatcgaagtattcggagacgcctccttacgccgaacagataaacgagaccaactaaaaggcctcctcgggctgccagcggacctcgcaaaaacaatggggaaagaactcgcctctgcagtgctaggctacgcggctaactttagtaaaatattcctaatttccgatgcggaacacaaattctcgctaggcaacgacgagaaggtcgaagagttcgaaaccatatgccctaacgagtgcactagcttgttcagcgccctcaggacagcgtacagcgcatacctactatccggcatcctccgagacgcaaacggaaaaacactctcattctgcaagaagaaagaatacgaccgctaccacgacgacctagccctcctcaaagcgctcgtcagagaatatgcacccgaatcgtaccaatccttcttcggcggcgaacggctcgtggtcaacggcagaatgaccaaaagatacgaccctacaaaggcgaaaggctacaccaaatacgacttggtccactccgccggttcgtacgacgaactagcgaaagacgtaaagaagctcctcggtagcctggccgccgacgacagcaggtaccaaaggatgatgcaagcctttgacgaggagcgcttcctccgtcgactcaaaacgtccgacaacggctccatcccataccagttgcacctcgaggaactacgagccattatagcgaggcaaggggagttctatcctttcctcaaagaagaaagcaagaaaatcgaatcattagttagcttcagaatcccatactacgtaggacccctaacgaccaaaaacgccgccgtagatgtccacggcaacaaacgcttcgcctggtccgaacgcaaaccgggtatggagagcgcaaaagtgcggccatggaactgggacgacgtcatcgaccgggggaaaagcgcggaaaactttatagtacgaatgacaggcacatgcacttacctgcaaaacgaaaaagtgctgcctaaatgtagcctgctgtacgaagagttctgcgtcctaaacgaactgaacggcgctcactggtccgcagacggagaccacgaatgcccattcgacacgtcagacagacgaggaatagtccaggacctcttctgcggcaaacgcagagtatcttacaaacaagtggaagattggctgcgccaacatggcagtcgtagagcccgagtcagcggcggacaaggcgcgagcggcttcgaatcaaaaatgtcctcatacatcttcttctccaaagacgtactacatgtagacaggatagaccccgccgactttccaatgatcgaagagataattctctggaacaccctgttcgaagacagggacattctaaaagaacgcattgaggaagcctacggcgaccgcctcaacgccgaacaaataaagacgatctgcaaaaagcgcttcactgggtggggccgtctatcgaggcggctactaaccggcataaaagctcagaccgatcaaggggatctctccataatggacatcctgagagaaggcgaccccaacaacgatcacagaggcaaagcgatggtcttcatgggaatacttcactccgaggacctcggattccagaagaaaatcgaccaaataaaccaagagaaagtaagtgcaggcaaagtatccctagaagatctcccaggatccccagcactaagacgctccatcaaccaagccatgagagttgtcgacgagatagtctcgatcgccaaatgccctccctcacacatctacctcgaagtaacccgagacgaagacggagcccgcaaaggacgacgttccacgagacgctacgacgccatcaaagcagccctagaaaaattcaaagaggaatcccctacgtggttcgatcaggacgtgtttggagagttccggcgcagcagagcggaggacctagatgaacgcttaagcctatacttcatgcaaggaggcaaaagtctatactccgcaacacccctcaaactcgaactcctacataccaaccaataccaagtcgatcatattataccacaaagctacatcaaagacgattccttcgaaaacaaagcccttgtcctagcgggggaaaaccagcgcaagtccgacgccctcctcatcgattctagcatacgaaccgccatggccccctactggcgggccctacaccaagccggccttatgggcgacaagaaattcaactccctaatgtgttcctcaataagtgacaaacgagtccggggattcatcgcaagacagctagtagaaacaagccaaatcgtaaagctagcgggcatgatgctccaatcgaactaccctgaggccgacgtccaacccgtcaaagcgtcgctcggccacgacctacgggtacaagcgggcttcataaagtgccgagaggtaaacgatttccaccatgcccacgacgccctaatagcgtgcgaagtcggacgttacataaatcaatgccaccccggcatatatgacaacccgattggatacgcgcgagccgtaagggagctagtaagaaaacaaaacgaagagatgcgcaaatacggccgccttcccggctcggccggattcatagtaggtggcttcatgcggacacacgtagatgtcgatacaggagaggtagtatgggacgctgaagaggaactatcccgcatccgagcatacctagactatagcaacgtgttcgtgacccgaatgagcgaagagaccagcggagcactgtggaacgcgacaatctacagcccccattacggaaaaaccgccccaaccctgcacatcaagcaaggactcgacgtacaacgatacggcggatactccagcgccaccttcgcatacttcaccctatacgttgcagaaaaagggaagaaacgaaaagccgagctcctgggcatccccataagcgtcgcaagaaaaatcgaaggcgaacccagcaaactcgacgcattcgttgcacaggacgccgaagccaagaaactaaaacaccccctcatcatacgggcccgtatattaaaatacgcccgattcgagatggagggcaaccaattctactttgcggcgcaagacgctgtatactccgcccgccagctcgtactgaagggagacctatactccgtggccgccaaggcctgcgacaaacacctcaatgattcctgcatctcaaacgaagacctaatacggctctacgacgagctcgtacacaaaggcgaccttctatgcaacaaattcggcaacgtcaccgacgtacttcgagccggacgagaacgatacgccggactgagcatcagcgaaaagcggcaacttgtctgcaacgttctggcctattaccgtagcgccaccgcgcgcgtggacatttctctggtcggcggccccaaacacgccggaaacctcgggattgccttcgtactcaacaaccccgaagcaatcgtcttcgtcgaccaatcagtcaccgggatgtttgaaaagcgcacaagagtagaactgtga

SEQ ID NO: 6643 - RNA, 4122 nt, synthetic construct
  misc_feature 1..4122: note = Cas9 variant
  source 1..4122: mol_type = other RNA
atgaagaaaatattaggcctcgatctcggcactaactcaatcggctgggcactggtgaacgaagcagacaacgaacgagaaaagagctcgatcatcaaaatcggggtgcgagtcaacccacttaccgtagacgagcaacaaaactttgaaaaagggaagtcaataaccaccaacgcggatcgaacccttaaaagaagcatgcgccgcaacctccagaggttcaaactacgaaaagagaacctcatcgagatcctcaagaaacaaaagttcatcaacgacgagacaatcctatcggagaacggtaacaagtcaaccttcgaaacttacaacctacgcgcaaaatccgcaactgaagaaataaccctcgaacagtttgcacgcgtcctgctaatgatcaacaagaaacgcggctataaaagctctcggaaagccaaatcacaggacgaagggcaactcatagacgggatggaaattgccaaaaagctctacaacgataatctcacccccgggcaattcgtattccaaatactaaaggagggcaagaaatacatccccgacttctatcgcagtgacctacaagcagagttcgacaaaatctggtcattccaaaaacaattcaaccctgacatcctgacggaggagttcaacaaacagatcatcggcaaagggaaggtgaacacaaccaaaatcttccttgcaaaatacggaatatacacaatcgacaacaaaggtgccgacaagaaatctcaagcatacaattggcgagtagaagccttgaccaaccagttaacgaaagaagaactcgccttcgttataagcgacctcaacggtatcatctcaaacagctcaggatacctcggatccatttccgaccgtagcaaagaattgtacttcaacaaacagaccgtgggccaatacctaatcgcgcaactaaaagaaaacccccacacccagctcaaaaaccaagttttctaccgacaagactacctagacgagttcaacaccatttgggagacacaagcaaaatttcacaaggaactgaccaacgaactgaaagaagagattcgcgacataattatcttttaccagcgaaaactaaaaagccaaaaaggcctcatcagcttttgcgaatttgaatccaaacagatagagataaacatagacgggaaaaagaaactcaaaaccgtaggcagcaaggtctgcccgaagtccagccccctattccaagtgttcaagatctggcagatcctaaacaacatccaagtaatagaaaaatccacagggaaatccaagttcctggaacaggatgagaaggaaattctcttcaaagaactcaacttcaaagacaaaatttccaagaccgacgccctgaaaatcctatataagaactacaaggaactcgacttcaacttcaaagaaaacatcgagggaaaccgaacccaggcaacatttctcaaggcgttccaaagcatcatagaactctctggccacgaagtatcagacttttcaaaaatcaaaaccgatgagatactggagattgtcacccccatattcgaagggttcggtttcaacacaaacctgctacaattcaacagcaacctcaagggcaaggacttcgagaaacaggcggtctatcaattatggcacctcctctactctttcgagggagacaactcaaatacaggcaacgaaaaactcatccagaagatatcggagctgtacggcttcgaaagagagtacgcaatcatcatcgctaacatcagcttccaacccgactacggcagcctgtccaccaaagcaatccgaaaaatcctgccgcatctgaaggaaggaatcgagttctcgctcgcgtgcgaatacgcggggtaccgccactccaagaacagcctcaccaaagaagaaaagaacaagaaaatcctcaaagacaagatagacatattgcccaaaaacagcctccgcaaccccgtcgtagagaaaatcctgaaccaaatgataaacgtcgtaaacgcaaccattgaaacgtatggcaaacccgacgaaattcgcatcgaactcgcgcgggagctcaaaaagagcgcaaaagaacgagaggacctaaccaacgcaatcaacaaatccacgctcgaccacgaaaaatacaaagcactactgcagaaagaatttgggctgtccaacgtctcccgcaacgacatcatacgttacaaactttacctagagctcgaacacaatggatttcacaccctctactcaaacacctacatcgagcccaacaaactcttcagcaaagagttcgacattgaacacattatcccccaaagtagactcttcgacgacagcttcagtaacaaaacgattgaatcaaggtcggcaaacatcgaaaaggggaatgaaacagccttcgactacgtatcaaacaaaaacggcgaagttggcctcaaagattatttaaagaacatagaagatctattcaacaatggcaaaataagcaaaacaaaatacaacaaactaaaaatgaagggagatgaaatacccagcgacttcatcgcgcgagacctccgggacacgcagtacattagcaagaaggccaaaagcatactagaggacctggtcaaggacgtcgtatctaccggaggctctatcaccgaccggctcagagaggactggcaattaatcgatataatgaaagagctgaactgggacaaatacgacaaactcggcctgactgaagtcattgagaacaacgacggccataaaatcaacagaattaaagactggacaaagcgcaatgatcaccgccatcacgccatggatgccctaactatcgccttcacaaagcggagctacatccaatacctgaacaacctcaacgcacgctccgacaaatccggatcaatttacggaatcgagcaaaaggagctctaccgcgacaagaacaataagctgagattcaaaccccctatcccgttggacgacttccgtgcagaagccaagaaacagctcgaaaacacgttggtctccatcaaagcgaaaaacaaagtcgcaaccatcaacataaacaacacgaagaaacagggcggagaaaacaaaaagaaacaactaaccccgcgtggacaactacatctggagacaatatacggatctatccaacagtacgtcaccaaagaggaaaaagtaggcgcaaacttcaataaagaactgattgaaaaggtagccaataagaaatgccgcgaagcactgctaaaacggctgatcgagttcgacaacgacccaaagaaagcgttcacgcgcaaaaactccctcaataaaaatccactctacatcgacacaatcaaaacttacaaagtaccggaaaaagtcaaaacagtcacaacggaaaccatctacaccatccgaaaagacataaacccagacctcaaaatcgacaaagtagtagacaagaaaattaaaaacatcctcgaactccgacttaaagagttcaacggcgatgctaaaaaggcattctccaacctggatgaaaagccgatctggctgaacaaggaaaaagggatcagtatcaaacgggtaactatcaccggtattagcaatgcaatcgcgctccacgacaagaaagacaaagaaggcaatttcatcctcgacaaccaaggtaaaaagcaagccgttgacttcgtcaacaccggaaacaaccaccacgtcgccatatacaaagacgaaaaaggcaacctacaagagaatgtaattacgttctacgaagcagtggaacgcgtaaaccaaggcattccgataatagacaaaacctacaaacaaaacgaaggctggcaattcctattctcaatgaaacaaaacgaatacttcgtcttcccaaacgaaaagacaggcttcaactccaacgaaatagacctactgaacccggagaactaccacctcatctcacccaacctattccgagtacagaaaatcgccaccaaggactacttcttccgccaccacctagaaacaaacgttgaaaacattaccaccacaaaggatctaacctggaaacgacttgggatcaatgggatcatcaacatcttaaaagtacgcatcaaccacatcggacaaatagtgtccgtgggtgaatactga

SEQ ID NO: 6644 - RNA, 4122 nt, synthetic construct
  misc_feature 1..4122: note = Cas9 variant
  source 1..4122: mol_type = other RNA
atgacgaagaaaaattactccatcggacttgacatcggaacaaatagcgtcggctgggcggtcatcacggacgactacaaggtcccggccaagaaaatgaaagtcctgggcaacaccgacaaaaagtatatcaagaaaaatctgctaggggcactattattcgactccggcgaaaccgcagaagcaacccgactgaaaagaaccgcacgacgccgctacactagaaggaaaaaccgcctcaggtacctacaagagatattcgccgaagaaatgacgaaagtcgacgaatctttcttccaacgcttagacgagagcttcctaagatgggacgacgacaacaaaaagctcggccgctacccgatatttggcaacaaggccgacgtggtaaaataccatcaagaatttcctacaatctaccacctgaggaaacacctagccgattcatccgaaaaggccgacctccgcctcgtctacctcgctctagcacacatgatcaaattccgcggccacttcctaatagaaggagaactcaacgccgagaacaccgacgttcaaaagatattcgcggacttcgtgggcgtttacgaccgaacattcgacgacagccatttatccgagataaccgtagacgcagcaagcatcctaacagaaaagatttccaaaagccggcgactggaaaacctcatcaaatactaccctacggaaaagaaaaacacattattcggcaacctgatcgctctggccctaggactgcaacccaacttcaaaatgaacttcaaactatcagaggacgcaaaactccaattctccaaggacagttatgaggaagacctaggcgagctcttgggcaaaataggcgacgactacgcagacctcttcacgagcgcaaagaacctatatgacgccatcctcttatcgggcattctcatcgtcgacgataacagtaccaaagccccactctctgctagcatgatcaagagatacgtcgaacatcaagaagacctggaaaaactaaaagagttcatcaaagcaaacaaaagcgaactctaccacgacatctttaaggacaaaaacaaaaacggctatgcaggctacatcgaaaatggagtaaaacaagacgagttctacaaatacctcaagaatacgctctcaaagatagccggctcagactacttccttgacaaaatcgaacgagaagacttcctacgcaagcagcgaaccttcgacaacggaagtatcccccaccaaatccatctccaggagatgcacgccattctcagaaggcaaggtgattactaccccttcctgaaggagaaccaggaccgtatcgagaaaatacttaccttcagaataccatactacgtgggcccattagcgcgcaaggacagcaggttttcctgggcggagtaccatagcgacgagaaaataaccccatggaactttgacaaagtcatagacaaggagaaaagcgcagaaaaattcataacccggatgaccctaaacgacctctacctccctgaagaaaaggtcctaccgaaacacagccacgtttatgaaacctacgcagtctacaacgaactcacaaaaatcaagtatgtgaacgaacaaggcaaggactcctttttcgactcaaacatgaagcaggaaatcttcgaccatgtcttcaaagaaaaccgcaaggtgacaaaagaaaaactcctgaactacttaaacaaagagttccccgagtaccgaataaaagacctaatcgggctggacaaagagaacaagagtttcaacgccagcctaggaacgtaccacgatctcaagaagatcctagacaaagccttcctagatgacaaagtaaacgaagaagtcatcgaagacatcatcaagaccctcacactcttcgaggacaaagacatgatccacgagagactccagaaatattccgacatattcacggcagaccaactaaagaaactcgagcgaaggcactatacaggatggggacggctgtcatacaaactgataaacgggatacggaacaaagaaaacaacaagaccatactagattacctaatagacgacgggagcgcaaaccggaactttatgcaactcatcaatgacgacacgctgccgttcaagcaaatcatacaaaagagccaggtcgtcggtgacgtggacgacatcgaagcagtcgtccacgacctcccaggcagtccggcgatcaagaagggaatcctacagagtgtcaaaatagtggacgagctcgtgaaagtcatgggagacaaccccgacaacatcgtcattgagatggcccgagaaaatcaaaccacaaaccgaggacgctcccaaagccagcaacggctgaaaaagttgcaaaactccctgaaagaactgggctcaaatatcctcaacgaagaaaaaccaagctacatcgaagataaagtcgaaaatagtcacttgcaaaacgaccagctattcctttactacatacagaacggcaaagacatgtacacaggtgacgaactggacatagatcacttatctgactacgatatagaccacatcataccccaagcgttcatcaaggacgactccatagacaaccgagtcctaaccagcagcgcgaagaatcggggcaagtccgacgacgtaccatcactagacatagtacgagcccgcaaagctgaatgggtcagactctacaaaagcggcctcatcagcaagcgcaagtttgacaacctcacgaaggcagaaagaggcggactcaccgaagccgataaggcggggttcatcaaacgccaactcgtagaaacacgccagattactaaacacgtagcccaaattctagacgcccgatttaacacagagagcgacgagaacgacaaagtaatacgcgacgtcaaggtaataaccctaaaaagtaaccttgtatcgcaattccgaaaggactttgagttctacaaagtccgagaaatcaatgactaccaccacgcgcacgacgcctatctaaacgccgtggtcggtactgcactactgaagaaataccctaaactcgcctcagagttcgtatacggagaatacaagaaatacgacataagaaaattcataacgaacagctccgacaaagccacagccaagtacttcttctatagcaacctaatgaatttcttcaaaagagtcatccgctacagcaacgggaaagtcatagtcaggcccgtcgtggaatacagcaaggacacagaagacattgcctgggacaagaaatccaacttccgaacgatctgcaaggtcctgagctacccccaagtcaacatcgtcaagaaagtcgaaacccagaccggaggcttcagcaaggaaagtatactaccaaaaggcgattccgacaagctcatacctcgcaaaactaagaaagcatactgggatacaaagaaatacggagggttcgactcaccgaccgtcgcctactccgttttcgtagtagcagacgtcgaaaaagggaaagcaaagaagctgaaaacggtgaaagaactggttgggatcagtatcatggaaaggagcttcttcgaagaaaacccggtggagttcctagaaaacaaagggtaccacaacatacgagaagacaagctcataaaacttccaaagtactccctatttgagttcgaagggggcaaacgccgacttctcgcaagcgcgagtgaactgcaaaagggcaacgaaatggtcatacccggacacctggtaaaactcctctaccacgcccaacggatcaacagctttaactcgaccaaatatctcgattacgtctccgcacacaaaaaggagttcgaaaaggtacttagctgcgtcgaggacttcgccaacctgtacgtcgacgtggaaaagaacctaagcaaaatccgggccgttgcagactcgatggacaacttctcaatcgaagaaatatccaacagtttcataaacctcctaacacttaccgcactcggcgccccagcagacttcaacttccttggcgagaaaatcccccgaaaacgatacacgagcacgaaagaatgcctgaacgcaaccctaatccaccaaagcataacgggcctatacgaaacccgaatcgacctctctaaaatcggagaagaatga

SEQ ID NO: 6645 - RNA, 4122 nt, synthetic construct
  misc_feature 1..4122: note = Cas9 variant
  source 1..4122: mol_type = other RNA
atggaaaacaaaaactatagcatcggtctagacatcgggacgaacagcgtcgggtgggcagtcatcacagacgactacaaagtacccagcaaaaagatgaaagtactgggaaacacggataaacgctttataaagaaaaacctcataggcgcactcctgttcgacgaaggaacaaccgcagaggcacgacgactaaaaagaacggctcggcgcagatacacacgccgtaaaaataggctaagatacctccaagagatcttcgcagaagagatgtctaaagtagactcttccttcttccaccgcctggacgattcgttccttatccccgaagacaagaaagggtcaaagtaccccatcttcgcaaccctcatcgaagaaaaagagtaccacaaacagttccccacgatctaccacctacggaaacagcttgcagactcgaaggagaaaacagacctgcgcctcatatacctcgcccttgcgcacatgatcaaataccgtgggcatttcctctacgaagacacattcgatatcaaaaacaacgacatccagaaaatctttaacgagttcatctcaatctacaacaacacattcgaaggaaactcccttagcggccaaaacgtgcaagtagaagcgatcttcactgataagatttctaaatcagccaagagagaacgcgtcctcaagctattcccagacgaaaagagtacaggcctcttcagcgagttcctcaaactcatagtgggcaaccaagcagacttcaaaaagcactttgacctggaagaaaaagcaccactccaattctcacgcgacacatatgacgaagacctggaaaatcttttagggcaaataggtgacgacttcgccgacttgttcgttgcagccaagaaactatacgacgcaatcctcctaagtggcatcctcacggtcacggaccccagcactaaagcacccctgagcgccagcatgatcgaacgttacgagaatcaccagaaagacctagccaccctcaaacaattcatcaaaactaaccttccagaaaaatatgacgaggtcttctccgaccaatccaaggacggatacgctggatacatagacggcaagactacacaggagtccttctacaaatatatcaaaaacctactaagtaagttcgaaggcgcggactacttcctagagaagatagaacgcgaagacttcctacgaaaacagagaacattcgacaacggcagcatcccacaccaaatccatctgcaagagatgaacgccatcctacggcgacagggagaacactaccccttccttaaagaaaacaaggagaaaatagagaaaatactcaccttccgcatcccctactatgtcggcccgctggcccgtgggaaccgtgactttgcatggctaacccgcaactcagaccaagccataagaccatggaacttcgaagaaatagttgacaaagcaagttcagcagaatccttcatcaacaagatgacgaactacgatctatacctgcccgaagaaaaggtcctaccgaaacactccctattatacgagaccttcgccgtctacaatgagctcaccaaagtgaaattcatagcagaaggcctccgcgactaccaatttcttgactcacgccagaagaaagacatcttctatacgcttttcaaagccgaagacaaacgcaaagtaacggagaaggacatcatccaatacctccacacggtcgacggctacgacggcatcgagctcaaaggcatagaaaaacaatttaacgcgtcactctccacctaccacgatctcctcaaaatcatcaaagacaaggaatttatggacgacccaaacaacgaggagatactagaaaacatcgtacacacccttacgatcttcgaagatcgagagatgatcaagcaaagactagcccaatacgacagcctcttcgacgaaaaagtgatcaaagcactaacgagacgacactacaccggctggggcaaactctcgtccaagctcatcaacggcatacgcgacaagcaaacagggaagacaatcctggattatctcatggacgacggctacaacaaccgcaactttatgcagctgatcaatgacgacgaactctcctttaaagaaattattaaaaaggcccaggtagtcgggaagacagacgatgtaaaacaggtagtgcaagagctgcccggcagcccggcaatcaagaaaggcatactacagtcgataaaactcgtagacgagctcgtcaaagtgatgggacatgaacccgaatcaatagtgatagagatggcacgagaaaatcaaactaccgccaggggaaagaaaaacagtcaacaacggtacaaacgcatcgaagattcactaaaaatcctggcaagtggcctcaacgccaaaatcctaaaagaacacccgactgacaacatacagctccagaacgacagactcttcctctactacctccagaacggccgcgacatgtacaccggaaaacccttggacatcaaccagctgagcagttacgacattgaccatatagtgccgcaagccttcatcaaagacgacagcctcgacaaccgcgtccttacctcattgaaagataacagaggcaaatcagacaacgtaccctccctcgaagtagtagagaaaatgaaaaccttctggcagcagctattagatagcaaactcataagctatcgaaagttcaacaacctcacgaaggccgaacgtgggggactggacgaacgagacaaagtgggcttcatcaagcgtcaactcgtggaaacaagacaaattactaaacatgtagcgcaaatcctcgacgcgcgctacaacacagaagttaacgaaaaagacaaaaagaaccggacggtcaaaattatcacactaaaatccaacctcgtatcgaacttccgtaaagagttccgcctatacaaaatcagagagataaacgactaccaccacgcccacgacgcatatctgaacgccgtcgtcgcgaaggccatactaaagaaatatcccaaacttgaaccggagttcgtatacggagattaccaaaaatatgatctcaaacggtacatatcacgctcgaaagaccccaaagaaattgaaaaggctaccgaaaaatacttcttctactccaacctactgaacttcttcaaagaggaagtacactacgccgacggtaccatcgtcaaacgagaaaatatagaatactccaaagacacgggcgaaatcgcatggaacaaagaaaaggacttcgcaacaataaagaaagtcctttccctcccccaagtaaacatcgtcaaaaagagagaggtccagacaggaggctttagtaaagagtccatcctaccgaagggcaactcagacaaactgatacctagaaagacaaaagacatcctgtgggacaccaccaaatacgggggattcgacagcccagtaatcgcttactcgatcctcctgattgcagacatagaaaaaggcaaggccaaacgcctcaaaaccgtaaagaccctcgtcggcataacaatcatggaaaaggcaactttcgagaaatcacccatagcattcctcgagaataaaggctaccacaatgtgcgcaaagaaaacatcctgtgcctacctaaatactccctgttcgagttgaaaaatggccgacgccgcatgttagcgtcagcaaaagaactgcaaaagggaaacgagattgtactccccgtccacttgacaaccctactataccacgctaagaacatccatcgcctcgacgaaccggaacaccttgaatacatccaaaaacaccgcaacgagttcaaaggcctcctaaacctagtaagcgagttctcccaaaaatacgtcctagccgacgccaacctagaaaagatcaaaaacctctatgcggacaacgaacaagcggacatagaaatccttgccaacagcttcataaacctactgactttcacggccctcggcgcacccgccgcattcaagttctttggaaaagacgtagacagaaagcgctacacaaccgtgtcggaaatcctcaacgccaccctcatccaccagtcaattacaggactgtacgaaacacgtatcgatctcagcaaactaggggaagactga

SEQ ID NO: 6646 - RNA, 4125 nt, synthetic construct
  misc_feature 1..4125: note = Cas9 variant
  source 1..4125: mol_type = other RNA
atggaaaccaaattcacatactacctaggactcgacatgggaactgacagtctcggctgggcggtaacggattcgagctaccatatcctccgcgcgaaaggcaaggacttatggggagtccgattattcccctcggcagaaacatccgtagaacgcaggacgtaccgcgtaaaccgccgcaggaggcaacgcgaggtcgcccggatcggcgccctgaaagagctattcgcggacgaaatcgaaaaagtcgaccccggattcttcgtccggctggacgagagtaaattccacatggaagaccgcagcgaaaacaacaaacaaaagtacggtctattcgcggacaaacttttctcagacgcaggctactacaaaaagtaccccaccatatttcatctgcgcaaggaactactcgaatccgaggaaccgcacgacgttcgcctcgtatacctagcattactgaacatgtttaaacaccgcgggcactttctcaacagctcgctgcaaatcgaaggtgaaaattcgaacatcgctgagagctatcagatgttcgtggacacgctcacggacgaggatctagacttcccggagcaggtaagcggcgagcgactgcaggaaatattcagatccagcgacagccgcaaaaagaaagtcgagaacctcctggccgagatgaatctgagcaagaaacagaaacgggaaatccagttcgtcaacctgatctgcggattaaaagggaagctatcggagctattcccggacaaagaatacgacgaagaacaaaagaaaatagcattcagcttccaggactcggactacgaagacaaagagaatacgatccaggaacttctagacgaatccgaaatgaatatgatctacgcagtaaaagccgtgcacgacagcggagtgctctcgggcatcatgaacggcgaacgatacctcagcgtcgcacgcgtggcctcctatgagaaacacaagaaagacctacagattctgaaagacatactgaagaaatacgacacaaaagaatacttcgaaatgtttaggaatgagtcagccaaatcggaatcatactccgcctacgtcggctcagtcaagtaccacggcacatttcgcagaggcctcagtgggggcaaacaagaggacctatacaagcacatcaaaaaggtactcggtaaattcccccaggacgacgaaggagtgacttacatactcgaggagatagagacagaaagtttcctacccaaacaactgacggcgtcaaacggcgttatacccaaccaagtacacgcccgggaaatgctcgccatcttaaagcacgccgaactctacctaccgttcctccaggagaaggacgatacaggattatccgtctccgaaaagattctaaaactattcatgttccaaataccatactacgtagggcccctcggccaagaatataaagacaagaaaggatacaacgtgtgggccgagcgcaaagcgagcgggaagatatacccctggaatttcgaggacaaaatagacgtaaagaaatcagcagagaaattcatagggaggatggtacgtcgctgcacctacctcagtggcgaacaggcactgccaaaacagagcctattgtacgaaaagttccaagtactcaacgagctgaacaacctccgcattcgcggggagaaaataccagtcagtctcaaacaagaaatataccacgatctgtttggcgacggaaagaaagtaagcatgaccaggcttacaaactacctcctacagaatggagtcatatcaggggaagaaaaagactcatgtatatccggcatagacggcgggtttcacaactccttatcgagcgtaggcaagttcaagggagtgttcggagacacggtccatacagatgagcatcgcaaaatgatcgaagatataatattctggggcacggtattcggagatgggaaaaagctcctaaaagagaaagtcgaagaagtctacggtaaccagctaacggaggcccagaaaaagcgaatattcggattcaaattcagcagctggggccgcctatccaaagccttcctcaccatggaaggcgcgtccaaggacgacggagaaataaaaggactcatccaagctatgtgggacacgaactgcaaccttatggagcttctctcagaccgcttcacatacaaggacaaactaaacgaaatggttacaacagccgaaaagcccctctgcgaatggaaaatcgaggacctggacgaaatgtacctctcggcccccgtcaagagaatggtatggcagacgatccgtgtagtagacgaggtacaacagatcatcggctgcccacccaaacgaatattcgtcgaaatgacccgcagcgatggcgagaagggaaagcgcacagtctcacgacagaaaaagctagtagatctatataaagcattaggaaaagagggaaagacctggagcgaggaactcagcgacactcccgagagccaatttcgaatcaaaaagctatatctatactaccttcaaatgggcaaatgcatgtacaccggcgaagccatagaactggagcaactcatgaatgataacctatacgacatagaccacatatacccgcgacactttatcaaagacgacaacatctcaaacaacctcgttctggttaagaaagagaaaaacgcacacaaatcggactcattcccaatagaaccggaaatccgcaacaaaatgatgccattctggaaaagcctacgcaagaaagggttccttacggaagaaaaatacaaccgcctgaccagaatgtctgcgttcaccgacgaagaaaaagcagcgttcattgggcgccagctggtagagaccagccaagggacgaaagcgatcacccagatcttcgagcaagccttcgccaacagtgaaatagtgttcagcaaagcatccgtcgtatccgccttccgacaaaaattcgactgctacaaagtcaggtgcgtaaacaattatcatcacgcccacgacgcctacttgaacatcgtagcaggcaacacctaccgggtcaaattcacatcaaacccgctgaatttcataaaagaagcaaagaaaaatcccaactcacgcgagaaccgatacaacatggacaaaattttcgaatgggacgtcacacgaaacggcgaaacggcctgggtcgcacagacaaaagaacacccaggaaccattcaattagttaagaaatacctaaacaaaaacagccccctcataaccaaaatggtctatgagaagcacggcgggataacgcagaaggccactatctggagcgccaagaaagcagaaagcggcaacacagacgcctacatacccgtcaaaatgaacgacccccgcctcgctgacgtcaccaaatacggaggcgtaacaacaatagccgtagcaggctacacactcctcgagtacaaggcgggaggcaaaacggtccgcagtcttgaagccctacccatctatctaggagggagtaagaaactcacagaggagcaaatggtggaatatttcagcaacgtcctacagcaagaaaacaaagagaaagtagtctcagacgtgataataaggaaaaagatgatcccgtctggctccctaataaagtacaacgggttctactattacctagctggaaaaacgggagaccgcatcatactaatatcagccgtccaattatgcctaccaatggacaccatgctctacatcaagaaaatcgaaaaagcctgctccaccggcaacttcgaggaaaaagacaaaaacggaaaacaagtcctcagcaaacagcagaacgaatttgtgtacgaattaatcatacaaaaataccaacagtccatattcaaaaagaaagtcggagcaatcggcgatacgataatcgagaaaagagaaaaattcgccgaaatatcactcgaagaacagtgcaaagtcctcatgcaaatatttctcaacttccaaagcggaatcggcgtagaactgaaaatcattgaaggaggcaagaaatcaggcgtaacgtacctcaacaagaaagttatgaatgtccaggagctaaaactcattgaccagagcgtcaccggcgtattcagtagagagatagacctgctaaccatatga

SEQ ID NO: 6647 - RNA, 4125 nt, synthetic construct
  misc_feature 1..4125: note = Cas9 variant
  source 1..4125: mol_type = other RNA
atgaagaaacgctactcatacagcatcggcctggacatcgggaccaacagcgtcggatgggcagtcataaacgaggactacaaagtacccgctaagaaaatgaccgtcttcggcaacaccgacagaaaaacaatcaaaaagaacctactcggcacagtccttttcgactcgggtgaaacggcgcaggcacggcgactcaaacgaacgaaccggcgccgatacacgcgccgccgctaccgactatgccagctacaaaacatattcgcaactgagatggtcaaagtcgacgataccttcttccaacggctaagtgaatcattcttttactaccaagacaaggcatttgacaaacaccccatattcggaaattcaaaggaggaacgcgcataccacaagacatatcctaccatataccatctccggaaagacttagcagaccgcgaccaaaaagccgacctacgcctcatatatctagcgctatcacacatcatcaaattccggggacactttctaatcgagggcaagctcaattcagaaaacacagacgtacagaaactcttcatagccctcgtcaccgtatacaacctcctcttcgaagaggagccaatcgccggcgaaacgtgcgatgccaaggccctgctcacagcaaaaacgtctaaaagcaagcgtctcgagtccctaatcagcgagttcccgggccagaaaaagaacggcctcttcggaaacttactcgcgctcgcccttggactgcgacccaacttcaaatcgaacttcggactctctgaagacgccaagctacaaatcacgaaggacacttacgaagaagaactcgacaatcttctggcagaaataggagaccactacgcggacctctttctcgccgccaaaaacctcagcgacgctattctgctatccgatattcttacactaagtgacgaaaacacccgcgcaccactctcggccagcatgatcaaacgctacgaggaacaccaggaggacctagcattgctgaaaaagctagtaaaagaacagatgccagaaaaatactgggaaatctttagcaacgcgaagaaaaatgggtacgcgggatacatagaaggcaaagtgagccaagaggacttctaccgctacataaaacccatactctcgcgccttaaaggcggcgacgagttcctagcaaaaatcgaccgcgacgactttttaaggaaacaacgaacttttgacaacgggagcataccccaccagatccacctaaaagaactacacgcgatacttcgccgacaagaaaaatattacccattccttgccgagcagaaagagaaaatagaacaactactctgcttccgaatcccatactacgtcggaccactcgcaaaaggcggaaactcgagcttcgcctggctaaaacgccggtccgacgaacccatcacaccctggaactttaaagacgttgtcgacgaggaagcctccgcccaagcgttcatagagggaatgacgaattacgacacctacctccccgaggaaaaagtcctgccaaaacacagccctctgtacgaaatgttcaccgtatacaacgagctcaccaaagtcaaatacatcgccgagaacatgaccaagcccctgtacttgtcagccgagcaaaaggaagccataatcgaccacctgttcaagcaaacacgcaaagtcaccgtgaaagacctgaaagaaaaatacttctcacaaattgaaggactcgaaaatgtcgacgtcacaggtgtcgagggtgccttcaatgccagcctaggcacttacaacgacctcctcaagataatcaaggacaaggccttcctcgacgacgaggcgaacgccgaaatactggaggagatagtcctaatactaacactctttcaagacgaaaaacttatagagaagcgcctcgccaaatacgcaaacctattcgaaaaatcggtcctgaagaaactgaggaagcgccattatcgtgggtggggccgcctctcgcgccaactcatcgacggcatgaaagacaaagccagcggcaaaaccatactagactttctgaaggcagacgattttgccaaccgcaacttcatacaactgatcaacgactctagcctggacttcgagaaactaatcgacgacgcacagaagaaagcgattaaacgtgaatcgctcaccgaggcagtagcaaacctggcaggcagcccagcgataaagaaaggcatactccagagcctaaaagtggtcgacgagattgtgaaagtaatgggacacaaccccgacaacatcgtgatcgagatgagtcgggagaaccaaaccaccgcacaaggactcaaaaacgccaggcagcgcctcaaaaagattaaagaagtccataagaaaacaggaagccgcatcctagaggacaacagcgaacgaatcacgaacctcaccttacaggacaaccgcttatacctatatctcttacaggacggaaaagacatgtacaccggacaagacctggatatcaacaaccttagccaatacgacatcgaccacataatcccacagagcttcataaaggataacagcattgacaacctagtcctgactacacaaaaagccaaccgcggaaagagcgacaatgtaccatcaatagaagtggtaagagatatgaaggaccgggtgtggcggcgacaactcgccaacggtgcgataagccggcaaaaattcgaccatctaaccaaagcggaacgcggcggcctagctgactccgacaaggcccggttcctcagacggcagctagtagagacccgccaaataacgaaacacgtagctcagctactcgacagccgtttcaactcgaaaagcaaccaaaacaagaagctcgcacgcaatgtgaagatcatcacgctaaaaagtaagatcgtatcagacttcagaaaagacttcgggctctacaagctaagagaagtcaacaactaccaccacgcacatgacgcgtacctaaacgcagtagtaggcaccgccctactaaagaaataccccaaattagaagcagagttcgtttacggcgactataaacacttcgacctcgtgaaactaatttccaaatcggacccatccctcggcaaagccaccgccaaagtattcttctactccaatatcatgaactttttcaaagaagaactctcactcgcggacgggaccctcatgaaacgtccggtaatagaaactaacaccgagaccggtgaggtagtctgggacaaggtaaaagacttcaaaacaataagaaaggtactctcctacccccaagtcaacatagtgaagaagactgaaatccaaagcggggcattctccaaagaatcggtactctccaagggaaattccgacaagctcatcgagcgcaaaaagggctgggacccaaagaaatatggaggatttgactcacctaacacggcatactccatcttcgtagtcgcgaaagttgccaagcgcaaggcccaaaaactgaagaccgttaaagaaatcgtcgggataaccatcatggaacaagccgagtacgaaaaagacaacatcgcgttcctcgaaaagaaaggctaccaagacattcaagagaagctcctgataaagctaccaaagtactccctgttcgaactggaaaacggccgaagacggctccttgcgtccgcaaacgagttccaaaaaggcaatgaactagcgctttcgggaaaatacatgaaatttctctacctggcctcccgctacgataagctctcgtcgaaaatagagtcggaacagcaaaagaaactattcgtggaacaacatctgcactactttgacgaaatccttgacatcgtggtaaaacacgccacgtgctacataaaggccgagaataaccttaagaaaataataagcctatacaaaaagaaggaggcgtactcgataaacgaacaggccctgaatatgctaaacctgttcatatttacctcccttggtgcccccagcacgtttgtattcttcgacgagaccatcgacagaaaaaggtacaccacatcttctgacgtcctcaatggcatcctgatccaacaaagcataaccggcctctacgaaaccagaatagacctcagtcgattcggcggcgattga

SEQ ID NO: 6648 - RNA, 4125 nt, synthetic construct
  misc_feature 1..4125: note = Cas9 variant
  source 1..4125: mol_type = other RNA
atgaagaagcagaaattctccgactactaccttggtttcgacatcggcaccaactccgtagggtggtgtgttacggacctcgactataacgtactccgattcaataaaaaggacatgtggggcagccggctgttcgacgaagctaaaaccgcggcagaacgcagagtccaaagaaacagccggcgccgactcaaacgacggaaatggaggctgaacctcctcgaggaaatcttcagcgacgagatcatgaagatcgactccaacttcttccgccgactgaaagagtcctcactctggcttgaggacaaaaactcaaaggaaaaatttaccctcttcaacgacgacaactataaggattacgatttctataaacaataccccacaatattccatctgcgagacgaattaataaagaacccagaaaagaaggacatacgactaatttatcttgcgttgcatagcatattcaagagccgcggtcacttccttttcgaagggcaaaacctgaaggagataaagaacttcgaaacgctatacaacaacctcatctccttcctcgaagacaacggcatcaacaaaagcatagacaaggacaacatagagaaactagagaagataatatgcgactcaggcaaaggcctgaaagacaaagagaaagagttcaaaggaatattcaacagtgacaaacagctagtcgcaatcttcaaactcagcgtaggcagctccgtcagcctaaatgacctcttcgacacggacgaatacaagaaagaagaggtggaaaaggagaaaatcagcttccgagagcaaatatacgaagacgataaacccatctactactcaatactaggcgagaaaattgaactcctcgacatcgccaagagcttctacgacttcatggtcctgaacaatatcctctcagactccaactacataagcgaagccaaggtcaaactgtacgaagaacataagaaagacctcaagaacctaaaatacataatccgaaagtacaacaaggaaaactacgacaaactcttcaaagataaaaacgagaataactaccccgcgtacatcggtctcaacaaagagaaagacaagaaagaggtcgtagagaaaagcaggctgaaaatcgacgatttaataaaagtcatcaaaggatacctcccaaaaccagaaagaatcgaagagaaggataaaaccatcttcaacgaaatactcaacaaaatagaactcaaaaccattttacctaaacaacggataagtgacaatggaacgttgccctaccaaatccacgaagtggaactcgagaaaatactcgaaaaccaatccaaatactacgacttcctcaactatgaggagaacggagtttccaccaaggacaagctcctcaagaccttcaagttcagaatcccctactacgtcggcccgctcaatagctatcacaaggacaaaggcggcaacagctggatagtccggaaagaagagggaaaaatcctaccatggaacttcgaacaaaaagtcgatattgagaaaagcgcggaagaatttataaaacgtatgaccaacaagtgcacgtatctcaatggagaagacgtcattcccaaggactccttcctctactcagagtacatcatcctgaacgagctcaacaaagtccaagtcaatgacgagttcttgaacgaagagaacaagagaaagataatcgacgaactgttcaaagagaacaagaaagtgtcagagaagaaattcaaagagtacctactcgtaaaccaaatagcaaaccggacagtagaactcaaaggcataaaagacagctttaattcaaattacgtatcgtacataaagttcaaagacatctttggcgaaaagctaaacctagacatctacaaagaaatctccgagaagtcgatcctatggaaatgtctctacggagacgacaagaagatattcgagaaaaagatcaagaacgagtacggagatatactcaacaaagacgaaatcaaaaagataaactcattcaaattcaacacctggggccgcctctcggagaagctcctgacgggaatcgagttcatcaacctagaaaccggcgaatgctactccagcgtaatggaagctctaagacggaccaattacaacttaatggagctcctcagctcgaaattcacccttcaggaaagcatagacaatgaaaacaaggagatgaacgaggtttcgtaccgcgacctcattgaagagagctatgtatcgccctcgcttaaacgagccatcctgcaaaccctgaaaatttacgaagaaatcaagaaaatcaccggccgtgtcccaaagaaggtcttcatcgaaatggcgcgcggaggcgacgagtctatgaaaaacaagaaaatcccagcaagacaagagcagttgaaaaagttatacgacagctgcggaaacgacatcgccaacttctccatagatatcaaggaaatgaaaaactccctctccagctacgataacaacagccttcgccagaaaaagctctacctctactatctgcaattcggcaaatgcatgtataccgggcgggaaatcgacctcgaccgcctactgcagaacaacgacacttacgacatcgaccacatctacccgcgctcaaaggtaatcaaagacgactccttcgacaacctagtactggtcctcaagaacgaaaatgcagagaaatcaaacgaataccccgttaaaaaggaaatccaggagaagatgaaatcattctggcggttcctcaaggagaaaaacttcatttccgatgaaaagtacaaacgcctcacaggaaaggacgacttcgaactccgcggattcatggcgcgccagttagtcaacgtccgccagaccaccaaggaagtcggaaaaatcctccagcaaatcgaaccggaaattaaaatcgtgtacagtaaggccgagatcgcctcgagtttccgagagatgttcgacttcatcaaagtacgcgagttaaacgacacccaccatgcaaaagacgcatacctgaacatagtcgccggaaacgtatacaatacaaagtttaccgagaaaccctacaggtacctacaagagattaaagagaattacgacgtcaagaaaatatacaactacgacataaagaacgcatgggacaaagaaaactctctagaaatcgtaaagaaaaacatggagaaaaacacagtgaacatcacccgctttataaaagaggaaaaaggtgaactcttcaacctcaacccgatcaagaaaggagagacctccaatgaaatcatctcaataaagccgaaactgtacgacggtaaagataacaagttaaacgagaaatacggctattacacctccctcaaagccgcgtatttcatttacgtcgagcacgagaagaagaacaaaaaggtcaaaacgttcgaacggataacacgcatcgacagcaccctaataaagaatgaaaagaatctcataaagtatctggtctcgcaaaagaaactacttaacccaaaaatcatcaagaaaatctacaaagaacaaacgctcataatcgactcctatccctacacattcaccggtgtagactcaaacaagaaagtagaactgaaaaacaagaaacaactatacctggaaaagaaatacgagcagatcttgaaaaatgccctaaaattcgtcgaggataaccagggagaaaccgaggagaactacaaattcatctacctcaagaaacggaacaacaacgagaaaaatgagaccatcgacgccgttaaagagagatacaacatcgagttcaacgaaatgtacgacaagttcttagaaaaacttagcagcaaagactacaaaaactatatcaataacaagctatatacgaacttcctaaacagcaaggaaaagttcaagaaactaaaactctgggagaaatcgctcatactacgtgagtttttaaagatattcaacaaaaacacgtacggaaaatacgaaatcaaagactcacaaacaaaggaaaagctattcagcttcccagaggacactgggcggatacgactggggcaatcgtctctcggcaacaacaaagagctactcgaagaaagtgtaacaggtctttttgtcaaaaagataaagctctga

SEQ ID NO: 6649 - RNA, 4128 nt, synthetic construct
  misc_feature 1..4128: note = Cas9 variant
  source 1..4128: mol_type = other RNA
atgtccaacaaaccatacagcattggactggacataggcaccaattcagtcgggtgggccgtcataaccgacgattacaaggtccccagcaagaaaatgaaagtcctcggcaataccgataagcacttcataaagaaaaatctcatcggtgccctactattcgacgaaggaacgacagcagaagaccgccgactaaaaaggacagcccgccgaagatacacgcggaggaaaaaccgcctacggtacctccaggaaatattcttcgaagaaatgagcaagctggactcgggattcttccaccgcctagacgacttcttcctgattccagaggacaaaagaggcagtaaataccccatctttgccacactcgccgaagagaaagagtaccacaaacagttcccaaccatttatcacctaagaaaacaactggccgactcgaaagaaaaggccgacctgcgactaatatatctaaccctcgcccacatgatcaagtacagaggacacttcctatacgaagagtccttcgacatcaaaaacaacgacatacagaaaatcttcaacgagttcatctccatctacgataacaccttcgaagggtcctcactctctggccagaacgcgcagatagaggccatattcacggacaagatcagcaaatccgccaagcgagaacgagtactgaaactgttcccggacgaaaagagcacgggtctcttctccgagttcctcaaactcatcgtcggcaaccaagccgacttcaagaaacacttcgagctcgaagagaaagcgccactccaattccccaaagacacgtatgacgaggatttagagaacgtcctaggccaaataggcgacgacttcgccgacctattcgtagccgccaagaaactgtatgacgccatactgctctccggaatcctaaccgtaaccgacccttcgacaaaagctcccctgtcagccagcatgatagaacgatacgaaaaccaccaaaaagaccttgcagcgctcaaacagttcatcaagaccaacctcccagaaaagtacgtggaagtcttctccgaccaaagcaaagacgggtacgcgggctatattgacggcaagaccacccaagaggccttttacaagtatatcaaaaacctactatcaaagttcgaaggaacggactacttccttgataaaatcgagcgcgaggacttccttcgcaaacaacgaaccttcgacaacggcagcataccccatcaaatccacctccaagaaatgaacgccatcctgcgccggcaaggagagcactacccgttcctaaaggagaacaaggaaaagatcgagaaaatcctcacgttccgaatcccttactacgtaggaccgctagcccgagggaaccgagactttgcctggctgacacgaaactcggaccaagcaatccgaccatggaacttcgaaaagatcgtcgacaaagcgtcaagtgccgaagacttcataaataaaatgacgaactacgacctctacctgcccgaagaaaaagtactccctaagcactcccttctatacgaaacattcgcagtgtacaatgaactaaccaaagtgaaattcatcgccgaaggtctacgcgactaccaatttctggatagtgggcagaaaaagcaaattgtaaaccaactattcaaggaaaaacgcaaggtaacgaagaaagatataatccactacttacacacggtagacggctatgacggaatagagctcaaaggcatagagaaacaattcaacgcctccctatctacataccacgacctcttaaaaataatcaaagataagaagtttatggatgacagcaagaatgaagccatacttgagaacattgtacacacgcttaccatcttcgaggaccgagaaatgatcaaacaaaggcttgcacaatacgacagtctattcgatgagaaagtgatcaaagccctcacacgacgacattacaccggctggggcaaactgtcagctaagctgataaacggcatatgcgacaaacaaacagggaacaccatactcgactacctcatcgacgacggggagataaacagaaacttcatgcagctaatcaacgacgacgggctctccttcaagaagatcattcaaaagagccaagtggtcggagaaacggacgacgtcaagcaagtagtgcgcgaattgcccggcagccccgccatcaagaaaggcatcttgcagtccataaagatagtggatgaactcgtaaaagtaatggaccacgcaccagaatcaatagtgatcgaaatggcacgcgaaaaccagaccacagcacggggcaaaaagaactcacaacaacgctacaagcggattgaagatagcctaaagaatctagcatccggcttagacagcaacattctaaaagagaaccccaccgataacatccagctgaaaaacgaccggcttttcctctactacttacaaaacggtaaagacatgtatacaggagaggcactagacattaaccaactctctagctacgacatcgaccacatcatcccgcaagcattcataaaggacgactccctagacaaccgcgtcctcaccagctccaaagacaataggggtaaatcggacaacgtcccgtccctagaggtcgttcaaaagcgcaaggctttctggcaacaactactcgactccaaactaatctcagagcgtaaattcaataacctaactaaagccgaacgagggggcctaaacgagcgcgacaaagttggcttcatcaaacgacaactcgtcgaaacacggcagatcaccaaacacgtcgcccaaatactagacgcccgctacaatacagaagtcaacgaaaaagacaagaaaaaccgtaccgtgaagatcatcacgctaaaaagcaatctcgtctcaaacttcagaaaggagttccggctatacaaggtaagagaaataaacgactaccaccacgcccacgatgcctatctcaacgctgtcgtcgcaaaagcgattctcaagaaatatccaaaacttgaacccgagttcgtatacggggagtaccagaaatatgacttaaaacgctacatatctcggtcccgaaacccaaaagaagttgaaaaggcgacggaaaagtacttcttctactccaaccttctaaacttcttcaaagaggaggtgcactacgccgacggaaccatcgtaaaacgtgaaaacattgaatactccaaagacaccggagaaattgcctggaacacagagaaagattttgccaccatcaagaaaatcctaagctacccccaagtcaacatcgtaaagaaaaccgaggagcaaaccgtcggtcaaaacggcggtcttttcgacaacaacatcgtatccaaagaaaaggtcgtcgacgcatcgaaactcatcccaatcaaatccggcctctcaccaaagaaatacggcggctacgcacgaccgacaatcgcatactcggtgctagtcacctacaaacaaaacaacaagatcaaaaacaccatggtcggaatccccgtccttacgaagctcgagttcgagagggacccaaacctatacctccgcaacctgggaatcaataacgtatcacacgttatcaagctagtgaagtatacagtactagagttcaagcacaagtacggaacttaccgacgtttcatagtctccaaccaggaactgaagagagccaaccaaatattcgttaccaccaaacaaatgaaactgatcagccaatacacgacactagataaaaatgaacatgacagtctcctcaaaaacaaccaacaactaatacaaagcatatggaaccaattcctagagttcatgctcgcgaccgatctcgttaacaagaaacaatacgacgaactcatactcacaaataaccaaacaatcgaagaatgccgcaacatcatgaacagggtgattaccaccctatcgttcaccaacataaacgctgggcaaaagaaaataatcttcgacgacaccctctcacttcccatcaaacggtggcaattcaccgacagcgacaaaatggtcaagaaaataatcgaaagcacgctcatacaccaatcaatcacgggtctctacgaaacccgcatagacctcagcaaactgggcgaagactga

SEQ ID NO: 6650 - RNA, 4128 nt, synthetic construct
  misc_feature 1..4128: note = Cas9 variant
  source 1..4128: mol_type = other RNA
atgaaagaataccacataggcctagacatcggaacgtcaagcataggatgggccgtcacagacagtcaattcaaacttatgaggatcaaaggaaaaaccgcaatcggcgtccggctatttgaagagggcaaaacagccgcagaacgtaggaccttccggacaacacggagacgactgaaacggcgaaaatggaggctgcattacttagatgaaatcttcgccccacatctccaggaggtcgacgagaactttctccgccgactcaagcaaagcaacatccaccccgaagacccagccaaaaaccaagcattcataggcaaactactcttccccgaccttctcaagaaaaacgagcggggctacccgacgctcatcaaaatgcgagacgaactacccgtggagcaacgcgcacactacccagtcactaacatctacaagctgcgagaagcgatgatcaacgaagataggcaattcgacctgagggaggtctacctggcagtacaccacatagtgaagtaccgcggtcacttcctaaacaacgcctccgtggacaagttcaaagtcggacgaatcgacttcgacaaatcattcaacgtgctaaacgaagcgtatgaggaactacaaaacggagaaggcagcttcacaatcgaaccaagcaaagttgagaaaatcggacagctcctcctggacacaaaaatgcgtaaactggacaggcaaaaagcagtggccaaactcctcgaagtcaaggtggctgataaggaggaaaccaagcggaacaagcagatagccaccgccatgagcaagctggtactgggctacaaggcggacttcgccacagtggccatggtcaatgggaacgaatggaagatcgacctcagcagcgaaacttccgaagacgaaattgagaagttcagggaggaattaagcgacgcccaaaacgatatcctgaccgagataacctcactattttcccaaatcatgctcaacgagatagtccccaacggcatgagcatctcggaatccatgatggaccgatactggacccatgaacgacaactagcggaggtgaaagagtaccttgcaacacaaccggccagcgcacggaaagagttcgaccaagtgtataacaagtatatcggtcaagctcccaaggaaaaaggatttgacctcgaaaaaggactcaagaaaatcctctcaaagaaagaaaactggaaggaaatagacgagctcctcaaagcgggagactttctgccaaaacagcgtatctcagcaaacggagtgataccccaccagatgcaccagcaagaactcgacaggataatcgaaaagcaggcgaagtactacccctggctagcaacagagaacccggcaacaggggaacgagaccgccaccaggcaaaatacgaactcgatcaactggtctccttccgaataccgtattacgtcgggcccctagttaccccagaagtacaaaaggcaaccagcggcgcaaagttcgcatgggccaagcggaaagaagacggcgaaatcacgccttggaacctatgggacaaaatagaccgggcagagagtgcagaggccttcataaagagaatgaccgttaaagacacctacctgctcaacgaggacgtactgccagcgaacagcctactctaccaaaagtacaatgtcctcaacgagcttaacaacgtccgggtaaacgggaggagactcagcgtcggaataaaacaggacatttacaccgagctattcaaaaagaaaaagacagtcaaagctagcgacgtagccagccttgtgatggccaaaacacgaggggttaacaagccgtcggtagaagggctaagcgaccccaagaaattcaacagcaacctagccacatacctagacctcaaaagcatagtgggagacaaagtagatgacaaccggtatcagatggaccttgaaaacattatcgaatggagaagcgtatttgaagacggagagatcttcgcagacaaactcacggaagttgaatggttaaccgatgaacaacgcagcgccctagtaaagaaacgctacaaaggctgggggcgactcagcaagaaactcctcacgggcatcgtcgacgaaaacggacagcgcatcatagacctcatgtggaacacggaccagaacttcatgcaaatcgtgaaccaacccgtcttcaaagagcaaattgaccaactcaaccagaaagcaatcaccaacgacgggatgacactcagagaacgagtcgagtccgtacttgacgacgcatacacgtccccgcagaataagaaagccatatggcaagttgtaagagtagtcgaagacatcgtcaaagccgtgggcaacgccccaaaatccataagcatcgaatttgcacgaaacgaaggcaacaaaggtgaaataacacgaagccggcgcacccaactgcagaaactattcgaagaccaggcacatgaattggtcaaagacaccagcctcaccgaggaactagagaaggtccccgacctgtcagaccgctactacttctacttcacacaaggcggtaaagacatgtacacaggagaccctatcaacttcgacgaaatctccaccaaatacgacatcgaccacatactaccacaatcattcgtaaaggacgactccctcgacaaccgcgttctcacctcccgtaaggaaaacaacaagaaaagcgatcaggtacccgcaaaactctatgcagccaagatgaaaccctactggaaccaactcctcaaacaaggcttaatcacgcaaaggaagtttgaaaacttaacgatggacgtcgaccaaacgatcaagtacagatcccttggcttcgtaaaacgacaactggttgaaacccgccaagtgataaagctcactgccaacatcctgggatccatgtatcaagaagcgggtacggacataatcgaaacacgagcagggctcacaaagcaactccgcgaagagttcgaccttccgaaggtgcgcgaggtcaacgactatcaccacgccgtagacgcatatctaaccaccttcgcaggccaatacctcaaccgccggtaccccaaactacgcagctttttcgtctacggcgaatacatgaagtttaaacacgggtccgacctcaagttacgaaacttcaacttcttccacgaactcatggaaggcgacaaaagccagggcaaggtcgtcgaccaacaaactggtgaactaataactacccgagacgaagtcgcagactacttcgattgggtccaagacctaaaattgatgctggtcacaaaggaactaaaacgctccaatggcaaactcttcgacgctaccatacagaacgcgaactacacgaaactaaacgaaaggaaaaaggtctttgtgcccctcaagaaagagctagacaaaaccctttacggatcctacagcggcatacaaagcagctatatgaccatcgtcaaaaagttcgacaagaaaggaagcacatacgccgttcagcgaatacccgtcatgtacagcaaactactggaactggagaaagaacaaagtaaacttaaccgtctagtccaatctattgtaacatcagacccccaagcacccaacaatttcgaagtacttatgccatgcgtcctgagcgggcagctagtaatcgataacggccgaaaattcaccctaacatcataccgctaccaatgctcaactgcccaactcttcctccccaagaaagatctaaaatacatccaaaacaacttcaaagagctcaagaaaacaccagacaagcaggacaaaatattcgaaaccatatatgacgatatactcaagcaggtagacaagtacttcagcctctacgacatcaacaaattccgcagcaagctacacgacggaaaagacaaattcctcgccctggaaaatttcggggaaaaggagtccaaggacaaagtaataaccaaaatcctgagaggactacacgccaacgcggaacgaacaagtctcaaagagatcggcctaagcacaccgctagggcagttccaatcgggggaagggggtattacactatccgacaacaccaaaataatctaccagtcaccgactggcctcttcgagcgacacgtgtaccttaaggacctatga

SEQ ID NO: 6651 - RNA, 4128 nt, synthetic construct
  misc_feature 1..4128: note = Cas9 variant
  source 1..4128: mol_type = other RNA
atgcgcaaaaaccaagaaccatacaacataggcctggatataggaacgagcagcataggctggagcattatgaatgataacttcgacctgatgcgagtcaaagggaagaaaggaataggagttcgcctctacaacgaagggcaaagcgcagccgaacgccggatgcaccggacagcacgacgccgatacggcaggcgcaagtggcgtctccgcctactggaggacttcttcgacgagcacatggcagaagtcgacgacacgttcttcgcgcgactcaaagacagcaatatcagtcccaaagacgacaaaaagtaccgcaagagcctcctttttcccaaatccaaaggcgtaacctatcaagacgacggggagttctacaagaaatatccgacgatgtaccacctacgctacgcactaatgacggagcaccgcaaattcgacctcagagaaatttacctggcattccaccacatggtaaagtacagaggaaacttcctctatgacaccagcgtagactcatttgaggccaaaaatctagacattaaggggaaattcgacgagattaatgacctcctgagttcgtacaccgacttctacgtggacaacagcaatgccgcgctggtcgaaagcatactcctagagaaaaacacaacacgaaaagataaatccaaaaagatcgcaaaactactacacgtggaggacaaagaaaaagggaaaaataagaaggcgaaagacctcgcaacgcaaatctctaacgccgtactcggcctaaaatgcaacttccacctaatcttcgaactacaacaaaagtactcgttcgacttatgttcggaaaagaccgaggagaacatcgcgaagctaagcgaagtcctggacgaaaaccaaaagatgttgcttatgatattgaaagaggtccaagaccaggtaatgctcaacgctttcgtccccagtggtatgtccctgtcagaagccatgatgcaaaaatacgacgactacggagaacaactaaaaatctaccacgagctagaacacagcgtgtccgacgactcagcagcaaaactgcgaggcgcctaccgggactacaacgacaacataattaagaggatcgacggagacaataaaaaggacaccttctacaagcgcgtgaagaatatcctaacaaagatctccaaagaatacgtagaccaggacgtactcgaatcctgcggcaagctcaagaagctcatagacgaaaacaaattattcatacgacagcgcacagcagccaacggagtactcccccaccagctgcaccaaatagagatgcgcaaaatcatcgacaatcagaaagaatattacccatggctagcggagccgaacccgaacgaaaagcgccgcgtctacagcaaatacaaagttgaggagctcatagccttccgcatcccctactacgtcggacccctagtagacccaaacaatgccgacaagaacaaagaggcccgcttcagttggatggtgcggaagaaagatggagagataacgccgtggaacttctacgataaagttgactgggccgaatcggcaaacaacttcatagaacgcatgaaatcaaaagacacatacctactgggggaagacgtcgtcccgaaagaaagtatgctataccaaaaatatgaagtcctaaacgaactcaacaatctccggatcaacgacagtggcctaagcgactccttcgaagacgtcaaactcaaacaggcaatctacaacgacctattcaagaaacagaaaatagtaaaaataaccgacttacaaaactacctagtgcaaaaccacaaatacttagtcaaaccaaagatcagcggcctcgccgacgagaaccgcttcctctcttcactctccacctattcggacctcaagacaatattcggagacaaagtcgacgaccggacctacttcaacgactttgagaaaatggtggagtactcaaccgtgttcgaggacggccacgactacaaccagaagctagacgaatacacatggctgacaaaggaagaaaaatacaaaataggaaagaagaggtaccgcgggtggggcaagctatccaagaagttgttgaccggtctaagagacaaaaacaaccacaccatcatggacaacctatgggaaaccaacaggaacttcatgcaaatccaaaccgccgacgagttctcgaagcagattgccgaggaaaacgagagacacctaaaaggctcggtatccgacgccatcaacgatatgtatacaagcccagccaataagaaagccatacgacaagtactacgcgtcgtcgatgacatacaaaaagcaatgggatacgccccgtcgagcatcagccttgagtttgcgcgagaagacggtcccagtgtacgcaccgtcagccgggccaaccgcatgaaaagcatatacgagaagtatgcatcggaagtatcagaagaggttatgaaagatctagacggagtgatcaaagacaaaaagggtctcaatgaccggctctacctctatttcgaacaacaagggaaagacatgtactccgggcatccgctagacttcgacaaggtcatatcgggacaggagtacgatatagaccacatactgccccaagccgtgatcaaagacgacagtcttgacaatcgagtcctcaccaccaaagccctcaacaatgacgtcaaaagtaaaggagtcccatgccggatgttcaacggaatgcactccttctggaagaacctgtacgacaagggcttcatcagccgtcgcaaatttaacaatctcactacaaaccccgaaaatatagacaagtataaaatgaagggcttcgtcaaccgacaactcgtcgaaacacgtcagatcataaaactcgtcgcaaacgtcctaaacgacaaataccagaatgacgacgtagacataattgaagtgcgtgccgaactgacgcacgacgtccgtaaacacttcaaattctacaagaacagaaacgtcaacgactaccaccacgcgttcgacgcctaccttacatccttcatcggccactacctattcaagaaataccccaacttgcgccccttattcgactacaatgacttcatgaaagtgagcgacaacgtattcaaacagctccgcgggaacaacttcctgggggagttcctaaacaaaaccggcgacatcataagcaccgacgggaacttcgtccttaataaagaagagatgatcaacaaactcaacaaagcctacgcattcaagaaaatcctggtaaccaaagaggtcggacaaaggacaggagccatgtttaatgaaacgagataccccgcccccaacagcaggaaggccgccctgaaataccgtcgaatgccgaaaccggactcgctaatcagtgtcaaagactacaagaacacagacatctacggaggctactcaggcaaaaatgacgcatacatggtaatcgtggacatgggaaaacagtacatggtcgtaggcgtgcccgtgcgctacaccgaaaagttggacaaattacgcataaaacactcagaactctacagagacgaactacgaaaagtactttcacgtgacaaaacgctcctggacagcaagggcaacgtcaaaagattcgacattgtactggaccgcgttctctacggccaattgatagaagacggcaacgaactcttcacactcgggagctcaaagtacaaacgaaacttccgacaacttttcctagacaagcaatgcatcgaaatcctggactcaagcgccacaccccagcctaccgacgaagaacttatatgggtatatgaccaaatccttgacaaagtcgacaagtacttcgaactatacgacatcaaccgacaaagggaaacactacgtaagggtagagctgccttctgctccctccccaacatcagcatgaaaaaggacgatgtgacgaagaaaaagatcctcaacgagatcctggtagccctccatgcgaacgagtccgagtcaaactgcgaaaagatcggaaagaaggtcttcgggcgcctccaggtcccaggcggcataaagctaagcaaggaagcgaaactcatataccaaagtcccaccggcctattcgagcgagttgtgtatctaaaagacctctga

SEQ ID NO: 6652 - RNA, 4128 nt, synthetic construct
  misc_feature 1..4128: note = Cas9 variant
  source 1..4128: mol_type = other RNA
atggaaaacaaaaagtactccatcgggctggatatagggacaagctccataggcttcgcagtagtggacgaaaacaaccgcgttatgcgagtcaagggcaaaaacgccataggcgtaagactcttctcagagggacagccggccgcagacaggaggagcttccgaaccacccgccggaggttaagccgaaggcgatggcgactccgactgctccgggagatcttcgagccatacatcaaccccgtagacgaagcattcttcatgcgcctcaaagagtcgaacctctccccgaaagacgcaaacaaacattacagcggcgacatcctgtttaacaaccaaacagaccaagacttttacgagaagtaccccacaatataccaccttcgacacgcactaatgaccgaacacagaaaattcgacgtccgtgaaatctacttggctatacatcacatcgtaaagttccgcggtcactttctaaacgcggccagcgccagcaacttcaccgtgggaaaactaaatctggaaggaaaattcgacgcgctgaacgaaatataccaacgcgtactcactgatgaccccttcgcgcttcgcaccgacaatttagaccacataaaagaaattctcattgacaataagcgctcgcaggcagacaggcaacgaaccctcaccggggacgtgtaccaaagctctgaagagaaagaaatagaaaaacggaacaaagcaattgccacggaaatactcaaagcggcagtgggaaacaaggccaagctcaacgtcataactaatgtagaagtcgacaaagaagctgcaaaggactggagcttgaccttcgactcagagaccatcgacgatgaactcgcaaaagtcgatgggcaaatgacggacgacggcagagaaatcatcgaaatcctacggtcgctctacagcggcatcacgcttgccgcaatagtcccagaaaaccacacactctctcaatccatggtggaaaaatacaacagccacaaagcgcacctaaagctcctaaaagacctgataaacaacatgacagacacaaagaaggccaagaacctccgtgctgcatacgacggatacatcgacggtgtaaaaggcaaagtgctaacccgagacgacttctacaagcaaatccagggaaacctcgacgactccgcagaggcccagaaaatccaagacgtaatggaccaagacgagttcatgccgaaacaacgcactaaagcgaacggcagcatcccgcaccaattacagcagcaagaactagaccaaatcgttgaaaatcaaaaggaatactacccttggctcgccgaagaaaaccctaacgagaccagacgcggcgtcgccaaatacaaactagacgagcttgtcacattcagagtaccatattatgtagggcccatgataacagccgaagaccaagaaaaacaatcgggtgcctccttcgcctggatgaagcgcaaagagccgggaaacatcaccccatggaacttcgaccagaaagtcgaccgaatggcctccgcaaaccagttcatcaaaagaatgacgacaaccgacacctacctgctcggcgaagacgtactaccagctcaatccctgctctaccagcgatttgaagtcctgaacgaactcaataagatccgtatagacagaaaaccaatctccatagaactaaaacagcagatcttcaatgacttattcaagaaattcaaaaacgtcaccataaagcacctccaagaatatctcgtagccactggaggatacgacaagcggccaagaatcgacggcctcgccgacgagaaacgcttcaactcaggcctaagtgcctaccatgacctgcacgggatactgggagccgaagtcgtggacgcgaatgacaagcaggacgacctggagaaaatcatcgaatggagcacgatcttcgaagacaagaaaatatacagagccaaactagacgagctaacgtggctaactgacagtcagaaggaaaaactcgccaccaagagataccaaggatggggacggctatctaagaaactcctgtccggcttgcgcaattccgaccaccgatcaattctcgacatcctctggatcacaaacgaaaactttatgcaaatccaagccgatcccgacttcgccgagctagttaaaaacgcgaaccaaggcatgctcggcaaaaacaactcccaagacgtaataaacgacttatacaccagcccgcaaaacaagaaagccatccgacaaatactgctcgttgtacacgacatccaaaacgcaatgcacggacaagcccccgccaaaatccacgtagagttcgcccggggtgaagaacgaaacccccgtcgctcgattcagcgacagcaccagatagaagcagcatacgataaagtaacctccgacctcctagtcgacgccggcgtccgacaggaactaaaagacgcaataaatgacaaacgagacttcaaagacagactgtttctttacttcatgcaaggcggtcgggatatttacaacggagaaccaataaacatcgacagacttagctcatacgatatcgaccacatcctgccgcaagccttcgtaaaagacgactccctcaacaaccgcgtcctgacagacgcagaaggcaaccgacgcaagtcagacgcagtaccctccgaactgttcggtgcaaaaatgcgctctacatgggaactcatgcgtgagcaaggcctaattagcaaagctaaataccgcaacctcacaatgaaccccgaaaacataaacgctcacaccgaaaacggcttcatcaaccgtcaacttgtcgagacacgccaagtcatcaaactagccgtcaacatactggccgatgagtacacagaagacacccaaatcgtcagcgtcaaggcagacctctcacaccagatgcgagaagacttcgagctactcaagaaccgagacgtcaacgactatcaccacgccttcgacgcctatctcgccgcctttatcggcaattatctcctagaacgttacccaaaacttcaatcctacttcgtatacggcgacttcaaaaagttcagtcaaaaggacacaaagatgaggcggttcaacttcatctatgatctcaaacactccgatcaaatcgccgacaaaaacggcaagaaaatctggcacaaaacaaatgacctcgactacatacgccatttattcgcatacaagaaaatcctgatcagccacgaggtctccgaacgccgcggagccctctacaaccaaaccgtatataaagccagcgacgataaagcctcaggtcaaggctcgaagaaactcatccccataaaagccaacaaacccacagaaatctacggaggatacaccgggaaaacgctggcatacatggctatcgtcaaagtcatcaaaggcaagaaaatcgcctacaaagtcgttggagtgcccacctctgcactcgtccagctagctggaatagaacatggaagccaagaggagcttaaccgcctctacgacgtcttaaaaccccaattcactcagcttaagaaaaataacaaaacgggagaaatcagcgagactgtatcgaaattcgagatagttatcccgcgcgtcaagtaccagcagctagtagaagacgacgacaagctctttatgatagggagcgacacgtatccctacaacgctcaacagctagttctttccgaaggagccctcaaagtcataaacaacgtctaccgaaaaggcgaaaattccgataaacaggaatcatacaaactagatgacgtctacgacgagataatcatagccatgaagaaatacttccccctatacgacaaccgaggcttccgggaaaaagtagccgaaggcaagagcaccttcgaaaatctccccatcagcaatgaatttaaaaatggaaaactaacgaagattggcaagaaagaggtaatcaaccggatgctccaaggcctacacgcgaatgcgacaatgacagatctcaaaatcctagggataaaaagccccttcgggttcatgcaacagcccaccggaatcgccctgtccgagaatgcacaactaatatatcaatcaccgacagacctattcgagcgcagagtccaactcaacaagattaaatga

SEQ ID NO: 6653 - RNA, 4128 nt, synthetic construct
  misc_feature 1..4128: note = Cas9 variant
  source 1..4128: mol_type = other RNA
atgaagaagatactaggactagacctaggcaccacctccatcggctgggccctagtctacgagtctgaaaacacggacgagaaaagctctatagttcggctcggggtccgagtgaaccccctgtcagtcgacgaaaaaggcaacttcgaaaaagggaaagctataacaacgaatgccgaccgccaacaaacacacggggcccgtatcaacctccaacgatacaagctccgccgagaaaatttgaaagactgtcttcaaaagcaaggctggatcggaaccgaggccctgtgcgaggaaggaaagaccagcaccttcgagacctacatgctccgcgctaaagccgccgaagaggagatctcgctccacgagctttgccgggtcctattcatgatgaacaaaaagagaggttacaaatccaacagaaaagcaaataacaaagaagacgggaagctgtttgacggcatgacagtcgcgaagaaactctatgaagaacacctaaccccggctgagtacagcttccaactactaagttcaggcaagaaattcaagcaggaatattacagatcagacctcaaagaagagttcgaccgaatctggaacgaacaacaaaagtactaccctgagatactcacagacgactttaaacagcagctgcaaggaaaatcgaaagggaatacatcaaagatcttcctgggaaagtacggtatctactctgccgacctgaaaggcctcgaccggaaactccaacctcttaagtggcgagtagaggctctcaagcaacaagtcgacaaagaagtactagcgttcgttatcagtgatctcaacggacagatcgccagcacctcaggactgctaggagccatctcagaccgttcaaaggagctgtacttcaacaaacagaccgtgggacaatacctatggaccagcctcaaagaaactccccacgtatcaatcaaaaacaagccattctaccggcaagactacctagacgagttcgagaaaatatgggaaacccaggcaacataccacaaggaactcacccccgaactaaagcaagaaataagggacattatcatcttctaccaacgccccctaaagagcaagaaaggactcataagcgtctgcgaactggaacaacgaaaggtaaaagtcaccatagacgggaaggaaaaagaaatctccatcggccccaaagtcgcacccaaatccagtcccatgtttcaagagttccgaatctggcaaaacctaaacaacatcctactaatcgacaagggaaacaactccatacaccccttatacgaagaagaaaagaacctactctatgaagaactatccgtaaaagaaaaactgagtaaagctgaagccctcaaagttctgaacaaaaattccaagcaatgggacctcaactataaagaaatcgaaggaaaccggacccaagcagtactctacgactgctacaatcgcatcatagtcatgaccgggcacgaagaatacaacttcaaaaagctaaaggcatcggaaatacggtcctacgttaagaccacgtttaccggactcgggttcaacacagacattctggagttcgacagctccctaacgggccacgaactggaaaagcaaccaatgtaccaactgtggcacttgctatactcgtacgaatcagacaacagtagaaccggcaacgacgcacttctacgtaaattagaaaccgcattcgggttcccaaaagaatacgcagcagtcctctccgatgtagtgttcgaagacagctatggcaacctcagcgttaaggccatgagaaaaatcctcccacaccttcaagccggtctgaactactcgcaggcatgcgaagaagcgggctacaaacacagccggcgcagccttaccaaaaacgaactcgatcaaaaggagtacaaagaaaaactcgagctcctcccgaaaaactcgctacataacccagtagtcgagaaaatactcaatcaaatgatcaatgttataaacgcggttatcgacgaatatggaaagcctgacgaaatccgcatcgaactcgcacgagagctaaaaattggcgccgccgaacgggaaaacatgacacggtccataaatcagggcaatgccgaaaataagcgaatacgagaaatcctcgagaaggagttcgccttatcatacatctcgcgcaacgatattatcaaatacaaactgtacgaagaactcaaatccaacggattcaaaacactatactccgatacatacatctccaaagacaaactcttctccaaagacttcgacatagaacacatcatcccaaaggcacgactgttcgacgattcgctgtccaacaaaactatcgaggcacgagacgtcaacatagcaaaaagcaataaaacagcattcgacttcatctccgaaaaatacgaccaacaaggcatcgaggcctataagaaaaagctcgacatcctcctacaggacggatcaatatctaaagcgaaatacaatcgccttctcatgaaagaagcagacatcccgtccggcttcatcgaccgcgatctacgcgatacccagtacattgcaaagaaagcctacgagatactttccgatctggtccgtaacgtgactccgaccaccggcgccgtgaccagcaggcttagagaagactggcaactcgtagacgtcatgaaagagctcaatttcgaaaaataccagaagctcggtctcgtggaagtcatcgaggaccgcgacggccgcaaaatcaagaggataaaggactggactaagcgcaatgatcatagacaccacgcaatggacgcgctgaccatcgcgttcaccaagccgagctacatccaatacctaaacaacctgaatgcgcgttcagataaaaactcatccatatatggcatcgaaaacaaggagctgcaccgggaagacaacaaactccggtttaacgcgcccctacccataaacgagttcagggccgaagccagacgccacctcaaaagcatactggtatccgtaaaggccaagaacaaagtcatgacgcagaacgtaaacgtcataaaaactaaacacggagtcatcaagaaggtgcaactcacgccacgaggtgagctacacaacgcaaccttctacggaaccaagaaacgtcccattataaaaatggtgaaagtgggggcagccctagacgaagtaacaataaagaaagtttccagctcgtttatacgggaggcgctactagaccgcctacacgaatacaatggggacgccaagaaagcattcacaggccgcaacagcatcgacaaaaacccaatatacatcgacgaggaacacaagaaaacagtcccggccctcgtcaaaaccatagagtgggagatgtaccaccctacccggaaacttataagccccgacctaaaaatcgacaaggtcattgacaaaggcattagagaaatactcaaaacccgactcgccaagttcaacggggacgcccaaaaagcattctccaacctcgacgagaacccaatatataaagatgaagccaagaaaataaccctcaaacgcgtgtcgctcgaaggcgtgtcgtccgtcatacccctccacacgctaaaggaccgcgaaggcaagctagtcgtcggcaaagacggcaaaccggtgctgggtgactacgtgcaaacaagcaacaaccaccatatcgccttctacatggacgagaacggaaacctgcaagacaacgtcgtgtcattcttcgaggcggccgagcgcaaaagccaaggagtaccagtcatagacaaaaattacaaccacgacaaaggatggaacttcctcttcacaatgaagcagaatgagtacttcgtatttccgaatgaggtgacaggattcaacccgagcgaagtcgacctaatggacgaagcaaattactcaatcatatccccaaacctgtaccgcgtacagaaaatgtccaaagccagcggacgagactactggttccgacaccacctagaagcaatgctaaacgacgacccaaagctgcgaaactcaatgttcaagcgcatcaccagtcttaaggctctggaaggtatagtgaaagtacgaatcaattgcatcggcaaaatagtagcagtgggggagtacgactga

SEQ ID NO: 6654 - RNA, 4128 nt, synthetic construct
  misc_feature 1..4128: note = Cas9 variant
  source 1..4128: mol_type = other RNA
atgtccaacaagagctatagtatagggctagacatcggcactaactccgtcggttgggccgtgattacagacgactacaaggtcccatcgaagaagatgaaagtgcttgggaataccgacaagcactttataaagaaaaacctaatcggggcccttcttttcgacgaaggaaccaccgccgaagaccgccgattaaagagaacggcgcgcaggcgatatacacgccggaagaaccgactacgctacctgcaagaaatattctcccaagaaatttcaaaagtagacagctcattctttcaccgactagacgatttcttccttgtcccagaagacaaaagaggcagcaagtacccgatattcgcaacactcgtcgaagaaaaagaataccataaaaaattccccaccatctaccacctcagaaagcacctcgccgatagtaaggagaagaccgacctgcgactcatatacctagcacttgcgcacatgatcaaatacaggggccacttcctatacgaagaaagcttcgacatcaagaataacgacatccaaaaaatattttcagaattcatcagcatatacgacaacaccttcgaagggaaaagcctctcaggacagaacgcgcaagttgaagccatcttcaccgacaaaattagcaaaagcacgaaacgagaaagagtacttaaactcttcccagatgagaaatcaaccggcttattcagcgagttcctcaaactcatagtcggaaatcaggcagatttcaaaaaacactttgacctcgaggaaaaagccccccttcaattctcgaaagatacctatgacgaggatctggaaaacctactcgggcagataggggatgatttcgctgacctcttcttagtagcgaaaaaactctatgacgcaattctactcagtggtatactcaccgtcaaagacctgtcaaccaaggctcccctctccgcatcaatgatcgagcgctacgaaaaccaccaaaaggacctagcggccctcaaacaattcatccaaaacaacctccaagagaaatacgacgaggtatttagcgatcaatcgaaagacggctatgccggctacattgacggcaagaccacgcaagaggcattctacaagtacataaaaaacttgctctcgaagttcgagggcgccgactacttcctagacaaaattgaaagagaggactttctaaaaaaacaaaggacattcgacaacggctccatccctcaccagatacacctacaagaaatgaacgcaataatccggagacaaggtgaacactacccgttccttcaagagaacaaagagaagatcgaaaagatcctcacattccgcatcccctactacgtagggccactagcaagaggaaatggcgacttcgcctggctcacacgcaactcagaccaagccatacggccctggaacttcgaagaaatcgtagaccaagcctcatccgccgaagacttcatcaataaaatgaccaactacgacctctacctaccagaggaaaaagtcctaccaaaacattcccttctatacgaaactttcgccgtatacaacgaactaacaaaagtcaaattcatagccgaggggctcactcgttaccaatttctggataaaaagcagaaaaaagacatatttgacaccttcttcaaggcggaaaacaaaaggaaagtgacggagaaagacatcatccactatctccacaacgtcgacggctacgatggaatagaactcaaggggatcgaaaaacagttcaatgcatcactctcaacataccatgaccttcttaagatcataaaagacaaggcgttcatggacgactccaagaacgaggaaatcctcgaaaacataatccacaccttaaccatctttgaagaccgagaaatgatcaagcaacgtctagcccaatacgattctctgttcgacgagaaagtcataaaagcgctaacccgccgtcactacaccggctggggaaagctgtcagcaaagctaattaacgggattcgcgacaaaaaatcggggaaaacaatcctcgactacctcatagacgacggcgagatcaaccgcaatttcatgcaactcatccatgacgacggactgtccttcaaggaaataatacagaaggctcaagtattcggaaaaaccaatgacgtaaaacaagtcgtccaggagttacccggctcccccgcaatcaagaaaggcatcctacaatcaataaagatagtcgacgagctcgtcaaggtcatgggacacgccccagagagcattgtcatcgaaatggcccgcgaaaaccaaaccacggccagaggaaaaaagaactcacaacaacgctacaaacgcatcgaagactcactcaagaacctggccagtgggctagacagcaacatactcaaagaaaacccgacagacaacattcagctccagaacgaccgcctcttcctgtactacctgcagaacggacgcgacatgtacaccggcaagcccctcgaaatcaaccaactctcgaactacgacatcgaccacataataccacaagcatttataaaagacgactcacttgacaaccgtgtcctaaccagctccaaagacaacaggggcaagagcgacaacgtcccgtcgctagaggtagtcgaaaaaatgaaagcattctggcaacagctcttagactccaagctaatttccgaacgcaagttcaacaacctaacgaaagcagaacgcgagcgaggcggcctaaacgaactcgacaaggtcgggttcatcaaacgccaactagtagaaacacgacaaatcaccaaacacgtcgcacaattcctagacgcacgattcaacaaagaagtaaccgaaaaagacaaaaaaaaccgcaatgtcaagataataaccctcaagtctaacctagtctccaacttccgcaaagagttcggcctatacaaagtccgcgagatcaacgactaccaccacgctcacgacgcataccttaatgccgttttagccaaggcgatcctcaaaaaatacccaaagctcgagcccgagttcgtatacggcgactatcagaaatacgaccttcaacgctacatatccaaatctcgcgagcctaaagaagtagaaaaagcgacacaaaagtacttcttctactcaaacctcctcaactttttcaaggaagaggttcactacgccgacgggaccatagtcaagcgagagaatattgaatacagtaaggacacgggcgaaatcgcgtggaacaaggagaaggatttcgcgactgtcaaaaaagtcctttccctaccccaagtcaacatcgtgaagaaaaccgaagtccagacaggcggcttcagcaaagaaagcattttaccgaaggggaactcggacaagctgatcccccgaaagacaaaggagatcctatgggacacgacaaaatacggcggcttcgattcccccgtaattgcatattccatactactcatcgctgacatcgaaaagggcaaagccaaaaaactaaaaactgtcaaaactctcgtcggcataacaataatggaaaaagcgacgtttgaaaagaaccctatcacattcctcgagaacaaggggtatcataacgtgcgaaaggaaaacatactctgccttcccaaatactcactattcgaactcgagtccggaaggcgccgcatgcttgcctccgccaaagagctacagaaaggaaacgaaattgtcctcccagtatacctaaccacactactttaccacagcaaaaacgttcacaaactggacgagcccgagcacctggaatacatacaaaaacaccgctacgaattcaaggacctgctcaacctcgtaagcgaattcagccaaaagtacgtgctggccgacgcaaacctagaaaaaatcaagaacctatacgccgataatgaacaagccgacatagaaatactagccaacagcttcataaacctgctgacgttcacggcattaggagcccccgctgcattcaaatttcttggcaaggacgtagacagaaaacgctacaccacggtctcagagatcctcaacgccacactcatccaccagtcgataacaggtctgtatgagactcgcatcgacctcagcaaattaggcgaagactga

SEQ ID NO: 6655 - RNA, 4128 nt, synthetic construct
  misc_feature 1..4128: note = Cas9 variant
  source 1..4128: mol_type = other RNA
atggaaaagaaatactccatcggacttgatataggtaccaattcggtaggctgggcagttataacagatgactacaaggtcccaagcaaaaagtttaaggtactaggcaacaccaaccgcaaatccattaagaaaaacctaatgggagcactactattcgacagtggcgaaacggcagaagccacccgcctcaaacgcaccgcaagacgcagatacaccagacgcaaaaaccggatacgctacctacaggaaatcttcgccaacgaaatggccaaactcgacgactcgttcttccagaggctggaagagagcttcctagtcgaggaagacaagaaaaacgaacgccatccgatcttcggaaacctagccgacgaggtagcatatcacaggaactaccccaccatctaccatctgcgcaagaaactcgcggactcacccgaaaaagccgatctcagactaatctacctagccttagcccacattatcaaattccgcggtcacttcctaatagaggggaaactaaacgcggagaactcagacgtcgcaaaactcttctatcaactaatacaaacatacaatcaactgttcgaggagtcgccccttgacgaaatagaagtagacgccaagggaatcctatcagcgagactttcaaagtccaaaagacttgaaaaactaatagcagtcttccccaacgagaaaaagaacggcctcttcggaaacataatagccctcgccctaggactcacccccaacttcaaatccaacttcgatctaaccgaagacgccaagctacaactaagcaaagacacctacgacgacgatctcgacgaactactaggtcaaatcggcgaccaatacgccgacctcttcagcgctgccaaaaatttatccgacgcgatactcctgtcggacatcctacgcagcaactcggaagtcacgaaagcgccgctatccgcgtccatggtaaagcgctacgacgaacaccaccaggacctcgcgctactgaaaaccttggtccgacaacaatttccagaaaagtatgccgaaatcttcaaggatgacactaaaaacggctacgccggctacgtcggcatcggcatcaaacaccgaaaacggaccacgaaactagccactcaagaagagttctacaaatttatcaagccaatactcgaaaagatggacggcgcagaagaattactagcaaaactcaaccgagacgacctacttcgaaaacaacgcacattcgacaacggctcaataccacaccagatacacctcaaagaactacacgcaatcctccggcgccaagaggagttctatccgtttctcaaagaaaaccgcgagaaaatcgagaaaatactgacattccgaataccatactacgtgggacccctggccaggggcaacagccggttcgcctggctcacgcgaaaatcagaagaagcaataaccccatggaactttgaagaagtcgtggacaagggcgccagtgcgcagagcttcatagagagaatgacgaacttcgacgaacaactaccgaacaagaaagtactgccaaagcactccctcctatacgaatacttcaccgtctacaacgaactcacgaaagtcaagtatgtaactgaacgaatgagaaaacccgagttcctgtcaggagaacagaaaaaggcaattgtcgacctcctcttcaagaccaaccgcaaggtgacagttaaacaactcaaggaagactactttaagaaaatcgagtgcttcgacagcgtagaaatcattggggtcgaagacaggttcaacgcctcactaggtacataccacgacctgcttaaaataatcaaagacaaagacttcctagacaacgaagagaacgaggacatcctcgaagacatcgtactcactctgaccctcttcgaagaccgcgaaatgatagaagaacgcctcaaaacctacgcacaccttttcgacgacaaagtcatgaagcaactgaaacgccgacactacaccgggtggggacgactatccagaaaaatgataaacggcatcagggacaagcaatcaggaaagacgatcctagatttcctgaaatcggacggattcagcaaccgcaactttatgcaactgatacacgacgactcccttacgttcaaggaagagatcgagaaggctcaagttagcggccaaggagacagcctacacgagcaaatcgccgaccttgcaggctcccccgcgatcaaaaagggaatcctacagaccgtcaaaatcgtcgacgagctcgtcaaagtgatgggccacaaaccagaaaacatcgtcatagaaatggcgagagaaaaccagaccaccacgaaaggcctccaacaatcgagagaacgcaagaaacgtatagaagaaggaatcaaagagctggaatcacaaatccttaaggagaaccccgtcgaaaatactcaactacaaaacgagaaactctacctatactacctgcagaacggccgcgacatgtacgtagaccaggaactcgacattaaccgacttagcgactacgatgtcgaccacatagtcccgcagtcgttcataaaagacgactcgatcgacaacaaagtcctaacccgaagcgtagaaaaccgaggcaaaagcgacaacgtaccgagcgaagaagttgtaaagaaaatgaaaaactactggcgccagctacttaatgcaaaactgataacacaacgaaaattcgacaacctcaccaaagcggaaagaggaggactaagcgaggcggacaaggcaggcttcatcaaacgacagctggtggaaacccgacaaatcacaaagcacgtagcacgcatcctcgactcccgcatgaataccaaacgcgacaagaacgacaagcctatacgcgaggtcaaagtaatcacactcaagtccaagctcgtatccgacttccgcaaggacttccaactttacaaggtgagggacatcaataactaccaccacgcgcacgacgcttatctgaatgccgtggtcggcacggcactgatcaagaaatatccaaaactcgagtcagagttcgtctacggcgactacaaagtatacgacgtacgaaaaatgattgccaaatccgaacaggaaataggaaaagcgacagccaagaggttcttctactccaacatcatgaacttcttcaaaaccgaagtgaaactcgccaatggagaaatccgcaaaagacccctcatcgagaccaatggcgaaacaggagaggtcgtctggaataaggaaaaggacttcgccaccgtccgaaaagttctagccatgccccaggtcaacatagtaaagaaaaccgaagtacaaacagggggcttcagcaaagaatctatcctaagcaaacgggaatctgccaaactgatcccacgtaaaaagggatgggacacacgaaagtacggcggcttcggatctcccaccgtcgcttactccatcctggtcgtggcgaaagtagaaaaaggaaaggccaagaagctaaaaagcgtcaaagtcctcgtcggaatcacaataatggagaaaggcagctacgaaaaggaccccatcgggttccttgaggccaaaggatacaaagacatcaaaaaggagctgatattcaaactgccgaagtacagcctcttcgagttagaaaacggccgcaggcgcatgctagcctccgccacagagctacaaaaggccaacgaactcgtcctaccacaacacctcgtgcgcctcctctattatacacagaacatatctgccaccacaggatccaataaccttggctacatcgaacaacatagggaggagttcaaggaaatatttgaaaagatcatcgacttctcggaaaaatacatactcaagaacaaagtaaactccaatctcaagtcgagcttcgatgagcaattcgccgtaagcgacagtatcttgctcagcaacagcttcgtgagcttactcaagtacaccagcttcggtgcatctggcggcttcacattcctagacctagacgtcaaacagggacgccttagataccaaactgtcaccgaagtactcgacgccaccctcatctaccaaagcatcaccgggctctacgagacacggacagacctaagtcaactaggaggcgactga

SEQ ID NO: 6656 - RNA, 4128 nt, synthetic construct
  misc_feature 1..4128: note = Cas9 variant
  source 1..4128: mol_type = other RNA
atgaagaaaatcctcggactcgatctgggcactacaagcatcggttgggccttagtcaacgagagcgaaaacaaagacgaacagagttcaatagtccggctcggagtccgggtaatcccactcacggtggacgaaaaaggaaatttcgagaaaggcaaagccatcaccaccaacgctgaccgacaacaggtccatgcagctcgaatcaacttacaacgttataaactacggagagagaacctcagggactgcctgcaaaaacaaggctggatcggctccgaaccaatgtgtgaggacggtaaaagcagcaccttcgaaacatacaaattacgggcgaaagcagcagtcgaagaggtcagcctccacgagttcgcccgagtcctcttcatgctcaacaagaaaaggggctacaaatcaaaccgtaaagcaaacgacaaagaagaaggcaaactcttcgacggcatgacgatcgccaaaaagctatacgaagaacatcttaccccagcagaatacagcctacaactgctaaatacgggacgcaagttcacccccgaatactaccgaagcgacctcatcgaagagttcgagaaaatctggaacgaacaacaaaaatattacccagaaatactaactgacgagttcaagcaacagcttgaagggaaagccaaatccaacacaagcaaactattcctcggaaaatacgggatctactccgccgacacaaaaggacttgaccggcgccttcaacccctcaagtggcgagtggaagccatgaagcaacaagtcgataaggacgttttagccttcgtgatatcagacttaaaaggtcaaatagcaaacacctccggtctactaggcgccatatccgaccgctccaaggaactatacttcagcaaacaaaccatcggccaatatctatgggcctcacttcaggaaaacccacacatctccatcaaaaatcagccgttttaccgccaggactacctcgacgaatttgagaaaatttgggaaacccaagctacataccacaaagaacttacctccgaactaaagcaagaaattcgagacatcatcatattctatcaacgacccctcaaatcgaagaagaacctcatcgccgtctgcgaactcgaacaaagaaaagtcaaagtaacggtagacggaaaagaaaaagaaatcacgataggccctaaaatcgctcccaaatcaagccccatgttccaagagttccgtatctggcaaaatcttaacaatatcctcctcctcgatcacgaaacaaattccaaacggcccctgtacgaagaagaacgcaatctcttgtacgaggaactatcggtaaaggaaaagctaagcaagacagaagcgcttaaggtcctaggcaagaaatccaaacagtgggatctcaattacaaagaactcgaaggtaaccgaacccaggccgtcctatacgactgctacaaccgaattattgtaatgagcggacacgaggaatgcaacttcaagaaactcaaagcatccgacatccggcactatgtaaaaatgatattcaaaaacctggcattcaacaccgacatactgtgtttcgacagcagcctgaaaggccacgagttggaaaggcaacccatgtgccaactatggcacctcttatactcgtacgaaggcgacaacagtcgtaccggaaacgacgccctcctacggaaactcgagacgagcttcggattcccaaaagaatacgcagccgtcctagccgacgtgatcttcgaagacagctacggcaatctatccgtcaaagccatgcgaaacatactcccgcatctacaggccggcaaagactattcgcaggcgtgtgaagaagccggttacaaacactcccgcagatcactgacgaaagaggaactgaaccaaaaagtgtacaaagaaaaactcgagctactacctaagaacagcctgcacaacccggttgtcgagaaaattctcaaccaaatggttaacgtaataaacgccgtaatcgaagaatacggcaaacccgacgagatcagaatagaactcgcacgtgacctgaaaatcggagccgccgaacgagaaaacatgacacggtccatcaaccaagggaacgccgaaaataaaagaatccgcgaaattcttgagaaagagttcgcgctatcatacctttcgcgcaacgacatcataaaatataagctatacgaagaactcaagagcaacggatttaagacactatactctgacacttacatatccaaagacaaactctttagcaaggatttcgacatcgaacacatcatacccaaagcgagactcttcgacgacagcctgtccaataaaacaatagaagcacgcgacgtaaatatcgcgaaaagcaacaagaccgctttcgacttcatattagagcgttatggggaacaaggtgtcaagacgtacaaaaccaaactactcagactgctagaggacggagccatatcaaacaagaaatacaacaacctactcaaaacagaggcagacattccatccggattcatcgatcgtgacctacgaaacacacaatacatcgctaagaaagcatatgagattctcagcgaacttgtaaaaatagtgacaccgaccacgggctccgtcaccaatagactccgagaggactggcagctagtagacgtcatgaaggagctgaacttcgagaagtaccaaaaattaggcctcgccgacgtaatcgaggaccgggacgggcggaaggtcaagcgaataaaggactggacgaagcgaaacgatcaccgccatcacgcgatggacgcgctaacgatagccttcaccaaaccatcctacatccaatacctgaacaacctgaacgcacgatccgacaaatccagcagcatctatgggatagaagtcaaagagctgcaccgtgaagagggcaaattccgcttcaacgctcctctccctatcaacgagttcagggccgaagcaaaacgccacctaaagtccgtcctagtatccatcaaagccaaaaagaaagtcatgacacaaaatgtgaataagataaaaaccaaacacggcatcatcaagaaagtacaactcacaccaagaggggagctacacaacgcgacgtactacgggacgaagaaacgacccctagtccgcatggtaaaagttggcgccgccctagatgaggcgacgattaaaagggtctgctccccagcgatccgcgctgccctccttaaacggctaaacgcctacaacggagacgccaaagaagccttcactgggcgaaacagcatcgacaagaacccaatatacctagatatagaacaaacaaaactggtccccgtacttgtcaagaccatagaatggggaatgtatcatccaatacggaagcgaatcacgcccgacctcaagatagacaaagtcatcgacaaagggatccgcgagaagctaaaagcgcgccttgccgagttcaacggcgatgcgcagaaagcgttctccaacctagacgaaaatcccatttacatggatgaagccaagcggatcacccttaaaagagtcagcatcgaaggagtcctcagcgccatcccactacacactctcaaggataaagccggtaaaccggtgatcgggtcggacggcaaaccagtctttggcgactacgttcaaacctcgaataaccaccacatcgcgttctacatcgacgacaagggaaacctacaggacaaccccgtcagtttcttcgaggctgcagaacgcaaaagtcaaggagtaccagtgatcgacagacgctacaactgcgacaagggctggcacttcgttttcacaatgaaacaaaacgagtacttcgtcttcccgaacgaagcaaccggctttatcccgagcgaagtggatctcctagacgaagctaactactgcataatcagcccaaatttatacagagttcaaaaactcagcaaagcgagcggccgagactactggttccgccaccacctggagaccatgttgaacgacgatctccgacttaaaaacagcacgttcaagcgcatccagagcctgaaagggctcgaggacatagtaaaagtccgaattaacagcattgggaaaatagtagcagtaggaaagtacgactga

SEQ ID NO: 6657 - RNA, 4128 nt, synthetic construct
  misc_feature 1..4128: note = Cas9 variant
  source 1..4128: mol_type = other RNA
atggagacaaaatttacctattacctcggcctggacatgggcacggattccctcggatgggctgtcaccgacagctcctaccacatcctcagagccaagggcaaagacctgtggggagtacgattattcccggcggccgagacctcagtcgacaggcggacgtaccgggtaaaccggcgccggaggcaacgggaggtagcaaggataggggcgctcaaagaactcttcgccgacgagatcgaaaaagtagaccccggattcttcgtaagacttgacgagtcaaagttccacatggaagaccgctcggagaacaacaaacaaaagtatggcctattcgcagacaaactgttctccgacgccgagtactacaagaaatacccaacaatattccatctccgcaaagaactcctagaaagcgaggagccccacgatgtgcgcctagtctaccttgcactactgaacatgttcaaacacagaggccacttcctaaactcctccctgcagatagaaggcgaaaacagtaacatcgccgaatcataccagatgtttgtcgacacattaaaagacgaagaactagactttcccgagcaagtttctggtgaacgactccaggaaatctttcgctcaagcgacagtcgaaagaagaaggtcgaaaacctactggcggaaatgaacctctcgaagaaacagaaaagggagatccaatttgtaaacctaatctgtggccttaaaggcaagctaagcgaactattccccgacaaagaatacgatgaagaacagaaaaagatagccttcagcttccaagactccgattacgaagacaaggagaacacaatccaagagctgctagacgaaagtgaaatgaacatgatatacgcagtcaaagcggtacatgacagcggcgttctatcaggtatcatgaacggagaaagatacctcagcgttgccagagtcgcaagctacgaaaaacacaagaaggacctacagatactgaaagatatactgaagaaatacgatacaaaagagtacttcgaaatgttcagaaacgaatccgagaaaagcgagaactacagcgcatacgtcggcagcgtcaaataccacggaaccttccgacgtggactgagcggtgggaaacaggaagacctatacaaacacatcaagaaggtgctgggcaagttcccccaagacgacgagggtgtaacctacgtactcgaggaaatagaaacagaatccttcctcccaaagcagctcaccgcatccaacggcgtcatccccaatcaggtgcacgcaagggaaatgctagcaatcctaaaacacgccgaactctatttaccatttctacaagagaaagacgacacggggctaagtgtatcagagaaaatcctcaaattattcatgttccaaataccttactacgtgggcccgctaggacaagagtataaggacaaaaagggctacaacgtatgggccgagcgtaaggagccaggaaagatctatccatggaacttcgaagaaaagatcgacgtaaagaaaagcgcggagaaattcataggtcgcatggtccgccgatgcacatacctcagtggagagcaggccctacccaaacagtccctactctatgagaaattccaagtactcaacgagcttaacaaccttcgaataagaggggagaaaatacccgtgagcctcaagcaagaaatctaccacgacctattcggagacggcaagaaggtgagcatgaccagactaacaaactacttgctccaaaacggggtcatcagcagcgaagaaaaggacagctgcatctcaggcatcgatggcggattccataacagcctctccagcgttggtaagttcaaaggagtcttcggcgacacggtacacaccgacgaacaccggaaaatgatcgaagacataatcttctggggaactgtattcggagatgggaagaaactcttaaaggaaaaagtggaagaagtatacggcaaccagctaacagaagcacaaaagaaacgcatatttggcttcaaattctcaggatggggacgcctcagcaaagcgttcctcaccatggaaggcgcctccaaagacaacggcgagatcaagggccttatccaagcgatgtgggacaccaattgcaacctaatggagctcctatcagaaagattcacatacaaggacaaactaaacgagatggtcactaccgccgagaaaccactatgcgaatggaagatcgaagacctagacgaaatgtatcttagcgcccctgtaaaacggatggtgtggcagaccatacgcgtggtcgacgaggtccagcagatcatgggatgtccaccaaagcgcatcttcgtcgaaatgacccgatctgacggggagaaaggcaaacgcactgtctcccgccaaaagaaattggtggacttatacaaagcgctaggaaaagagggaaaaatctggagcgaagaactcaacaacaccccagaaggccaattcaggataaagaaactgtatctctactacctacagatgggcaagtgcatgtacacaggagaatcgatcgagctcgaaccactcatgaacgacaaccacttgtacgacatcgaccacatctacccccgtcacttcatcaaagacgacaacatcagtaacaacctggtactggtcaaaaaggaacgaaacgcccacaaaagcgacagctttcccatcgaacccgaaatccgaaataaaatgatgccgttctggaaaagcctccgaaagaaaggcttcctaaccgaagaaaaatacaacagactaacacgcatgagcgctttcaccgatgaggaaaaagccgccttcataagcagacagctagtagaaacctcgcaagggaccaaagccatcacacaaatcttcaaacaggccttcgcagacagcgagatagtcttctcaaaggccagcgtcgtctccgcattccgacagaaattcgactgctacaaagtccgctgcgtcaacgattaccaccacgctcacgacgcatacctcaacattgtagcgggcaacacgtaccgggtgaaatttacatccaatcccctcaacttcataaaagaagctaagaaaaacccaaattcacgagagaaccgctacaacatggataaaaccttcgaatgggacgtaacaaggaacggcgaaaccgcatgggtcgcacagtccaacgaaaaccccgggacaatccagctagtcaagaaatacttgaacaaaaacagcccgctcataaccaaaatggtgtacgaaaaacatggcggtatcacccaaaaagccaccatctggtccgccaaaaaggccgagagcggaaacaccgacgcctacatcccagttaagatgaacgacccaagactcgcagacgtaaccaagtacggcggagtcaccacaatcgccgtcgccgggtataccctcctcgaatacaaagccgggggcaagactgtccgcagcctagaagccctacccatctatctgggaggaagcaagaatctcactgaggaacaaatggtagaatacttctccaacatcctccagcaggaaaacaaagaaaaagtagtgtcagacgtaataatacgaaagaaaatgatcccaagcggaagcctgatcaagtacaacggtttctactactacctcgccggaaaaaccgggaaccgcattgtcctgatcagtgcagtccagctctgcctacccatggacaccatgctttacataaagaagatagagaaggcttgttcaacaggaaacttcgaagagaaagacaaaaacgggaaacaagtgctgagcaagcaacaaaatgagtttgtatacgaactaataatagaaaagtaccaacaaagcatatttaaaaagaaagtgggtgccataggcgacaccatcatcgagaagcgtgaaaaattcgccgagatcagcctggaggagcagtgcaaggtgctcatgcaaatattcctaaacttccagtcagggataggggtcgatcttacatccgtagacggatcaaacaaatcaggggtgacttaccttaacaagaaaatcatgaacgcacaggaactcaaactaatcgaccagtccgtaacaggagttttctcaagagagatagacttactaaccatatga

SEQ ID NO: 6658 - RNA, 4128 nt, synthetic construct
  misc_feature 1..4128: note = Cas9 variant
  source 1..4128: mol_type = other RNA
atgagtaacaaaagctactccatcggactggatatcggcacaaacagcgtaggctgggcagtcatcacagacgactacaaggtcccaagcaagaaaatgaaagtcctaggcaacaccgacaaacacttcatcaagaagaacctgatcggcgccctcctgttcgacgagggcacgaccgccgaagatcgcagactaaaaagaaccgcccgccggcgctacactcgaaggaaaaaccgactcagatatctccaagaaatcttcagcgaggagatgtccaaagtagactccagtttcttccaccgcctggacgactcattccttgtccctgaagacaagcgcggaagcaagtatcccatattcgccaccttggccgaggagaaagagtaccacaagaaattccccaccatataccacctgaggaagcacctggcggactcaaaggagaagacggacttacgcctgatatacttggccctggcccacatgatcaaataccgaggacacttcctttacgaagaatccttcgacataaagaacaacgacatacagaagattttctcagagttcatttccatctacgacaacacgttcgaagagtcttcactaatcggacaaaacgcccaggtagaagcaatcttcaccgacaagattagcaaatcagccaagcgtgagcgcgtcctcaaactcttccccgaccaaaaatcaacaggcctgttctcggagttcctcaagttgatcctaggcaaccaggctgacttcaagaaacatttcgacctcgaagagaaagctcccctacagttttcgaaagacacctacgatgaggacctagaaaacctcctgggccaaatccgggacgacttcgcggacctcttcttggtagcgaaaaagctctatgatgcaatcctcctgagtggcatcctcacagtcaaagacctctccacaaaagcaccgcttagcgccagtatgatcgaacattacgaaaaccaccaaaaagacctcgccgcgttgaaacagttcatacagaacaacctgcaggagaaatacgacgaagtgttcagcgaccaatcgaaagacggctacgccggatacataaacggcaaaacaacgcaagaagcattctacaagtatatcaaaaacctcctcagtaagttcgaaggcgccgactacttcctcgacaagatagaacgggaagatttcctccggaaacaacgcacgtttgacaatgggtcaataccacaccaaatccacctacaagagatgaacgccatccttcatcgacagggcgaacattatccgttcctgaaagagaacaaagaaaagatcgagaaaatcctaattttccgtataccctattacgtcggcccgcttgcccgaggaaatcgagacttcgcctggctcacacgaaactcagacgaagcaatccgcccctggaacttcgaagaaattgttgacaaagcatcctccgccgaagacttcatcaacaaaatgaccaactacgacctctacctgcccgaagagaaagtcttaccaaaacactccctactatacgagactttcgccgtatacaacgagcttacgaaagtcaaattcatcgcagaagggctaacacgctaccagttcctagacaaaaagcagaagaaggacattttctacaccttcttcaaagcagaagacaaacgcaaggtaacagaaaaagacataatccactacctacacaccgtagacggctacgacggaatcgaactggagggcatcgaaaagcaattcaacgcatccctgtcaacctatcacgatttacttaaaattatcaaggacaaggagtttatggatgacgacaagaatgaagcaatcctggaaaacatagtacataccttgaccatctttgaagatcgggagatgatcaaacaacggctcgcccaatacaacagcctattcgacgaaaaagtcattaaagcgctcacccgtcgacactacactggctggggcaaactaagcgcaaaacttatcaatggaataagagacaaaaagagcgggaagaccatcctggactacctcatcgacgacggagagataaaccgcaacttcatgcaactaatacacgacgacggcctcagcttcaaagaaataatccagaaggcacaagtcttcggtaagaccaatgacgttaagcaagtggtacacgaactgccgggatcaccggccattaagaaaggaatcctccaaagtataaaaatcgtcgacgaactggtcaaagttatgggccacgctccggaaagcatcgtcattgaaatggcccgcgagaaccaaacaactgcccgcggtaagaagaactcccaacaaagatataaaaggatcgaagactcactcaaaaacctggcctcaggactggacagcaacatactcaaggaaaaccccaccgacaatgtccagctccaaaacgaccgactcttcctctactacctacagaacgggcgagacatgtacaccggaaaaccactagaaatcaaccaactctccaactacgacatcgatcatataatcccacaagccttcatcaaagatgacagcctagacaaccgggtcctcactagcagcaaggacaacaggggcaaaagcgacaacgtcccatccctcgaagttgtggaaaagatgaaagccttctggcaacagctcctcgactccaaactcatctctgaacgcaaattcaacaatcttacgaaagcagaacgagaacgcgggggcctaaacgaacttgacaaagtcggattcatcaaacgacaactcgtcgaaacccgacagatcaccaagcacgtcgcacaaatcctggacacacgattcaacaaggaagttaccgaaaaggacaagaaaaaccggaatgtcaaaatcataacactaaagtcaaacctcgttagcaacttccggaaagagttcggcctttataaagtacgagaaatcaatgactaccaccacgcgcacgacgcatacctaaacgcggtggtagcgaaggcaatactgaagaaatatcccaaactcgaaccagagttcgtctatggagaataccagaaatacgacctaaaacgatacatctcgcgcagcaaagaccccaaagacatcgaaaaggccacagaaaagtatttcttctacagtaacctactaaacttcttcaaagaagaggtccaatacgcagacggcaccatagccaagcgggagaacatcgagtacagcaaagacacaggggaaatagcctggaataaagaaaaggatttcgcgaccgtcaagaaagtcctgtctctaccgcaagtaaacatcgtaaagaaacgagaagtccagaccggtggctttagcaaagaatcaatactcccaaaagggaacagcgacaaactcattccacgaaaaaccaaagatatactctgggaaacaaccaaatacggcggcttcgactcaccagtgatcgcctattcgattctgctcatagcagacatagaaaaaggcaagtcaaaagaattaaagacggtaaaaaccctggtggggatcacaattatggaaaaagccaccttcgaagaaaaccctatcacattcctcgagaacaaaggctaccacaacgtgaggaaagaaaacattctctgcctccccaaatacagtctattcgaactggaaaacggccggcgccggctactagcctccgccaaggaacttcagaagggaaacgagatcgtcctgcccgtatacctaacaaccctcctgtaccacagcaagaacctccacaaactggacgaaccgggccacctcgaatacatccaaaaacacagaaacgaatttaaagacctacttaacctggtgagcgagttcagtcaaaaatacatccttgcggacgccaacctagaaaagatacaaaacctatacgccgacaacgaacaggcagacattgaaatactcgcaaacagtttcatcaacctcctaacgttcaccacgcttggtgcccccgcagccttcaaattcttcggaaaagacatcgacagaaagcgctatacaaccgtaagtgaaatactgaacgcaacactaatacaccagagcatcacggggctctacgagacgcgcatagacctcagcaaactaggagaggattga

SEQ ID NO: 6659 - RNA, 4128 nt, synthetic construct
  misc_feature 1..4128: note = Cas9 variant
  source 1..4128: mol_type = other RNA
atggagaaaagctatagcatcggactcgacataggaacgaactcagtcggctgggcagtaattaccgacgactataaagtccctgccaaaaagatgaaggtcctcgggaacacagacaagaaatacatcaagaagaacttactcggcgcactcctgtttgactcgggcgaaactgcggaggtcacccgactaaaacgcacggcacgccgacgatacacccgccgcaaaaacagactcagatacctccaggaaatctttgccaaagaaatgacaaaagtagacgagagcttcttccagcggctagaagagtcctttctgaccgatgacgacaaaacgttcgactcacacccaatcttcggaaacaaggcggaagaagatgcataccaccagaagttcccaaccatctatcatctacgcaaatatctagccgactcccaggaaaaagccgacctaagactggtctacctggcactagcccacatgatcaagtacagaggacacttcctaatcgaaggcgagctgaacgcagaaaacacagacgtccagaagctgttcaacgtgttcgtcgagacctacgacaaaatagtggacgaaagccacctatccgagatagaagtggacgccagctctatcttgaccgagaaagtctccaaaagtcgccgcctagaaaatctaatcaagcaatacccgaccgagaagaaaaacacactcttcggaaacttaatagcactcgccctcggcctccaaccaaactttaaaaccaacttcaaactaagcgaggatgctaaactacaattctccaaagacacttatgaagaggacctagaggagctcctcggcaaagtaggggacgactacgccgacctattcatcagcgctaaaaacctctacgacgccatccttctttcagggatactgaccgtggatgacaacagcactaaggcaccccttagcgcgagcatgatcaaacgatatgtcgagcaccacgaggacctggaaaaactcaaagaatttatcaagatcaacaaactcaaactgtaccacgacatcttcaaggacaaaaccaaaaacggttatgccggatacattgataatggagtcaagcaagacgagttctacaaatacctaaagacaatcctcaccaaaatcgacgacagcgactactttctggacaaaatcgaaagggacgatttcctccgaaagcaacgcactttcgataacggatcaatcccgcaccaaatccatctgcaggagatgcacagcatcctacggcgacaaggggattattacccgttccttaaagagaaccaggcaaaaatcgaaaagatactaacgttccgcatcccttactacgtcggacccctcgcccgcaaagacagccgcttcgcatgggcaaattaccatagcgacgagccgattaccccatggaacttcgatgaggtagtcgacaaggaaaaatccgctgaaaaattcatcacacgcatgaccctcaacgatctctacctaccagaagaaaaggtgctcccaaagcacagccacgtctacgagacctttacagtctacaatgaacttaccaaaatcaaatacgtgaatgagcagggtgagagcttcttcttcgacgccaacatgaaacaagaaatcttcgaccatgtgttcaaagagaaccggaaagtgacgaaagcgaagctgctcagctacctcaacaacgagttcgaagagttccgcataaacgatctcatcggcttagacaaggacagcaagagcttcaacgcatcactcggcacgtatcacgacctcaagaaaattcttgataaatcattcctcgacgacaaaaccaacggccagatcatagaagacatcgtcctgacattgaccctcttcgaagacagagacatgatccatgaacgcttgcaaaaatattccgatttctttacgtcgcaacagcttaagaaattggaacgaagacactacaccgggtggggacgactctcatacaaactaatcaacggaatcaggaacaaggaaaataacaaaacaatactcgactttctgatcgatgacgggcatgctaaccgaaacttcatgcagctaatcaacgacgagagcctcagtttcaagaccataatacaagaggcccaagtggtcggagacgtggatgacatcgaagccgtcgtccacgacctcccaggaagcccagccatcaagaaaggaatacttcaaagcgtgaaaatcgtcgacgaactcgtaaaagtcatgggtgacaacccagacaacatcgtcatagaaatggctagagaaaaccaaaccacaggctatggccgcaacaagtcaaaccaacgcttaaaacgcctccaagatagcctaaaggagttcggctccgacatactatcgaaaaagaaaccgtcctacgtcgactcaaaagtagaaaactcccatctgcagaacgaccgactattcctctactacatccaaaacggaaaagacatgtacaccggagaggaactcgatatcgatcgcctgagcgactacgacatagatcacatcataccccaagcgttcatcaaagacaactccatcgacaacaaagtccttacatcatccgcgaaaaaccgaggcaagtccgacgacgtaccatccattgaaatagtccgaaaccgccgatcgtactggtacaagctatacaagagcggactcatcagcaaacgcaagttcgataacctgactaaggccgagcgtggaggcttaaccgaagccgacaaagccggcttcatcaaacgacagctagtcgaaacccgccaaataaccaaacacgttgctcaaatcctcgacgcccgattcaacaccaaacgcgacgaaaatgacaaagtcatacgcgacgtgaaggtcataacgctcaaatccaacctagtatcgcagttccgtaaggagttcaagttctacaaggtccgagaaataaacgactaccaccacgcgcacgacgcgtacctgaacgcagtcgtaggcactgcgctactcaagaagtacccgaagctcacgcctgagttcgtatacggcgaatacaagaaatacgacgtacgcaaactaatagcaaaatcctcagacgactatagcgaaatggggaaagcaaccgccaagtacttcttttattccaacctcatgaacttcttcaaaaccgaagtaaaatatgccgacggacgtgtcttcgaacgtccagatattgaaacaaacgctgacggagaggtcgtctggaacaaacaaaaggacttcgacatagtccgcaaagttctatcatacccacaggtcaacatagtcaagaaggtcgaagcgcaaaccggagggttcagcaaagagtccatactgagcaagggcgacagcgacaagctaatcccccgcaaaacgaagaaagtctactggaacacaaagaaatacggaggcttcgacagtcccaccgtagcatactccgtcctagtagtcgccgacatagagaaaggcaaagcaaagaaattaaaaaccgtaaaagaactggtcggaatatccataatggagcgcagcttcttcgaggagaacccggtcagcttcctcgagaagaaaggctaccacaacgtacaagaagacaaactcatcaaacttcccaaatacagccttttcgagttcgaaggtggacgccgacggctcttagcatcagcaacagaactacaaaaaggaaacgaagtaatgctaccagcccaccttgtcgaactactctaccacgcccatcggatcgactccttcaacagcacggaacatttaaaatacgtaagcgagcacaagaaagagttcgaaaaagtattgtcgtgcgttgaaaatttcagcaacttatacgtcgacgtagaaaagaatctatcaaaggtccgcgccgccgctgaatcgatgaccaacttctcactagaggagatatcggccagtttcatcaacctgctcaccctgaccgccctcggagcacccgccgacttcaacttcctcggagagaagattccgcgaaaacgctacacatccactaaagaatgcttatccgccaccctgatacaccaatccgtcaccggcctgtacgaaacacgcatcgatctctcaaaacttggagaagaatga

SEQ ID NO: 6660 - RNA, 4128 nt, synthetic construct
  misc_feature 1..4128: note = Cas9 variant
  source 1..4128: mol_type = other RNA
atgacaaaaatcaaggatgactacatcgtcggcctcgacatcggcacggacagttgcggctgggtcgcaatgaactcgaataacgatatcctaaaactacaggggaaaacagccatcgggagccgactcttcgagggagggaaatccgccgcggaacggcgtctgtttcgcaccactcatcggcgtatcaaaagacgacgctggcgccttaaactactcgaagagttcttcgatccgtacatggccgaagtcgacccatacttcttcgcacgactgaaggaatctggactcagtcctctcgataaaaggaaaaccgtctccagcatcgtgttccctacgagtgcggaagacaaaaagttctacgacgactatcccacaatataccacttgagatacaaattgatgaccgaggacgaaaaattcgatctaagagaggtgtacctcgccatacaccacataatcaagtacaggggcaacttcctttacaacacgtctgtaaaagacttcaaagcatccaaaatcgacgtgaaaagctcaattgaaaaactgaacgaactgtacgaaaacctaggacttgacctgaacgtcgagttcaacattagcaacacagcggagatcgaaaaggtcctaaaggacaaacagatcttcaaacgagataaagttaaaaagatcgcagaactattcgctatcaaaaccgacaacaaagaacaaagcaaacgcataaaagacataagtaaacaagtcgcaaacgcagtactcggctacaagacccgctttgacacgatcgcactaaaagagataagcaaagacgaactctcagactggaacttcaaactcagcgacatcgacgcagactcgaaattcgaagcccttatggggaacctggacgaaaacgagcaagccatcctactgaccatcaaagaactgttcaacgaagtaaccctaaatggaatcgtagaagacgggaacacactatcggagagcatgataaacaaatacaacgatcaccgcgacgacctcaaactcctgaaagaagtcatcgaaaatcacatcgatcgaaagaaagccaaggagctcgcgctcgcatacgacctatacgtaaacaaccgacacgggcagcttctccaggcgaaaaagaaactcggcaaaatcaaaccaaggagcaaagaggacttctacaaagtcgtcaacaaaaaccttgacgattcgcgggcatcaaaagaaatcaaaaagaagatagagctagactctttcatgccaaaacaacgcaccaacgccaatggcgtgatcccctaccaattgcagcaactcgagctagacaaaataatcgagaaccagtcaaaatactacccgtttctcaaggaaatcaaccccgtctcctcacacctcaaggaagccccatataagctagacgaactcatacggttccgcgtgccgtactacgtcggccccttaatatcccctaacgaatccacaaaagacatccaaacgaaaaagaaccaaaacttcgcctggatgatccgcaaggaggaagggcgcatcacaccctggaacttcgaccaaaaagtagaccgcatcgaatccgccaacaaattcattaaacgcatgacgaccaaagatacataccttttcggcgaagacgtcctgcctgcaaactcgctgctgtaccaaaaattcacagtactcaacgagctcaacaacatccgaatcaacggcaagcggatctcagtggacctaaaacaggaaatatatgagaacctgttcaagaaacacaccacggtgaccgtaaagaaactcgaaaactacttaaaagaaaaccacaacctagtcaaagtcgaaattaaaggactcgcagatgaaaagaaattcaacagcggtctcacgacgtacaaccgcttcaagaaccttaatatcttcgacaatcaaatagatgacctaaaataccgcaatgacttcgagaaaatcatcgaatggagcaccatattcgaagacaaatccatctataaggagaagttgcgttcaattgattggttgaacgaaaaacaaatcaacgcgctctcgaacatacgactccaaggatggggcagactctccaaaaagctactcgcacaactacacgaccacaacggccagaccatcatcgaacaactctgggactcccagaacaacttcatgcaaatcgtgacccaggccgacttcaaggacgcaatcgcaaaagccaaccaaaacctgctcgtcgcaacctcagtggaagacatattgaacaacgcgtacacgtcgccggccaacaagaaagcaatacgacaagtaataaaagtcgtcgatgacattgtaaaggcggcatccggcaaagttcctaaacagatcgccattgagttcacacgagacgccgacgaaaaccccaaaagatcgcaaacccgcggtagtaaactacaaaaggtgtacaaggacctctccaccgagctcgcaagtaaaacgatcgcagaggaactaaatgaggcaataaaagacaagaaactcgtacaagacaaatactatctctacttcatgcagttaggtcgcgacgcctacacgggagagcccattaacatagacgaaatacaaaaatacgacatcgaccacatccttccccagagcttcatcaaagatgacgccctcgacaaccgggtcctcgtaagccgcgcagtcaacaacgggaaaagcgacaacgtcccagtcaaactattcggtaacgaaatggccgcaaacctcggcatgacgatacgcaaaatgtgggaagagtggaaaaacatcggacttatctcaaaaacgaagtacaacaacctcctcaccgaccccgaccacatcaacaagtacaagtccgccggcttcatcaggagacagctcgtcgaaacgagccagatcatcaaactggtctccacaatcctccagtccagatatcccaacaccgaaattataacggtcaaggcaaaatacaaccactacctccgcgagaagtttgacctgtacaagtcacgcgaggtgaacgactaccatcacgccatcgacgcctacttgagcgctatctgcggcaatttgctgtaccaaaactacccaaatctccgcccattcttcgtctacgggcaatacaagaaattctcgtctgacccagacaaagaaaaagcgatcttcaacaaaacacgcaaattctcatttatcagccagctgctgaagaacaagagcgaaaactccaaagaaatcgcaaagaaactgaaacgcgcgtaccaattcaagtacatgctcgtcagccgcgaaacagagactcgcgaccaagaaatgttcaaaatgacagtatacccacgcttcagccacgacacagtcaaagcgccaaggaacctaatacccaaaaagatgggaatgtcacccgacatctacgggggatacacaaataactccgacgcatacatggtcatcgtgcggattgacaagaagaaagggacagagtacaaaatactcggcattccaacccgtgaactcgttaacctcaagaaagcggaaaaagaagatcactacaaatcgtacttaaaagagattctaacaccgcgcatcctatataacaaaaacggaaagcgggacaaaaagatcacgtcctttgagatagtaaaaagcaagataccctacaaacaagtgatccaagacggagacaagaagttcatgctgggctccagcacgtacgtatacaacgcgaaacaactgaccctctcaaccgaaagcatgaaagccatcaccaacaactttgacaaagattccgacgaaaacgacgcattaataaaagcctatgacgagatcctcgacaaagtcgataagtacttgccactcttcgatataaacaaattcagagaaaagctccactccggacgcgagaagttcatcaaactcagcctcgaggacaagaaagacacaatacttaaagtgttagaagggctccacgacaacgccgtgatgacaaagatcccaacaattggactgagcacaccactaggtttcatgcaattcccaaacggagtgatcctatctgagaacgcgaaactcatctatcaaagccccaccggactgttcaagaaatccgtcaagatctctgacctatga

SEQ ID NO: 6661 - RNA, 4131 nt, synthetic construct
  misc_feature 1..4131: note = Cas9 variant
  source 1..4131: mol_type = other RNA
atgtccaacttcgacaaccacaaagacagcatctgcaagcacaaaggactgaagaaagggaactactacatcggactcgacatcggcacgaactccgtcggctgggccgccacaaacgaacaatacgagctactcaaatttaagtcacacaagatgtggggtagccgccttttcgcggaagcccaaaccgcagtagatacgcgcatgaagaggagtgcccgccgccgactgcaaaggcgtaaattccgccttatactcctcgaatctctattcagcaaagagataaacgccgtcgatgagacgttcttcatgcgcctacacgagagcaactaccatgtcgaggacaagacgaacctagtcaagtatacgcttttcatagacaaaaactacaccgacgtagactactacaaagagttcccgacaatctaccacctccgacaccaccttatgaccgaagggaccaaggacataaggctcctctttctagcgatccatcatatcctaaagtacagaggcaatttcttgtacgggaagaaagagttcagcgtcgacggagaaatgtattccgtcctcagatcgaccctcgaagaactcggtttcggctcatacgtagaagacgaaaacgtactccaaagcatagccaacctggtgctagaccgcgggatcgcgcgctcggaaaaagtaaagcaaatcgaaccactgatcgcgcaaggcaaaaagctctcctcggtagagaaaaatagactcaaagcctgggcgtacttaatcatgggcctaaaagcgaaccttgttaacctattcaccgacgaagacgtcgaagtagtcctaccggaagaaaaagagttcaaatccatcaacctacacgaaggaatctacgaagatgtaagagacgcctatgaagacgcctggggcgaccgcttcgccatagtggaccagtgcaaagtacttcacgacattatagtgatcagtagcatcataaaacccgggcaatccctgtcagaggccaagatcgaatcatacaatcaacacaaggaagacctagtcctattaaagagtgtactgaaggaggacaaaaagctctatgacgacatgttcgtcgtcgacattgacaaagggactaattacgtaaaatacataaaacaaggagtcaacggtaacacaagcacgactcaggaagcgttctataaatatgtccgaaaagtcgtttcggtactgcccgaaaccgaaaacacgcgctgcatcgtccagaaactagaagaaggaacctttctacccttgcagaggatatccaagaacggcgtcgtaccctaccaactccataaagaagaactggtacgaatacttgagaaggcgaaactaaacttcccatttttgaacgaggttgaagatgggcttacagtcgccgacaaaatcatctcgatcctagagttcaaaatcccctactacgtcgggcccctcaacccaacacactccatcgaaaatgggggattcgcgtgggtagttagaaaggaagccggacaagtcctgccctggaacttcgaacagaaagtcgacgtccaggccagcgcagttaaattcatagaaaacctaaccaacaagtgcacctacctgatcgaccaagacgttctgccaaaatattccctcctgtatgccgagttctcgctgctaaacgaactaaacaacataagagtcaatgacaagccactacccgcagacgtaaaacaagcgtttatcagggaccacttcatcagtctgcaggacagtaaaacagcgacgaaaaaggtagtcgcaaaatacctcgtcgacaataactacgtctcacaaccacccataataaccggtatggatcaacagatcgcaacgaagctgacatcacacagagacatgaccagaatccttggtgagcactttgattacgcaatggccgaagacattatccggtacatcacaatattcggggaatcgaaagatatgctacggcaggtcctcaagaactattacggcgaccgcctgacaactgaacaaatcaagaaactcgggaaactcacatacacaggctggggccgcttatcgaagaaatttctcagcgacatatggggcatgaagaaaaacgacgacgacgccgaagccggcaccataatcgaacacatgagggagggccaggagaatctcatgcagctcctatcctccagctatagcttcattgacgtcgtacaagaatacgtcacaaacgtcctcggggccaaagagaaaactgccttcgaaatgctcgaagacctatccctgagccccatggtaaaacgctctgtttggcaaaccctccgcatcctagacgaaatcgtgagtataagaaaggaactacccaagaaaatattcgttgaagtagcacgcacgaacaaagcggataagaaacgaacccaaagcaggaaggccctactcgaagaactctacgaacagatcaaggacgaggacgtccacgtactccagcaagaactcgagagcaaagaagatagcgccctgaacagcaagaagctctacctctactttacacaaatgggccgatgtatgtacagcggacggcggatcgacatacacgaactgtttacagacacgtacgatatcgaccacatttacccacgctcgctcaccaaagatgactcctggcacaacattgtgcttgtcgagaaacaactcaacgccgaaaagacggaccgattcccaatcctaagtgccattcaaagcaagcaaaagggcttctggaagctattgtgggaccgggggttcatcagtgaaaagaaatacgatcgccttgtaaggaccaccgacctgactgacgaggaactcaaccaattcatcaaccgccaaatcgtatcaactaaccaatcagtcaaagccgtgactaccctactacaccagctttaccccgaaaccgaagtagtcttttccaaagccgagaacataagcgacttccgccgagattacggattcgtaaaggtacgcagcattaaccaccaccaccacgccaaggacgcatacctgaacatagtcgtgggcaacgtctaccacgagaagttcacgaagaacttcctctcattcgctaaacaaaaagggacccacaggacctacaatctaacgaaaatgttcgaatacgaaatcaagctcacagaagaaagcaagaaagtgatctgggaccccaatatccacatggacatagtcaagaaaatgatgaaaagcaatgacgtacgagttacccagagagcagtgccacaaaaagggggcctctccgacgaaacaatctacaagaaaggcatcgcgaaacgcggcgtctatttacctctaaaaagctcagacgagcgcgtacgcgacgtcgaaaaatacggaggacgaaccagcataacaatatccgaatacatcatacttaacatcagagacacctcagaccaagaccgaatcgaaatcttctcactacccctatacatagccgggaagaaagatatccacaaagcgatagaagaagcatacctctcaacctgcaagaaacccgcctcagtcgtcgacatccagatcctgtaccgcggactctatatcggctcaaaagtaaacatcaatggattcacctactacatgggtggtaaaacaggcagcaacgtctcagtagacagcgcggtcgacgtggtcatggacattacaagctccgtgtacatcaaactactcgagaaagtagcaatcaaaaagatagagaactcaaaaacattccgcatcgagaacatcaagacatcctacaaccacaaagaggtaacagtctcaaaagaacaaaacatagccctttaccaagaactcctcaagaagctagatacacctctgttcagcaagatgaaaggaaataaacttgaagagttccgtacggtaggtttcgacacgttcatcgcactgtccctagaagaccaggcaagcgtgcttctggaagtcctaaacgtcttgaccaacttcaaaaccaagcgcgacataacaaagatcggaatgacctctagccgcagtaccttggggataaacatatcgaacaccgaacagttctccgtcatcactacctccatcaccggcctatacgagcaggaaattaaaataaaatga

SEQ ID NO: 6662 - RNA, 4131 nt, synthetic construct
  misc_feature 1..4131: note = Cas9 variant
  source 1..4131: mol_type = other RNA
atgactaccaaaaaccgagagaaaaataacaaattccacaaggcttcgcccctctacacactcgggctcgacattggcacaacatcagtcggttttacagccatcgatgaagcccagagacctatgcgcgctaagggaaaaacagttatcggagtccgcctattccaagaaggtcagtcagcagtcggccgaaagaacttccggacgaccagacgccgcctaaaaagaaggcgccgaagactcaacttactgaagcagttcttctccgcgccactacgcaagatagaccccaccttcttcaagcgcctcaaagccagcagcctgtcaccagcggataaacgcagatacttggccccaggcctgtttcccaacggcggcgatattaagttctaccaaaagtaccccacgatataccacctacgactcgcacttatgacagaaaaacgacccttcgacctgagagaagtctatctggcaatccaccacatcgtcaaataccgtggcaatttcttaaatcctctccccgtctccgcattccgtggccgcaaccaaagattcgaagaccagttcagtgaactcaaccaactatacaagtccttggaaggcgagtccccgttccaattcgacgagaaaatcttctccgaactggacaagcagctattagtcaatgacggacgcaagatcgaccgacaaaaacaactcgcgaagcgagtatttatcaaaaccaacgagaagcgaatcgacagtcatcaccagaaaatcgcatcagccttctcaaaagctgttttcggctacaaatttcggcccgacgtcctcctaaatagcgacccgaatgagtccatagacgagttcataaaattcggagacgaagacttcgacgataaattagtaatactacgagaatcactcaacgccacgcaaaaagaaattctagcagtcactcaacgtatctactcacagataatcctaaatgagatcgtcccttcccgggagaccttatcagaggccatggtctcccgctaccaaaaacaccacagcgacctgcaactcctaaccgaagcgtgcaagaaaatgactaaagcaaaagcagcacgtatacaagccgcctataccgactacatcggtaaaggagacggccacaaacttgtccacgaccagttcgtggcgctaatcaaaaagaatctcgacccatcagaggaaggccgagacctcgccgaacgcctcgcacaagacgacttcatgcccctccaacgcacacccctcaacagggtgataccccaccagttacaacaggaggagctcgaccggatcatcgaaaaccaaggcgaatactaccccttccttaagacgctcaaccccaatcggagccgagccggcgtagccaactaccagctagacgagctagttagcttccgcataccctactacgtcggaccactcataacagcgaccgaccagctccacacttccggcgcaaaatttgcttggatgacacgccgcgcagccggagagataaccccctggaacttcgaccagaaagtcgatcgtctcgcatcagcaaaccaatttatacgccagaatatgccaaaggacaatcacctcctcgaagcggacgtcctgccagcaaattccctcacctaccaacgctacctcgtactcgacgagcttaacgcggtcaaggtaaatcataaatccttaaccgtctcgcaaaaacaacgaatcttcaacgaccttttcaaacgtcaacgaacagtgaccgtcctaaacctccaaaattatttgaaatccatcgaaaagctgcccaccctcccagtgataacaggtgtgtccgactccgagagattcaagaccaccctctccacctacttggacttcaaaaacatctttggcggcaaagtcgacgactcttcacagaaagaaaagttcgaaaagatcatcctctacgccactatcttcgaagatcacgcagtttataaagctaaactcgaccaaatagactggctaggccaacagcaaaagaccgacctgctcagcaaaaactaccaaggctggggacaactgagcgaaaaactgctgctgggcctaaagaaccaagccggccaatccatactagacgaactctggcaaacaaacaaacgcttccgcgaaatcatgaacgaagcacacttcgcaaaacagataatggcaagcaacgccgcacttctcaggaagaaaggccttgacgacgtactcagcacagcattcctcagcccccagaacaagaaagccatacgtcaaacagtagaagtcgtagacgacatagtaaaagccatcggctgcccaccccagaaaatctcacttcacttctcgaaagcaccagcagacgccatacgtcacgaacgcgacaatgccaacataatactccgcacatacagaaacctaccagcgaaaatggtagacgaccaactcaaagcagaacttcaagccaccgcagaaaaacaccaagttctgtccgacaaactttatctatacttcactcaactgggtagggacctctacactggtgaaatgctcaaaatgagtgagctagaaaacgacatgatcgaccatatcatgccccaaacctttgcatacgacgacagcgtcaacaaccgcgtactcgtatcccaaaaccattcctcccaactaggaaagacctctggagaaaagagcgacgcaaaaatgatcaggttctggcaagtactacgcgacaacaaactcatctccgaacaaaagtaccaaaacctaacgctcgactccgaccacctcagtaaaagcactcgggaacagctgctcaaccgctacctagtcgagaagaacccaataacccaatgggttgcctcagtgcttacggaaaaatacggcgacaacggaacaagagtactcaccatcaacccacgaatggtataccaaatgcgccgccaattcaacctagtcaacttacccgaagtcaacgactacgaccatggccttgatgcttacctagccgctttcatcggcaactatgtcgacaggcgatacccacgccttcgaagttacttcgtgtacggcgactttagcagttccaaagaaatcgtcttccggctaaacagattcaatttcctcttcgacctaggacaggccgaacccaacgaactcacggactgggaaactggcgaaatgatctgggacaaggctgctgcaaattccgtcctgcgcgatgtataccaatacaaattcatgctcatctcacaggcggtctactcaagacaaggtgcaatgtttaaccaaacgatataccccgcatcccaagcagcgggccgtcaactcattcccgttaagaaaaaccgcgcaaccaaattatacggcggctactcggggaacgttgatgcatacctcgcaatcgttcggctcggcggacccaaatcggatcaataccgtgtcgtcggaatccccaccaggatggtcggccgactgcaatccgccatgaaacaaggcgccgacacctacgcaaatacactacacaaaatactgcaaccgcaattcaccaagcgaaagaaaaacagacaaacggggtactacgaagagacgaccgaaccgttcgcagtcattttagataaggtatactaccgacaactcattatcgacggccaacaaaaattcatgctcggatcatcgacataccagttcaacgccaagcaattagtcctatcttcccgggcccgccaaatcctatcaggcgaagagagactaacagacgagaacggttctcaagacctcatcgacgtctacgacgagatactcaccaaaatagatcgctacttcgagctgtacgaccaacgacacttccgccaatctctgcacgacggccgcaagcaattcatcagcctaccaatccacaacgtttacagagcaaatagactgatagaacacggcaaatacgaaaccctatcgcaaattctcaatggcctacacgcgaacactatgatgacgaacctcagatacctcggcatttcctccccatttggaaaatttcagtcaccaaacggaataaaattatccaaggatgccgtcctagtctatcagtccccatccggcctcttcgaaagacgcgtccgtctccgcgatctctga

SEQ ID NO: 6663 - RNA, 4131 nt, synthetic construct
  misc_feature 1..4131: note = Cas9 variant
  source 1..4131: mol_type = other RNA
atgaacaacaaaccctactcgataggcctcgacataggtacaaactccgtcggctgggccgtcataacagacgattacaaagtaccctccaagaaaatgaaagtactggggaatactgacaagcacttcataaagaaaaacctcctcggagcccttctattcgacgaaggcacaaccgcagaagaccgccgtctgaaacggaccgcaagacgccgctacacgcgacgcaaaaaccgcctgcgctacctacaggaaatctttactgaagaaatgtccaaagttgatatctccttcttccaccgactagatgactctttcctagtccccgaagacaagcgcgggtccaaataccccatcttcgcaacactagaggaagaaaaggaataccacaagaacttcccgactatctaccatctgaggaagcatctcgccgactccaaagaaaaagctgacttccgcttaatatacctagccctcgcccacataatcaaataccgcggccacttcctctacgaggagtcattcgacatcaagaacaacgacatacaaaagatattcaatgagttcatatccatatacgacaacacattcgaaggcagcagcctcaacggccaaaacgcccaggtcgaagccatcttcactgataaaatttcaaaatcagccaaacgcgaacgggtgctgaaactgttccccgacgaaaaatccaccggcctcttctccgagttcctaaaactcatcgtgggcaaccaagcggactttaagaaacacttcgacctagaagaaaaggccccgctgcagttcagtaaggacacatatgacgaagacctcgaaaacctcttggtccagatcggagacgacttcgcagacctgttcctcgtagcgaagaaactctacgacgcaatactcctctcaggaatccttaccgtaacggaccccagtacaaaagctccactgagcgcctccatgatcgatcgatacgaaaaccaccaaaaagacttagccgccctcaaacagttcatcaaaaccaacctacccgagaagtacgacgaggtcttttcagaccaatccaaagacggatatgccgggtacatagacgggaagacgacccaagaagccttttacaaatatatcaaaaacctactgtcaaaactcgaaggcgccgattacttcctagacaaaatagaacgcgaggacttccttagaaagcaacgaaccttcgacaacggcagcataccgcaccagatacacttacaagagatgaacgccatcatccgcagacaaggcgagcactacccctttctacaggagaacaaagagaaaatcgagaaaatcctgaccttcagaatcccgtactacgttggcccactcgcaagaggcaacagagacttcgcatggctgacaagaaactcagaccaggcaatacgcccatggaactttgaagaaatcgtcgacaaggcccgcagcgccgaagacttcataaacaaaatgaccaactacgacctgtacctgcctgaagaaaaagtcctaccgaagcactccctcctatacgaaacgttcgccgtctacaacgagctaacgaaggtcaaattcatagcggagggcctacgagactaccaattcctcgactctggccaaaaacagcaaatagtcacacaactgttcaaagaaaaacgcaaggtcaccgaaaaggacatcatccagtacctacacaacgtggactcttacgatggcatcgaactcaaaggcatcgaaaagcaattcaacgcaagcctatccacctaccacgacctactgaagataatcaaggacaaagagttcatggacgacagcaagaacgaagccatactcgagaacatcgtccacacactcaccatattcgaagaccgtgaaatgatcaagcaaaggctggcccactacgcatcgatattcgacgagaaggtgataaaagccctaaccagacgacactacacaggatgggggaagctcagcgcaaaactcattaacggcatctacgataaacaatccaaaaagaccatactcgactacctaatagatgatggggaaataaaccgcaacttcatgcaactaataaacgacgacggactgagttttaaggaaatcatccaaaaggctcaagtggtaggaaagaccaacgacgtaaaacaagtagtccaagaactacccggcagccccgcaattaagaaaggaatactacaaagcatcaaactcgtcgacgaactggtaaaagtaatgggacacgcccccgagtcgatcgtcatcgaaatggcccgtgaaaaccaaacgacagcccggggcaagaaaaattctcaacagcgctacaaaagaatcgaagacgccctcaaaaacctagcacacggactcgacagcaatatcctaaaagagcatccgacggacaacatccagctacagaacgaccggttgtttctgtactacctgcaaaacgggaaagacatgtacacaggaaagtccctggacatcaatcaactctcctcgtgcgacatcgaccacataataccgcaggcattcatcaaagatgattccctagacaatcgcgtgctgacatcgtccaaagacaacagaggcaaatccgataacgtaccatccctagaaattgtacaaaagcgaaaggctttctggcagcagctactcgactctaaactgatatccgagcgcaagttcaacaatcttacaaaagcagagcggggtggcctcgacgaacgagacaaagttggcttcattaaacgacaactcgtcgagacccgccaaataaccaagcacgtcgcccaaatactcgacgcgcggttcaacaccgaagtcaccgaaaaggacaagaaagaccggtccgtcaagatcataacactaaagtcaaacctagtgtccaacttccggaaagagttccgtctctacaaagtccgagaaataaatgattaccaccacgcccatgacccgtatctgaacgccgtcgtagccaaagcaattctcaagaaataccccaaactagaaccagagttcgtctacggagattaccagaaatacgacttaaaacgatacatctcgcgtaccaaagacccaaaagaagtcgaaaaggcaacggagaaatacttcttctactcaaacctactgaactttttcaaagaagaagtgcactacgcggacggcaccatagttaaacgagaaaacatcgaatactccaaagacacgggcgaaatcgcctggaacaaagaaaaggacttcgcaaccatcaaaaaggtgctatcactaccacaagtaaacatcgtcaagaaaacagaggaacagaccgtaggtcaaaacggtggacttttcgacaacaacatcgtatccaaaaagaaggtcgtcgacgccagcaagctaacgccgataaaatctggcctttccccagagaaatacggcggctacgcccgccccaccatagcctactccgtactcgttatcgccgacattgaaaaaggaaaagcaaagaaactcaaacgaatcaaagaaatggtaggcatcaccgtacaagacaagaagaaattcgaagctaatccaatagcgtacctggaggaatgcggctacaagaacatcaacccgaatctcatcataaaactcccaaagtactccctcttcgagttcaacaacggtcaacgaagactcctggcatcatccatagaactccaaaaaggcaacgaactgatcgtcccataccacttcaccgcgctgctttaccacgcccaacggataaataaaatctcagaacccatacacaaacaatacgttgagacccaccagtccgagttcaaagaactcctaacagccataatttcgctctcaaagaaatacatccagaaaccaaacgtcgaatcgctactccaacaagccttcgaccaatcagacaaagacatatatcagctcagcgaatccttcatctcgctcctcaaacttatcagctttggcgcgccaggcacctttaaattcctaggggtcgagatatcgcaaagcaacgtgcgataccagtcggtcagctcatgctttaacgcaaccctaatacaccaatcgataactggcctctacgaaactcgaatagacctatcaaaactcggcgaagattga

SEQ ID NO: 6664 - RNA, 4131 nt, synthetic construct
  misc_feature 1..4131: note = Cas9 variant
  source 1..4131: mol_type = other RNA
atggacaagaaatacggaataggactcgatataggcacctcgtcaataggatggaccgttgtagacaaatacggtcacataattcgtgtgaaagggcaaaccggcataggagtgcgtctgttcagggaaggccagacagccgcagaacgacgcactttccgaacaaccagaagacgcttatctcgccgacgatggagactccggctcctacgcgaaattttcgacgaacccatatctgcaatcgacgagaacttcttcgcccgccaaaaagcctcatccctggcaccaggagacgcgcgataccaacaggccttccaactatttaacgacaggaccgaccaggcgttctactgtaaataccccactatctaccatcttagacaagcactcatgactgaatcacgccaattcgatatcagggaaatctacctcgccctccaccagatcatcaaatatcgcggtcacttcctcctcggcggcgccgccaaggacttccagtcagacaaactcgacctcgaggcctacttcacgacaatcaacgcacaactcgccggcatatattccgacggaagtgtccaactccctaccctagactggaaccaggcctgccaagaactaacagacacctctcgaacccaatcagatcgcaagaactggttagtaaaggagctaaaatcctacggcgactcccaactcaagccaatatacacccaaattgccaacgctatcctcggattcaaaacagacctagccaagattatgggaatcaacgaccctgaaaaagccctctcattcaacttagacgcactcgacgaccaccgcgacgatgtcgcagagctgctcaccgacgaacagattccgttggtaaatcttctcgccaaactacacactgcactcgagctcgcagcaattctcccggacggacaaaccctatccggtaagatggtcgaaatttacgaaacgcacaggaaacagctcaaaacgtacaaggcctttatccgccagctgcccgatagacaacaacgcctagcacttaaacaggcatacgatcactacatcgaccaggggcttaaccgagaggctttctatagcgaagtcaaagctatcctagaaaaacagaagccacttaccgccacaggacaagcgatgaagaaagccatggaccaaaacgcattccttctaaaacagcgcacaaaaaccaatattgcgatcccataccaggtacaacaacaggaaatggaccaaataatcgccaaccagtctaaatactacccctggctcgcaacaccaaaccccgtcaaatcacgaagagttatcgccccttacaaactcgacgaactcgtatgcttccgtgtcaattactacgtcgggccactcgttcagagcaagcccggcgaagccaccaaggaagcgaagttcgcctggatgaccagaaaagacccacagtccaccgtcgccattaccccctggaatttcgaccagcaagtcgaccgtcaagccagcgcaaacgctttcatccaacgaatgaaaacaacggacacctacctcctcggcgaagatgtcatacccaaaaacagcctcctatatcaaaagtacgaagtgctaaacgaactcaacaacgtccgcgtaaacggcgactggctcgacccgcaacgcaaacaatacctatttaaaaagctattcatggaccagccacaatccgtcgtcaccgtcaaagctctacagaagacactcgtagtcatcggagcttgcccaacgctaccaacagtagaaggcctcgccaaccccaagagattcctatcacagctgaccacataccacgacttctgcaaactactccccgatgacatccaacgcgccgacagacaagccgacattgagaaaatcatcaactggtcgactatctttgaagacacagcaatcttcaaagaaaaactaagagacatcaagtggctctccgctgaccaaatacgacgcctcagcagcagaccgcggtacagggggtggggcagattcagcgccaaactactatgcggtctccacgatcgccaaggcaacacggtaatggacgaactctggcagacttctcgaaactttatgcagatcatcagacagtcggacttccagaccgccatagccgccgtaaaccaacaggatctcggccgccaagacctacaacgagttatagacgacctctacacatcacctcagaacaagaaggcaatacgacaagtattagccgttgtaacagacatacagaaagccatgcacgggaaagccccctcatggctattcgtcgaagtagccaaaggagcccaaaagaacccgcagcgcacccaatcacgccaatcaaagctagcggaggcttatagggagtccgcacgtgagcttgtagacgaagctgtgaaggaacagctactgaccctccccgacgaccgtcaaacgttctcagaccgacttgtcctatacttccaacagaacgggcgcgacatctacactggcgaaccgctggacttcgaacggctatcgaactaccacatcgaccatataatcccccaagccgtcgtcaaggacgactcacttgacaaccgagtactcacctctaaccaggccaacctagagaaaggagcccacgtccccacaatcttccgcgacaaacaagaacccgtttggcaagagctatacagggtcggcctaatctcccaccggaaactcaggaatctcctcacaacccccgacgaccttgacgaccgcggccgagccaccggcttcattgcacgccaattagtggaaacgaggcaggtaataaaactggtcatggaagtactcagccagtactacgacacaaccgaaactgaactcatatcgataaaggcagggctctcacaccagttccggcaagaactcaacctccccaaactacgcgccctaaatgactaccaccacgcgcaagatgcttacctcgcggcccgaataggcacatacttgctccaaagataccccaacctaaaacgattctttgtatacggcgacttcaagaaaacgcattttgacctccagaggcgcttcaattttattggtggcatgatctcacgagagaaacaaccatacaacctaataaagaacccggtgacccaccaagtcatatgggacgaagaaatggaaattggcgactgtcaaaagaaaaaccctgagcaaccgaaacacgacgccaccgtaaaaatgatgaatctaactaaaatcatgaatctaaaacatatactggtcactcatgaagtctacgaaaaccatggcgccctcttcaaccagacaatctaccccgcgtcgcaggcccataaaaagaaactcatcccccagaaaacagaaaagcccatcgagctttatgggggacacagcagcgagcaagctggctacatggccatcataagactgctcggaaaacgaccagggtataaagtcatgcgcgtgccagttagatacgtatcgcaactgcaacaccaggacgtcgccgaacagaagaaactcctgtacaagatctttgtatccgaactaacgtcccgcaacaaagtcaaaccattcgaagtagtcgtaccccatgtgtgcctaaaccagcccgtggaagacatgatcaagggacaatggcacagattcgctttaaggaccaacggctactaccaaaaccaacagcaactgattctcagcctcgtagcacagcgaaccctggcagggtacaagccaaaagacgacgaacttatggcagtctaccacgaaatctgtaaacaggtcaaatactactttcccctatacaaaatgaacaaattccaaagccgattattcgcagccgaggaattactccaaaagagatcaacagtaaacagcttcagcataaccataggtaaaaacggaaaagagaacaagaccctaaacctcggcaagcgcgagctactcctcaggctgctaggaggactacacgcaaacgccacacgcgtggacctcaaagacatcggatgtaccggccaattcggccaactacaagtcaaaaacggaataaagctcaccgagcaagctgttttaattcacgaaagcccaacaggcctgttccaccgccgagtcaggctgaacgacctttga

SEQ ID NO: 6665 - RNA, 4134 nt, synthetic construct
  misc_feature 1..4134: note = Cas9 variant
  source 1..4134: mol_type = other RNA
atgaccaaaaagaactatagcatcggactcgacatcgggacaaactcagtggggtgggccgtcataacggacgactacaaagtcccagcgaaaaagatgaaggtactcggtaataccgacaagaaatacatcaagaaaaacctactgggcgcactcctcttcgactccggggaaaccgccgaagcaacgcgactcaaacgcacggctcgacgacgttacacacggcggaaaaacaggcttcggtacctgcaggaaattttcgcggaagaaatgacgaaagtggacgagtccttcttctatagactcgacgagagctttctaacgaccgacgagaaggactttgaacgccacccaatctttggcaataaggccgacgagataaagtatcaccaagagttcccaaccatctatcacctccgaaaacacctcgcggacagtagcgaaaaagccgatcttcggctagtctacctggcactagcccacatgattaaattccgaggccacttcttaatagaaggcgaactaaacgccgagaacaccgacgtccaaaagatcttcgcagacttcgtcggagtatacgaccgaactttcgacgactcacacctctccgaaatcacagtagacgccgcatcaatccttacggagaaaattagcaaatcacgaaggctcgaaaacctaatcaagtattacccaaccgagaaaaagaacacactgttcggcaacctcatcgccctagccctcggactacaacccaacttcaagatgaacttcaaactgtccgaagacgccaagctccagttcagcaaagactcctataatgaagacctcgaagaactccttggcaaaatcggggacgactacgctgacctattcacgtccgccaaaaatctttacgacgcgatcctgctgagcggtattctcaccgtcgacgacaatagcacaaaagctcctctatcagccagtatgataaaacggtacgcagaacaccatgaagaccttgaaaaactcaaggagttcataaaagcaaacaagtctgaactctaccatgacattttcaaggacgaaaccaaaaacggatacgccggatatattgagaatggtgtaaaacaagacgagttctacaaatacctcaaaaacacactatcaaaaatagccggcagcgactatttcttggacaaaatcgaacgtgaagacttcctgcgcaaacaaaggacatttgacaacggcagcatcccccaccagatccatctacaggagatgcatgccatcctaaggcgccaaggtgactactatcccttcctaaaagaaaaccaagaccgaatagaaaagatactaaccttcagaataccctactacgttggccccctagcaaggaaagatagcaggttcagctgggcagaataccactcagacgagaaaatcacaccctggaacttcgacaaagtaatagacaaagaaaagtccgcggaaaaattcatcacccggatgaccctgaacgatctctacctacccgaagaaaaagtgctacccaagcacagccacgtctatgaaacttacgcagtttataacgaactcacaaaaattaagtacgtaaatgaacaaggcaaagactccttctttgacagcaatatgaaacaggaaatattcgaccacgtctttaaagagaaccgcaaagtgactaaagaaaaacttctaaactacctcaacaaagagttccccgagtaccgcataaaagacctaatagggctcgacaaagagaacaagtcgttcaacgccagccttggcacataccacgacctaaagaagatactcgataaagccttcctagatgacaaagtcaacgaagaagtgatagaggacattatcaaaacgctcacactattcgaagacaaggacatgatccacgagcgcctccaaaaatactctgacatttttaccgccgaccaactcaagaaactcgaacgccgccactacacaggatggggccgactttcctataaactcatcaatgggatccggaacaaagagaacaacaaaacgatcctcgactacctcatcgacgacggcagcgccaaccggaatttcatgcagctcataaatgacgacactctccccttcaaacaaatcatccaaaagagccaggtcgtaggcgacgtggacgatatagaagcagtcgtgcatgatttaccgggctcaccggcgatcaagaaaggaatcctccagtccgtcaaaatagtcgacgagctcgtgaaagtaatgggtgacaaccccgataacatagtaatcgaaatggccagggaaaaccaaaccacaaaccgaggccgtagccaaagccaacagcgtctgaaaaagctccaaaacagcctcaaagagctcggcagcaacatacttaacgaagaaaaaccgtcatacatcgaggacaaggtggagaactcacaccttcaaaacgaccaactcttcctatactacatccaaaacggcaaggacatgtataccggcgacgaacttgacatagaccatctctcagactacgacattgaccacatcattccacaagccttcatcaaagatgactcaatcgacaaccgcgtcctaaccagcagcgccaaaaaccgcggaaaatccgacgacgtaccctcgctggacatcgtaagagccaggaaggccgagtgggtacggctttacaaatcgggtctcattagcaagcgtaaattcgacaacttgacaaaagcagagcgcgggggactcaccgaggcggacaaagccggcttcatcaaaagacagcttgttgaaacgcgacagataaccaagcacgtcgcacaaatactagatgcgcgcttcaacacggagtccgacgaaaacgacaaagtcatccgcgacgtcaaagtgataacactcaagagtaacctagtgtcccaattccgtaaagacttcgagttctataaggtgcgggaaataaacgattaccaccacgcgcacgacgcatacctgaacgccgtcgtaggaacagcactactaaagaaatacccaaaactagcaagcgagttcgtctacggcgaatacaagaaatatgacgtacataaactaatagctaaatcgagcgacgatcattccgaaatgggcaaagccaccgcaaaatacttcttctacagcaacctcatgaacttcttcaaacgcgtcatccgatactcaaatggaaaagttatcgtacgcccggtagtagagtactccaaagacaccgaggacatagcttgggacaaaaagtccaatttccgcaccatctgcaaagttctcagttaccctcaagttaacatcgtgaagaaagtcgagacgcaaaccggcgggttctctaaagaatcaattctacccaaaggggacagcgacaaactcatcccaagaaagaccaaaaaggcttactgggacaccaagaaatatggaggattcgactcccccacagtcgcatattccgtgttcgtcgtagcagacgtcgaaaaagggaaagcgaagaaactcaaaaccgtcaaggagctcgtcggcatctctataatggagcgctcgtttttcgaagaaaaccctgtcgagttcttagaaaacaagggctaccacaacatccgagaggacaaactcataaaattgcccaagtactcactttttgagttcgaaggcggaaaacgtcgactcttagcctcagcgtcggaactacagaaagggaatgaaatggtaattcccggccacctggtaaaactcctctaccacgcccaacgcataaattcgtttaacagcacaaaatacctggactacgtatcggcccacaagaaagagttcgaaaaagtgttatcttgcgtagaagacttcgccaacctgtacgtcgacgtcgagaaaaacctctcaaagatccgcgcagtagccgatagcatggacaacttcagcatagaagaaatatcgaactctttcatcaatcttctaaccctcaccgcgttaggcgcgccagcagacttcaactttctcggagagaaaatcccccgaaagcgctacacatctaccaaagaatgcctcaacgccacactcatacatcaatccatcaccggcctatacgaaacgcgcatagacctctcgaagatcggcgaagaatga

SEQ ID NO: 6666 - RNA, 4134 nt, synthetic construct
  misc_feature 1..4134: note = Cas9 variant
  source 1..4134: mol_type = other RNA
atgaagaaaccgtacagtatcggactcgatatcggaacaaattctgtagggtgggccgtcataacggatgattacaaagtcccatccaaaaagatgaaggtcctgggaaacaccgacaagcacttcataaagaaaaaccttatcggggccctgttgtttgatgagggcaccacagcagaagatagacgcctaaaacgaacgagccgacgacgatacacccggcgtaaaaatagactccgttacctacaggagatcttcagcgaagaaatcagcaaactcgacagctccttcttccaccgactcgatgatagcttcctagtaccggaggacaaacgaggctccaaataccccatcttcgcgacacttgaagaggagaaagaataccataagaaattcccgaccatctaccatctgcgaaaacaccttgccgacagtaaagagaaaaccgacctacgactcatctacctcgcactcgcacacatgataaaatacaggggccacttcttatatgaggagtcctttgacatcaaaaacaatgacatacagaaaattttcaatgagttcatcagcatatacgacaacacgttcgaggggtcatccctcagtggccaaaacgcacaagtagaagccatattcacagacaaaatctcgaaaagcaccaaacgcgagcgagtacttaaactattttccgacgaaaagagtacaggcctcttcagcgagttcctcaaacttatagtcgggaaccaagccgacttcaaaaagcacttcgacctcgaagaaaaagccccgctccaattctccaaagacacctacgacgaagacctggaaaacttactcggacagataggagacggattcgccgacctgttcctagtagccaagaaattgtacgacgccatcctcctatccggaatcctaactgtcaccgatccatccacaaaagccccgctatccgcatccatgatcgaacgctacgaaaaccaccaagaggacctggcagccctaaaacaattcatcaaaaacaacctttccgagaaatatgcggaagttttcagtgaccaatcaaaagacggctatgcagggttcatagatgggaagaccacccaggaagcgttttataaatacatcaaaaacctgctctccaaacttgaaggagcggactacttcctaaacaagatagagcgcgaggacttcctccggaaacaaagaacttttgacaatggctcaatcccgcaccaaattcacctacaagagatgaacgcgatcttacgacgacaaggagagcactatctcttcctcaaagaaaatcgcgagaaaatcgaaaagattctcgccttcagaataccttactacgtcggcccactcgcaagaggcaaccgcgacttcgcatggcttacccgcaactccgatcaggccatacgaccgtggaacttcgaagaagtagttgacaaggcatcctcggcggaagacttcatcaataaaatgaccaactacgacctgtacctgcccgaagaaaaggtactgccaaagcactccctactttacgaaacattcgcagtgtacaatgagctaacgaaagtcaagttcatcgctgagggcctccgcgactaccagttcctggactcaggacaaaagaaacaaatcgtcaaccaactcttcaaagacaaaagaaaagtcaccgaaaaagacattatccattacctacataacgtggacggctacgatggcatcgaactcaaggggatcgaaaaacagttcaacgctagtctctccacgtaccacgacctcctcaaaatcatcaaagacaaggagttcatggataacccgaagaacggagaaatcctagagaatatcatccacaccttgacgatcttcgaagatcgcgagatgatcaaacaacgtctcgcacaatatgacacgctgttcgacgagaaggtcataaaggcactcacccgccgacactacaccggatggggcaaactaagcgcaaaactaatcaacggcatacgcgacaaacaaacaggaaaaacgattctcgaatacctcatcgatgacggggactgcaaccgaaatttcatgcaactcataaacgacgacggacttagtttcaaagagattatccaaaaggcacaagtggtcgggaaaacagacgatgtcaaacaggtcgtgcaagagatcccgggctcccccgcaatcaagaaaggaatattacaatcgatcaaaatcgtagacgagctcgtgaaggtcatgggccacaaccccgaatcaatcgtcatcgagatggcccgtgaaaaccaaacgaccgcaaagggcaagaaaaactcacaacaaaggtacaaacggatcgaagacgcacttaaaaacctcgctccaggcctcgactccaatattctcaaagaaaaccccactgacaacatccaactacaaaacgaccgcctcttcctctactacctacaaaatggcaaagacatgtataccggtaaagccatagacataaaccagctatcaaactacgacattgaccacataatacctcaggcatttatcaaggatgattccctggacaaccgggtactcacatccagcaaagacaaccgcggaaaaagcgataacgtacccagcatcgaagttgtgcaaaaacggaaagccttctggcaacaacttctggactcgaaactcatctcagaaaggaaatttaacaatctcaccaaagcaaaacgcggagggctcgatgaacgagacaaagtcggtttcatcaaacggcaactcgtagaaaccagacaaatcaccaaacacgtagcgcaactcctagacacacgcttcaatacagaagtgaacgaagagaaccaaaagatccgcacagtcaaaatcatcaccctcaagagcaatctagtctccaatttccgtaaagagttcgggctatacaaggtacgagaaatcaacgactaccatcacgcgcacgacgcatacctgaatgcggtggtagcgaaggcgatactgaagaagtacccaaaactcgagcccgagttcgtctacggagactaccaaaaatacgacctaaagcgctacatactgaaatcgaaagcctcgaacaccatcgacaaggccaccgagaaatacttcttctactctaacctgctaaactttttcaaggaaaaagtccgatacgccgacgggaccatcaagaaacgtgagaatatagaatattctaacgacacgggagagatcgcgtggaacaaagagaaagactttgcaaccatcaagaaagttctatccctcccccaggtaaacatcgtcaagaaaaccgaagaacagacagtcggtcagaacggcggactcttcgacaataacatcgtcagcaaaaagaaagtcgtcgacgcctccaaacttatcccaatcaaatcctccttaagcccagaaaaatacggcggctacgcgcggcctaccattgcctactcagtcctcgtaatcgccgacatcgaaaaaggtaaaggaaaagcgaagaaactaaaacgaatcaaagaaatagtcggaatcactatccaagacaagaaaaagttcgagtccaaccctgttacctacctcgaagagtgcggttacaagaacataaattcgaacctaatcatcaagctgccaaaatacagcctattcgagttcaacgacggacaacgccgcttgttagcatcatccatcgaactccaaaaaggtaacgaactcatactaccatatcacctgaccgcgctgctgtaccacgcacaacgaataaacaaaatctcggaaccaatacacaaacagtacgtcgaagcgcaccaaaacgagttcaaagaactgctaacaaccataatatccctgagcaagaaatatatacaaaagcccaacgtagaactacttctgcagcaagcgttcgaccaagccgacaaagacatataccagctctctgaatccttcatctctctactaaagctcacctcgttcggagcccccggcgcattcaaattcctcggagtagagataagtcaatccagcgtacgatacaagccgaactcccaattcttagacaccaccctgatacaccaatccatcacaggcctctacgaaacccgaatcgacctctccaagctcggagaggactga

SEQ ID NO: 6667 - RNA, 4134 nt, synthetic construct
  misc_feature 1..4134: note = Cas9 variant
  source 1..4134: mol_type = other RNA
atgaacaacaagccatacagcataggcctagacatcggaacaaacagcgtcggatggagcgtcataactgatgactacaaagtgccctcgaaaaagatgaaagtacttggcaacacagacaagcgattcatcaagaaaaacctcataggggccctcctgttcgacgagggaaccacagccgaggcccggcgcctcaaacgaacagcaagacggagatacactagaaggaaaaaccgactccgatatctgcaggaaattttcgccgaagaaatgtcaaaagtagacagctcattcttccaccgactagacgactcgttcctcatcccagaagacaaacgggggtccaaatacccgatcttcgccacgctagtcgaagagaaggaataccacaaacagttcccgaccatataccatctccgcaagcagctggccgatagcaaagaaaaggccgacttgcgcctaatctacctcgtcctcgctcacatgatcaaataccgaggacacttcctgtacgaagaagcctttgacatcaagaacaacgacattcagaagattttcaatgagttcatcagcatatacgataacaccttcgaaggctcatcactcagcggtcagaacgcccaggtggaaaccatcttcaccgacaaaatctcaaaatcggccaaacgcgaacgcgtccttaagctattccccgacgaaaaatccacagggctattcagcgagttcctcaaacttatcgtgggcaatcaggcagacttcaagaaacacttcgacttagaagaaaaggcacccctgcaattctccaaagacacctacgacgaagacttagaaaatctcctcgaacagattggcgacgacttcgccgacctattcgtcgcagctaagaaactatatgacgccatccttctctcagggattctaacagtaaccgacccctcaaccaaggccccactgtccgcgtcgatgatcgaacgatacgaaaaccaccaaaaagacctggcagttctcaaacagttcatcaaaaccaacctgcccgaaaaatatgtagaagtcttctcagaccaatcgaaagacggatatgccggctacatcgacgggaagaccacccaagaagcgttctacaaatacataaagaacctcctgtcgaaattcgacggggcggactacttcctagataaaatcgagcgcgaggtattcctccggaagcaacgaacgttcgacaacggctccataccacaccaaattcatctccaagaaatgaacaccatcctccgaagacagggagaacactacccctttctcaaagagaacaaagaaaagatcgagaaaatcctgacattccgaatcccctaccacgtaggacccctagctcgaggcaaccgagacttcgcctggctgacaagaaactcagaccaagcaatacgcccctggaacttcgaagagatagtagacaaggcttcctccgccgaagacttcatcaacaaaatgaccaactacgacctttacctcccagaagaaaaagtactgcccaaacacagcttactgtacgaaacattcgcagtatacaacgaacttaccaaagtgaagttcatagcagaaggaatgcgcgactaccaattcctcgactccgggcagaagaaaaagatcatcaatcaacttttcaaaaagaaaagaaaagtgacggaggacgacattatcgactgcttacagaaaatcgacaactacgacggaatagaactaaagggcattgaaaaacaattcaacgcttcactctccacttaccacgatatcctcaagattatccgcgataaagagttcatggacgaccccaaaaacggggacatcctagaaaatgtcatacacaccctcaccatctttgaagatagggagatgatcaaacaacggctcgcccagtataattccatcttcgacgaaaaggtcataaaggcactcagcagaaagcactacaccggatggggtaagctgtccgcaaaactcatcgacggcatcagagacaagcagaccggtaaaaccatcctagattaccttatggacgacggaaaaagcaacagaaacttcatgcaactaatcaaggacgacgaactttccttcactgagatcatccaaaaagcacaagtagtaggagataccgacaacctccgccaggttgtccaaaacctcccaggatccccagccatcaagaaaggaatcctccaaagcataaaaatagtcgacgagctggtcaaagtgatgggacacgccccagaatcaatcgtcatcgaaatggctcgcgagaaccaaacgacggcccgtggcaagaaaaactcacaacagcgctataaacgaatcgaggactcactcaaaaacctggcatccgggttagacagcaatatactaaaagaaaatcccacggacaacatacagctacagaacgatcggttattcctatactacctccagaacggaaaggacatgtacacaggggaagccctcaacatcaaccaactcagcagctacgacatcgaccacataataccccaggccttcatcaaagatgattcactagacaaccgagtactgacaagctccaaagacaacagaggcaagtcagacaacgttcccagtcttgaagtggtagagaagatgaaagcgttctggcagcagctactcgactctaaactcatctccgaacgcaaatacaacaacctaaccaaagcagagcgggagcgaggtggcctaaacgaacttgataaagtaggttttatcaagcgccagcttgtcgaaacccgacaaatcaccaagcacgttgcgcagatcctggatgccagattcaacaaagaagttaccgaaaagaataagaaaaaccgcaacgtaaaaataatcactctgaagtccaacatggtcagcaacttccgcaaagaatttgggctatataaagtccgagagataaacgactaccaccacgcccacgacgcctacctcaatgcggtcgttgctaaggccatactcaagaaataccccaagctcgaaccagagttcgtctacggagactaccagaagtacgacctcaagagatacatatcccgctcaaaagaccccaaggaggtcgaaaaggcaacggaaaagtacttcttctactccaacctcctcaacttcttcaaagaagaggtgcattacgccgacggaactatcgtaaagagggagaacatcgagtactccaaagataccggtgagatcgcctggaacaaagaaaaagatttcgcgaccatcaagaaggtgttatccctaccccaagtaaacatcgtgaagaaaaccgaggaacagacggtcgggcaaaacggaggcctgttcgacaacaacatcgtttccaaaaagaaagtggtggacgcatcaaaactcataccaataaagagcggactttcccccgaaaaatacggcggatacgcccgaccaacaatagcctactccgtcctggtcacctacaaacaaaacaacaaaattaagaacaccatggtagggatccccgtgctaacaaagctagagttcgaacgcgaccctaacctctacctacgcaacctaggaatcaacaacgtttcccatgtcatcaagctagtgaaatacacagtgctagaatttaaacataaatacggcacctacagacgcttcatcgtcagcaatcaagaacttaaaagagccaaccaaatattcgtaaccacaaagcagatgaagctgatctcccaatacaccacactagacaagaacgagcacgactcactgctcaaaaacaaccaacagctcatccaatctatatggaaccaattcctagagttcatgctcgcaaccgacctggtgaacaaaaagcaatacgacgagctgatactcacgaacaaccaaacgatcgaagagtgcagaaacatcatgaaccgcgttatcaccaccttatcattcacaaatatcaacgctggacagaaaaagatcattttcgacgacacgctctccctcccaataaaacgctggcaattcaccgacagcgacaagatggtcaaaaagatcatcgaatccactctcatccaccaatccatcactggtctctacgagacaaggatcgacctctctaagctgggtgaagattga

SEQ ID NO: 6668 - RNA, 4134 nt, synthetic construct
  misc_feature 1..4134: note = Cas9 variant
  source 1..4134: mol_type = other RNA
atggaatcaaaccacgacggcgaacaagtaaaatacacactaggactagacatcggaacttcgtctatagggtacgccgcaatagacaaacaccaaaaaccaatacgcgccaaggggaaacacgtaatcggagtacgactatttcaagagggccaaaccgctgccgatcgacgcgccttccgaaccacccggcgcagacttaagcggagaaaatggcgtctgaaccttctcaaccgtctctttgacccttacttgtccgaagtagatccgaacttcctcccccgcctgcgccaaagcaacctctccccaaaagacgacaacaagcacttcaacgggtccaccctgtttccggacaaaaccgacgccgccttttacaggcaataccccaccatgtaccacctacgctacgcactaatgactgagaaacgaaaatttgacatccgagaagtttacctagcaatccaccacatcgtcaagtacagaggcaacttcctaaacagcgccaccgtagactccttcaagacatctaacatagatttcacgagccaatttgaccgcctcaacgaattataccggcaagtgatcctagacgaacccttccaaatcaacatggatcaggtcgacgaaatgaccaacaaactcctcgacaacgacgcactcaagttagacacacaaaagcaagtcgccaaattgcttcccgtaatatacaacgataaacccatagacaagcagtacacacgcattgccaccgagttctccaaagcaatcctcggctataaaacgaaactcgacgtcatattaaacttggacacacagaacgcgaaagactgggtaatccgacttgacgacgaagatatagacgacaaactacccgccctagtagaaaacctcgacgagtcccggcaggaaattgtcaccatcatacgagatctttacgcccaaatcactctgaacgcgatcgtgcccaaaggcaagtctctctccgaaagtatggtagacaagtataacgaccacaaagaccaccttgacctcctcatgggactaatacatgagctaggcgacgactcagcaaaggggatcaaactccgggaagcgtatacccaatatgtagggaaatcagatgataagacactgaaccaagacgacttctacgccgccatcaagaaaaacctcgacgaggatagcaaacgcagcccaaaaatacagcgcctgattgaacaagccagcttcatgccgaaacaacgaaccagcgccaacggagttatcccacatcaactccaccaattagaattagaccggataatcgagaaccaggggcggtattatcccttcctaaagaaacccaaccccaacactcacaaacccaacggcggcaaatacaaactagacgaactggtcgcattccgaatcccctactatgtcggcccactaatcaccaaacgcgaccaagagaaaacatcaggtgccgacttcgcatggatgataagaaaacccggacaggaaggcgaaataacgccttggaacttcgaccaaaaagtcgacagaatggcctcggcgaacaggttcatccgaagaatgaccaccaaagactcttacctcgtagcagaagacgtcctacccgatgcctccctgatctacgaaaaatttaaagccctcaacgaactcaacatgctcaaagtcaacgacagcaggctctcgccctcccagaagcaagacctattcaataacctctttaagaaacagaaaacaatccgcacgaagaaactccaaacgtatatccgcaccaactgggaactcccatcagtgatgatctcggggctagccgacccggacaaattcaactcctcactcagcacttacatcgactttagagacatatttggagaaaaagtagacgatccaaaccgtcaagccgattacgaagaaatcatagagtggtctacagtctttgaagatcgtaaaatataccaagccaaactcaaccaactcgactggctgactgagccccaacgcaaagcattactaacaaaacggtacacgggatggggtcgactaagtaagaaactcctcaccggattgaaagaccagaatggggactcaatcctagaccaactctggaaaacaaacgacaactttatgcagatccagtctcgcgacgagttcgcaaaacagatacacgacgaaaacgccaaacaattccacgaagcaaacaacgtcgacgacatactagatgacgccttcacctcaccccagaacaaaaaggcaatcagacaagtggacaaagtcgtccaggacgtcgttaaagccgtgggatacgcccccgacaaaatagccatcgagttcacccggtcgctagaaaacaacccccaacgaacggtcagtcggcaacgccaactccaagcagcgtacaaaaacattccaagagaaatcatgaaaagcggtctcatggccgaacttggctccgtagccgactcgaagaaggtcctatccgacaaactatatttatactttacccagatggggaaggacatgtacgaagacaaaaccataaacattgacaacttaccaaactacgacatcgaccacattttgccccaagcctttataaaagacgattcgatagacaatcgcgtcctaataagcaaagaggaaaatgctcgaaaatcaaaccgagtccccctcaaattcttcggcgccaagcgcatgggcttctggaaagacctgctcaacaacggcctaatctcaaaccgaaaattccaaaacctaactacagaccccgagaaaatcagtaaatactcagcgaaggggttcatccaccgacagctcgtggaaacctcccaggtaatccggcttgtagccaacatcctcggaaacgagtactcccaggcgggcaccacaatcatcgaagtaagtgcaaaaatgaaccgacaattacgcgaggactttcacctaatcaagaatcggaacgtcaatgactatcaccatgccatggacgcctacctaacagcttatgtcggggactacctgtacctgcgctaccccaagctcaggccgtacttcgtctacggagacttcaagaaggccgaagaccaggacctcaacatcagaaacttcaacttcctccacgacctcaaagacaatgaaagcctcgacaaaatagtcgacagcgaaaccggggagatagtctgggaaaaacacggcagcgtaaagcaactcaagaaggtctaccactataaattcatgctagtgtcccaagaggtttatacccgtcaggacgccctcttcaaccagacaatctaccccgcctcagatgctgacaaacgcaaactaatccccatcaaaaactcaaaacccgtcgacgtttacggaggatattcaggcaatatcgatgcgtacatggccatcgtcagagtccacggaaagaaagaagacaactacaaagtagtcggaatccccatgagagcagttaccaagctgaagaaagccgaaaaagaaggccacgacagctacctcaacgcagtacacgaagttcttaaaccacaattcactaaaaagaagaaaaaccgaaaaacaggagagatcaccgaaaccgtcgatgagttcgatgtcctgctcggtaaggtatactaccggcagctgattgtcgatggaaacaaaaagttcatgctaggatctagctcctaccaatacaacgccaaacaactcgtcctatccgataaggcaatgcaagtactctccaagaatggaaaagtaaagtcacaagacgaaaaccagaaccttatagacgtatatgacgaaattctagaaaaagtagatcaatacttcgaactgtacgaccaaagacactaccgggaatccctccacaaaggccgcggcatattcgtcaacttacccctttccaaccaatacgatggatccaaactaacctcatacggaaagtacgagaccatcgatgccatattaaacggcctgcacgcaaacgccaccatgagcaacctacgataccttggcataagcagccccttcggaaaaatgcaggcaagcaacgggctcaccatagatccagacagcataatctgctaccagtcgcccaccggacttttcgaacgtcagatcaaactcagcgatctctga

SEQ ID NO: 6669 - RNA, 4134 nt, synthetic construct
  misc_feature 1..4134: note = Cas9 variant
  source 1..4134: mol_type = other RNA
atgaataagccctactcaattggcctggacataggtacgaactccgtcggctggtctataattaccgacgactacaaagtgccagcaaagaaaatgcgcgtactgggcaacaccgacaaagaatacatcaagaaaaacctaatcggagcactccttttcgacgggggcaataccgccgcagaccggaggctaaagcgcacagcccggcgcaggtacactcgaagacgcaaccgtatcctgtatctccaggagatcttcgctgaggaaatgtctaaagtggacgactcctttttccaccgcctggaggacagcttcctagttgaagaagacaagagaggcagtaaataccccattttcgccacgatgcaggaagaaaaatactaccacgaaaaattcccaacgatataccatctgagaaaggaactagccgacaagaaagagaaagccgacctgcgtcttgtgtacctcgcactcgcacatatcatcaaattcagaggccacttcctaatcgaagatgaccgattcgacgtacgaaacaccgacatacaaaagcagtaccaggccttcctggaaatcttcgatacgacattcgagaacaaccatctgctatcccagaacgtggatgtagaggcgattctcaccgataagataagcaaaagcgcgaagaaagaccgcatactagcccaatacccaaaccagaaaagcactggcatcttcgcggagttcctcaaactcatcgttggcaaccaagccgacttcaagaaacacttcaacctagaagacaaaacacccttgcaatttgctaaagattcatacgacgaagacctcgagaacctgctcgggcaaattggagacgagtttgcggacctcttcagcgtggccaagaaactttacgacagcgtattgttatccggcatcttaacggtcaccgacctatcaaccaaagcgcccctctccgcctctatgatccaacgctatgacgaacaccacgaggacctcaagcacctcaagcagttcgtcaaagccagcctccccgaaaactaccgcgaggtattcgcggactccagcaaggacggctatgcaggctacatagaagggaaaaccaaccaagaggccttctacaaataccttctaaagctcctgaccaaacaagaggggtccgagtacttccttgagaaaatcaaaaacgaagacttcctccgcaagcaacgcacattcgacaacgggtcaatacctcaccaagtccacctcaccgaattacgggcaatcatccggcgtcaatcagaatattacccatttctaaaagagaaccaagaccggatcgaaaagatcctaacatttcgaataccatactacgtcggcccactcgctcgcgaaaaatcggacttcgcctggatgactcgcaaaacagatgatagcatacgcccgtggaacttcgaagacctagtcgacaaagagaagagtgccgaagccttcatacaccgcatgacaaacaacgacctctatctacctgaagaaaaagtactacccaaacactccttgatatacgaaaagttcaccgtgtacaatgaactcacaaaggtcaggttcctagcggaaggatttaaagacttccaattcctcaaccgcaaacaaaaagagacgatcttcaactccttattcaaggagaagcgcaaggtcacagaaaaggacatcatatcgttcctaaacaaggtggatggctatgaaggcatcgctattaaaggcatagaaaaacagttcaacgcctcgctatccacctatcacgacctcaaaaagatactcggcaaggacttcctagacaacacagacaacgagctaatcctggaagacatcgtgcagacactcaccctattcgaagacagagaaatgataaagaaatgcctagacatatacaaagacttcttcacagagtcacaactcaagaaactctaccgccgccactataccggatggggccgcctttccgctaaacttatcaacggaattaggaacaaagaaaatcagaaaacaatactggactacctcattgacgacggcagcgccaaccgcaacttcatgcaactcatcaacgacgacgacctctccttcaaacccattatagacaaagcccgcacgggcagccattctgacaacctcaaagaggtggtcggcgagctcgcaggctcaccagcaatcaaaaaggggatactacaaagcctgaagatagtcgacgaattagtcaaggtcatgggctacgaaccggaacaaatagtggttgaaatggcacgagaaaatcaaaccacggctaaaggcctatcacggtcaagacagcgcttgaccacactacgcgagtccctggcaaacctgaaatcaaacatcctcgaagaaaagaaacccaaatacgtaaaagaccaagtcgagaatcaccacctctccgacgacaggctgttcctctactacctccagaacggacgggacatgtacacgaagaaagcgctagacatcgacaacctcagccaatacgacattgaccacatcattccacaagcattcatcaaagacgactcgatagacaaccgggtacttgtctcctccgccaaaaaccgaggcaaaagcgacgacgtcccctccattgagatcgtcaaggcgcgtaaaatgttttggaagaatctgctcgacgccaaactcatgagccaacgcaagtacgacaacctaacaaaagccgagcgtggaggacttacttccgacgacaaagcccgctttatccaacgccaactcgtagaaacgcgccaaataacaaaacatgtcgcacgcatccttgacgagcggttcaacaacgaagtagacaacggtaagaaaatatgcaaagtaaaaatagttacactcaaatccaacctcgtgtctaactttcgcaaagagttcggattctacaaaatccgcgaagtcaatgactaccaccacgcccacgacgcgtaccttaacgccgtcgtcgcgaaagccatactcacaaaatacccccagctcgaacccgaatttgtctacggcatgtaccgccaaaagaaactcagcaaaatagttcatgaagacaaagaagaaaaatactccgaagccacccgaaaaatgttcttctactccaacctcatgaacatgttcaaaagagtcgtgcgcctagcggacggctccatcgtagtccggcctgtcatcgaaaccggacgatacatgcgcaaaacagcgtgggacaaaaagaaacatttcgctacagtccgcaaagtgctctcctacccccaaaacaacatagtcaaaaagactgaaatacaaacagggggattcagcaaggaatcaatacttgctcacggaaactcggacaaacttataccgcgcaaaacgaaggacatatacctcgatccaaagaaatatgggggcttcgactctccgatcgtggcctactctgtcctcgtcgtggccgacatcaagaaaggcaaagcccaaaaactaaaaacggtaacagaacttctcggaataaccatcatggaacgcagcagatttgagaaaaaccccagtgcattccttgaaagtaaaggataccttaatatccgcgacgacaaactcatgatactacccaaatactccctattcgaactcgagaacgggagacgacgccttttagccagcgccggtgaactacaaaaaggcaacgaattagctctgccgacccaattcatgaaattcctttatctcgcgtctcgatacaacgaatccaaaggaaaacctgaggagatcgaaaagaaacaagagtttgtcaaccaacacgtgtcctacttcgacgacattctccaactcatcaacgatttctcaaaacgtgtcatactcgctgacgccaacctcgagaaaatcaataaactgtaccaagacaacaaagaaaacatccccgtggacgagttagcaaacaacatcatcaacctattcacttttacgagcctcggggcacccgccgcattcaagttcttcgacaaaatcgtcgaccgaaaaaggtatacctcgacaaaggaagtcctcaattccacactaatacaccaatccattaccggcctctacgaaacacgcatcgacctcggcaagctcggtgaggactga

SEQ ID NO: 6670 - RNA, 4134 nt, synthetic construct
  misc_feature 1..4134: note = Cas9 variant
  source 1..4134: mol_type = other RNA
atggagaaaacctactccataggactcgatataggaaccaactcagtaggctgggcggtgatcaccgatgactacaaagtcccagcaaagaaaatgaaggtactcggcaataccgacaagaaatacattaagaagaacctactcggcgccctcttattcgactcgggggagacggccgaagccactcggctgaagcgagccgcacgccgacgctatacaagacgcaaaaatcgactgcgatacctacaagagatcttcgccaaggaaatggcgaaagtggacgagagcttcttccaaaggctcgaagagagctttctgaccgacgacgataagaccttcgactcacaccccattttcggcaacaaagccgaagaagacacataccatcaggagttccccacaatctatcacttacgaaaacacctagcagactcaccagaaaaagtagacctgcggttagtctacctcgcactcgcacatatgatcaaattccgtgggcacttcctcatagaaggccaactaaacgccgaaaataccgacgtccagaaaatattcgccgactttgtcggagtctacgaccgtactttcgacgatagccacctatcggagatcacagtcgacgccgcgagcatactgacagagaagatatccaagagccgtcgactcgaaaacttaatcaaacaatatccaaccgagaagaaaaacacactcttcggaaatctcgtcgcactagcgcttggactccaaccaaacttcaagaccaatttcaaattgagtgaggacgccaaactacaattctcaaaagacacctacgatgaagacctggaggaactactcggaaagataggcgacgactacgccgacctcttcacagccgccaaaaacctctacgacgccatcctcctctccggaatcctaactgtggacgataactcaaccaaagccccactctcggcctctatgatcaagcgctacgaagaacaccacgaagatctggagaaactcaaaaccttcattaaagtaaacaactttgataagtaccatgaaatcttcaaagacaagtctaagaacggatacgccggatacattgaaaatggcgtaaaacaggacatcttttacaaacacctgaagtcgattataagcgagaaaaacggcggccaatacttcctagacaaaatcgaacgcgaagatttcctcaggaaacaacggacattcgacaacggtagtatcccctaccaaatacacctccaggagatgcgtacgatactgcggcgccaaggggaatactaccccttcctgaaggaaaaccaggccaagatcgagaaaattctcacattccggataccctactacgtcggccccctagcccggaaaaactcccgcttcgcctgggccaagtaccattccgacgagccaataaccccgtggaatttcgatgaagtggtcgacaaagagaaaagcgccgaaaaattcataacacgcatgacactcaacgacctgtacctccccgaagaaaaagtactcccaaagcattcctatgtctatgaaacattcgccgtgtacaacgaactgaccaaaatcaagtacgtaaacgaacagggtaaatcgttcttcttcgacgccaacatgaaacaggagatattcgatcacgtcttcaaagagaaccggaaagtgaccaaagcgaaactcctatcctatctcaataatgaatttgaagagttccgaatcaacgatttaatcggcctggataaagacagtaaatccttcaacgccagcttgggcacttaccacgatctcaagaaaatactagataagagctttctagacgacaaaaccaacgaacagatcatagaagacatagtcctgaccctcacgcttttcgaagaccgggacatgatccacgagcgactccagaaatacagcgacatctttacatcccagcaactcaagaaactggaacgacgtcactacacagggtggggacgattgtcgtacaaactcatcaatggaatacggaataaagagaacaacaaaaccatcttggacttcctcatcgacgatggggacgccaaccgcaacttcatgcaactcataaacgacgactccctttccttcaaaacgacgatccaagaggctcaggtggtcggcgacgtagacgacattgaagcggtagtacacgacctcccagggtcccctgccatcaaaaagggcatactgcagtctgtcaaaatagtcgacgagctggtcaaagtcatgggccacaacccccagaacatcgtgattgaaatggcccgcgaaaaccaaattaccggatacggacgaaacagatcgaaccagcggctcaagcgcctacaagacagccttaaggagttcggaagtgacatacttagcaaaaagaaaccctcgtatgtagacagcaaagtcgaaaactcacatctccagaacgaccggctattcctgtactacatccaaaacggcaaagatatgtacacgggggaagaactagacatagatcacctgtcagactacgatatcgaccacattatcccgcaggctttcataaaggacaactcaatagacaaccgcgttcttacctcatcggctaaaaaccggggtaagtccgacgatgtcccctcgatagagatagtaagaaaccgaaagagctactggtacaaactatacaaatcagggctgatcagcaaaaggaaattcgacaacctcacaaaagccgaacggggaggactcaccgaaactgacaaggcgggatttataaagagacaacttgtcgagacccgtcaaatcacgaaacacgtcgctcaaatcctagacgcacgtttcaacaccaaatgcgacgaaaatgacaaggtaataagggacgtcaaggtcatcacgctgaagtcctcgcttgtgtcccaattcaggaaagagttcaagttctacaaagtccgggaaatcaacgactaccaccacgcccacgatgcgtacctaaacgccgtagtgggtacggcgcttctcaagaaatacccaaaactagcgcctgaatttgtatatggggaatacaagaaatacgacgtccgaaagctagtcgctaaatccagcgacaaccacagtgaacttggcaaagcaaccgccaaatacttcttttactccaacctgatgaacttcttcaaaaccgaagtcaaatatgcagatggccgagtcttcgaacgacccgacattgaaaccaacgcggacggtgaagtagtatggaacaaacaacgggacttcaacatcgtacgcaaggtcctcagctacccccaagtgaacatcgtcaaaaaggtcgaagtacaaacaggaggattctcgaaggagtcaatactacccaagggcgactcggacaagctcatcccccggaaaacaaagaaactccagtgggaaacacaaaagtacggtggattcgactccccaacagtcgcgtacagcgtcctcgtagtagccgacgtagaaaaaggcaagaccagaaaactaaaaactgtaaaagaactggtcggcatttccataatggaacgttccagcttcgaggaaaacccagtcagcttcctggaaaagaaaggataccacaacgtacaggaggacaaactcattaagctgccaaaatacagcctgttcgagttcgaaggcgggcgacggcgtctcctagcgtcagccactgagctgcaaaagggaaacgaggtagtactaccccaatacatggtcaacctcctctaccacagccaacacgttaacaacagccataaacccgaacacctaaactacgttaagcaacacaaagacgagttcaaggacatttttaacctcatcatcagtatagccagaatcaacatactgaaaccgaaagtggtagataatctcataaacgagttcaccgaatacggtcaggaagacatatctagcctgtcagaatcattcatcaatctgctcaaattcatctcctttggagctcctggagctttcaagttcctaaaacttgacgtgaaacagtccaacctccgctacaagagcacaaccgaagcactgtccgccacacttattcaccaaagcgtaacaggtctatacgaaacacgaatcgacctaagcaaactaggcgaggaatga

SEQ ID NO: 6671 - RNA, 4137 nt, synthetic construct
  misc_feature 1..4137: note = Cas9 variant
  source 1..4137: mol_type = other RNA
atgaaaactttcgccgaggagtacgtaatggataaatcaaaaccctacggcataggactggatatcggcaccaattcagtcggcttcgttgcaacagacgcagaaggacacctaatacgcctcaagggaaagaccgtaataggcgcatacctgttcaacgccggtatcagcgccgcagagcgaagaggattccgtacaacacgaaggcgactctcaagggtcaaatggcgacttggactcctgcgagagatattcgaaacccacttccaggagtcgatgggtgagaatgaagacaacgactttttcctccgattcaagtactcgaatatatcaccaaaagatccgcagttttccacagcaaagggcctattcaacgaccgcaccgataaagagttttacgatcaatacccaaccatctaccatctacgacgcgccttaatgactgaggaccatcaattcgacatacgggaaatctacatagcaatgcaccacatagtcaagtaccgcgggcactttctcaaagaaggccgagccaaagacttcaaggtcggagatctccgcctcctggacaacttcaagatgatgaacgagcaaatagaagaaataaaccccctatggcaactaaaactaccaaccgacgacgcgagcatcaaatccataacagcaatactcctcgacaacacccaaagtcaaaacgacaggcagaaagcagtaactaaagtgattctcgcgaccctcgttaaggcctcagacaaagatatcaacgccgcacgcaaacgctttgtaggcgaactcagtaaggcgatggtcgggctgaagactaagctatgggtgcttgcagacgtctcccagaacggcgactgggaaataaaatacgaaaactatgcggacttcgccgagacaattggcagcggcgaaagcgatacaatccaaagtcttttcaacgaaattaacgacctatacggtgtcatcacgctcgccggaataatacccaaagaagcggaatcattcagcgacggaatggtgcgaaaatacgaacaccatcggaaaaatctagaactcctcaaggtatactgtgcagaacagagcgacggcaaaagagggcgccaaatcagacaaacctatgacaagtacatagacggggtagacagcaagcaattcactcaagaagacttctacaaggccctgagcaagttcacggccaaggatgaagcaacctccgagaacgccaaacttatcgcccaggaaatcgccgtcggcacgttcatgccaaagctccggacaaaggcaaacggcaccataccacaccagctgcaccaaaaagagcttgacgcgatcatagaaaatcagaagaaatactacccctggttgggcgaagtcaatccagtggagtcccaccgacgcgcccttccatacaaactagatgaactcgtctccttcagaatcccctactacgtcggcccgatggtgacccccacgaaaggagaccctgagaaaagcaaattcgcctggatggttagaaaagaaccagggaccatcaccccctggaacttcgatcaaaaggtcgatcgctccgcgtcaggagaagcctttattcagcgcatgaaaacgacagacaccttccttattggagaagacgtcctaccgcagcaaagtcttctgtatcaaaagttcgaggtactgaacgaactaaacaagatcatgatcaacggcaaaccaatctgcagggaacagaaacaaagactcttcaaacaacttttcatgcaatacaaaacagtcacggtgaagaaagttcagcaaaacctcatcgcaaacggagaagagagcgaaaacgtccctatcaccggcctctctgaccccctcagattcaactcatccttcagcacatacatagattataaagacatcctaggcacagcagcagtaaacgacaacgccaaacaatccgatattgaacaaataatcgcctggagcacaatattcgaagacgccgccatcttccgcgaaaaactgaacgacataacatggctgaacgacgaccagcgaaataaactttcgcacaaacgatacagaggatggggcagacactcccgaaaactcctagcgggactccgggacggcgaagggcaaaccatcatagaacgtctttggaacaccaacgacaacttcatgcaaatacagaatgactccgagattgcacgccaaatcacagaggccaacagcagcaaaatggcaaccgcagagggcacagacgaaataattgacggcttttacacatcccccgagaataagaaagctctacgagaagtcatgaaagtagtcaaagacatccagagagcacaccacggccaagccccggcctgggtctacatcgagtccccacgggagacaccccggccgggccaacgcaccgtctccagagagcagcaactaaccgacttatacgagggagcggcaaaagagatagtcgacgacgcagtcctcaacgaacttaaagataaagtaaaaagcaaagagaacttcactgacaagctagtcctctacttcctccagaacggccacgacatctacgccaacgactcaataaacatcgacaacctaaacgcctacgacatagatcacgtgctcccccaatcgctaataaaggacgactcactagacaatcgcgtcctcaccacccacgaacggaacctcaaaaagtccaaccgcttcgcaacagaactattcgccgaccaacgtaagaaatgggaaaaatggcacaggctcgggctcatctcatcccgaaaactaaaacacctaaccatgcaaccaaactcggtcgagaaattcgcacacggatttatcgcaagacagctcacagaaaccaggcaaataatccacctcactgcaaacgtgctctcaaacctctaccaagagaacgacaccaaaatcgtcatgatcaaagccgggctcaatagcgagttccgacgaacattcgacttcccgaagaacagatcagtaaacgactaccaccatgcattcgacgcatttctcaccgccaaaatcggtcgttacctccttgctcggtaccccaaacttgaacccttctttgtctacggcaactttgtgaaaaacccgaaggcaatgaaaagactctccagcttcgacttcatagcccaactagccgcaaaaaccgacgatacctcccatatcgaccaacgctcgctaaaacaggtaccagtggtaaacgaagaaacaggcgaaattgtttgggacaaagatatcgaactagcagagctcgacaagacatataattataaaaccatgctagtcaagcgagcacaaaccgaaaacaatgcccaaatgttcaagcaaacggtcttcaaagcccgagacaaccaaaacaaaacgctcataccagtcaaaaacgggttatccacagacgtctacggcggccatagccaacaagccatttcatatctgtgcatagtatgggtaggccaaaagaagaaataccgagtcctcggtatatcaaccgcccacgccgggattctgaacaacttcgagaaaaactacggtcggttcgaagcgaaaaagaaactacaagaaatcgtgtcgaacacgctcgacaacgcagaccgcaatgacttcaagatcgtcgcacccaaagtactcttcgaacaagtcgtggaagacgacaacatgaaattcggcctaggatcggccagcgactaccgaaatgtccaacaactcttcctaagtcgcaaaaaccaactcctgctcgcaaacatgatgaccgaccaaatacacgaccaggacctcgtccacctattcgacgaaattgtgggccagatgaacgcacatttcccgatatttgaccgcggcgggtaccgcagcagcttgacacagtcgcgcgacaagttcctcaaacttccgtttaagaagaacgaagaccttataaccaaacaggaggttattagacgcatactagacggcctccatgccaacgccaaccgtaaggatctaaagataatcggctccaagggcgatttcggccgactcggcaccaagaagatctacctgtccaaggacgccaaactcatctatacaagtccgacctgcctgttcacgagaacggttcccctctcctctctctga

SEQ ID NO: 6672 - RNA, 4137 nt, synthetic construct
  misc_feature 1..4137: note = Cas9 variant
  source 1..4137: mol_type = other RNA
atgaccaacgaaaaatactcgatcggcctagacatcggcacgtctagcataggcttcgcagtcgtaaacgacaataacagagtcatcagggtgaaaggcaaaaacgccataggcgtccgactatttgacgaaggcaaggccgctgccgaccggcgatccttcagaaccaccagaagacgcctgtcccgcaggcgatggcgcctcaaactgctgagggaaatctttgacgcgtacatcacccccgtcgacgaggcgttcttcatcaggctaaaagagagcaatctctccccaaaggatagcaagaaacaatattcgggggacattctgttcaacgaccgaagcgacaaagatttctacgagaagtacccaaccatatatcatctgagaaacgcactaatgacagaacaccgcaaatttgacgtccgcgagatatacctggcgatacaccacattatgaaattccgcggccacttcctgaacgcgacgcccgcaaataatttcaaagtggggcgacttaatctcgaggagaaattcgaagaactcaacgacatataccaacgcgtcttccccgacgaatctatagagttcagaaccgacaacctcgaacaaataaaagaagtcctactagataacaaacggtcccgagcagacaggcaacgcacacttgtcagcgacatctaccagtcgtccgaggacaaggacatcgagaaacgaaataaggccgtagccacagaaatcctcaaagcatccctcggaaacaaggctaagctcaatgtcattacaaacgttgaagttgacaaagaggcggccaaggaatggtccataaccttcgactcagaatccatcgatgacgacctagccaaaatagagggacaaatgaccgacgacggccacgaaatcatcgaagtgttacgctcgttatacagcggcatcacactatccgcaatcgttccagaaaaccacactctctcccagagtatggtagcaaaatacgacctccataaagaccacctgaaactcttcaaaaagctcatcaatgggatgacagacacgaagaaagcgaaaaacctacgggcagcctatgacggatacattgacggtgtcaaaggcaaagtcctaccccaagaggacttctataagcaggtccaagtcaacctcgacgactccgccgaggctaacgaaatacagacatacatcgaccaagacatcttcatgccgaagcaacgcacgaaggctaacggatcaataccacaccagcttcaacaacaagaactagatcagataatagaaaaccaaaaggcctactatccatggcttgcagagctaaatccaaaccccgacaagaagcggcaacagctcgcaaaatataaactagacgaacttgtcacgttccgcgtcccctactacgtcgggcccatgatcacggctaaagaccaaaagaaccagtccggggcggagttcgcctggatgatccgcaaggaacccggaaacataacaccatggaatttcgatcagaaagtagataggatggccacagccaatcagttcatcaaacgcatgactacaacagacacatacctactgggagaggacgtactcccagctcagtcgctcctgtaccaaaaattcgaagtgctgaacgagttgaacaagatacggatcgaccacaaacccatctccatcgagcaaaagcaacaaatattcaacgacctattcaaacaattcaaaaacgtaacaatcaaacacttacaagactatctagtttcccaaggacaatattccaagcgtcctttaatcgagggcctcgccgacgagaagcgcttcaactcatccctaagtacatactcggacctctgcggcatcttcggcgcgaaacttgtcgaagaaaacgatcgccaagaggacctcgagaaaatcatcgaatggtccacgatcttcgaagacaagaaaatataccgcgcgaaactaaacgacctaacctggctaacagacgaccaaaaagaaaaactcgccaccaagcgataccaagggtggggccgactaagccgcaaactactcgtgggactcaaaaactcggaacaccgcaacatcatggacatactatggatcactaacgaaaatttcatgcaaatacaggccgaaccagactttgcaaaactcgtcaccgacgccaacaagggcatgctcgagaaaaccgactcccaagacgtgataaacgacctgtatacatctccccaaaataagaaagccatacgccaaatcctcctcgtcgtccacgacatccaaaacgccatgcacggccaagccccagctaaaatccacgtcgagttcgcccgaggggaagaacgaaatcctcggcgctcagtccaaagacaaagacaagtagaggccgcctacgagaaagtctccaacgaactggtttccgcaaaggtccgccaagaatttaaagaagcaatcaataataaacgcgacttcaaagaccgcctactcctctacttcatgcaagggggcatcgacatctacacgggtaagcaactaaacatcgatcagctttcgtcctaccaaatcgaccacatcctcccccaggccttcgtcaaagatgactcgctaaccaacagagtacttacaaacgaaaaccaagtgaaagcggactcagtaccaatagatatcttcggcaagaaaatgctaagcgtgtggggcagaatgaaggaccaaggactaatatccaagggcaagtaccgaaacctcacgatgaacccagaaaacatctcagcccacacggaaaacggtttcatcaaccgccagctagtggagacacggcaagtgatcaagctcgccgtgaacatattagccgacgaatacggcgactctacacaaatcatcagtgtcaaggcggacctatctcaccaaatgagagaggacttcgaactcctcaaaaacagagatgttaatgactaccaccacgcgttcgacgcgtacctagcggcctttatcggcaactatctcctcaaacgatacccaaaactagaatcttacttcgtctacggggactttaagaaattcacgcagaaagagaccaaaatgcgacgattcaatttcatatatgatctcaaacattgcgaccaagtcgtcaacaaagaaacaggcgagattctatggacaaaagacgaagacatcaaatacatacgacacctctttgcatacaagaaaatactcgtatcacacgaagtccgcgagaaaagaggagccctctacaatcaaacgatctacaaagcaaaagacgataaggggagcggacaaggctccaagaaactcatacgaataaaagatgacaaagaaacaaaaatatacggtggctattccggaaaatccctggcgtatatgacgatagtgcaaataacgaagaaaaacaaagtctcgtaccgagtgattggcataccaactctcgccctagcccgcctcaacaaactggaaaatgactctacggaaaataacggagaactgtacaaaataataaagccgcaatttacacactacaaggtagataagaagaacggagaaatcattgagaccacagacgatttcaagatcgtggtcagcaaagtccgcttccagcaactcatcgacgacgcaggccaattcttcatgctcgccagcgacacctacaagaacaatgcgcaacagctcgtaatctcaaacaacgcactcaaagctataaacaatacaaacatcacagactgtcctcgagacgatcttgaacgcctggacaacctacgcctagactcagcattcgacgaaatcgtgaagaaaatggacaaatattttagcgcgtacgacgcaaacaacttcagggagaaaatacgaaactcgaacctgattttctatcaactcccagttgaagatcaatgggaaaataacaaaatcaccgaactcggaaagcgaacggtcctcacccgcatcctacaaggcctccacgcaaatgcaaccaccaccgacatgtcaatctttaaaatcaaaacacccttcggccaactgagacagcgatccggcatatcactctccgaaaacgctcagctcatataccagagcccaaccggacttttcgaacgacgcgtccaactaaacaaaatcaagtga

SEQ ID NO: 6673 - RNA, 4137 nt, synthetic construct
  misc_feature 1..4137: note = Cas9 variant
  source 1..4137: mol_type = other RNA
atgaagaacaaggactatagtatcgggctggacataggaacttcatccataggcttcgcagtcgtcgacgaaaacaaccacgtgatgcgcgtgaagggcaaaaatgcaatcggcgtccgtctattcgacgaaggaaaacccgcagcagaccggcgagcgttcagaaccacacgccgccgcctctcgcgcagaagatggcgactaaagctactcagagagatattcgacagctacattacacccgtagacgaggccttcttcatccgcctaaaagaatcgaatctctcacccaaggactccaagaaacaatattcaggagacatcctcttcaatgaccgatccgacaaggacttctacacaaaatacccgaccatctaccatctgcggaacgcactaatgacggaacaccagaggttcgacataagagaaatatacctcgcgatccaccacatcgtaaaattccggggacactttcttaacgcaactccagccaacaacttccaagtcgggaaacttgacctagatcagaagttcgaggacctcaacgacatctaccaacgagtatttccggacgactcaatcgagttcagaatagacaacctcgaacagataaaagccgtgcttctagattccaaacggtcaagatccgaccgccagcgaagcctcgtcgacgacgtataccaaacaagcgaagacaaagaagtcgaaaagcaaaacaaggccgtcgcaacagaagtcctcaaagcgatactcggcaacaaggcaaaactcaacataatagccaacgtagaggtcgacaaggaggcagcaaaagaatggacaatcacgttcgattccgaaagcattgacgacgacttagccaaaattgacgggcaaatgacagacgacggcagagcgatagtcgaaatactgcgatccctgtacagcggaatcaccctctcggccatcgtaccggaaaaccacaccctctcacaggctatggtcgccaaatacgacttacacaaaaagcacctcacactactcaagaaactaattaacagcatgacggacacaaagaaagccaaaaacctcagagccgcatacgacggatacgtagacggcgtaaagggtaaagtcctcactcaagatgaattttacaaacaaatacaatcaaacctggacgagtccgtcgaagcctccgaaatacagacctacatcgaccaagacatattcatgcctaaacaacgcacaaaagccaacggatccataccccaccagctccagcaacaggagctagaccagatcatagagaaccaaaaggagtactacccatggctagctgaactcaacccaaacccagacaagaaacgacaacagctagcgaaatacaaactcgacgaattggtcactttccgcgtaccatactacgtgggccccatgatcaccgctgaagcgcagaaaaagcaatcaggggcggagttcgcctggatgatccgcaaagagtcaggcaacatcacaccgtggaactttgaccaaaaggtggacagaatggccacggctaaccaattcataaaacgcatgacaaccaccgacacctacctactaggcgaggacgtactcccctcccaatccttgctgtaccaaagattcgaggtcctaaatgaactgaacaagattcgcatcgaccgcaaaccgatcagcgtagagctcaaacaacaaatcttcaacgacctgttcaaaaagttcaagaacgtaactattaagcacctacaagactatcttgtagcccaaggccaatactcaaagcgtccactaatagaaggccttgccgacgagaaacgctttaactcgggccttagcacgtacaacgacttctgcggtatattcggtgcgaaacttgtggatgagaatgacagacaagccgatctcgagaaaataatcgaatggtctacaatcttcgaagataagaaaatataccgagcgaagctaaacgacctcgcctggctcaccgacgaacaaaaggacaaactcgccacaaagaggtaccaaggctggggccgactatcgtccaaactgctgatcggactacaaaattcggagcaccgaaacataatggacctcctatggatcggcaacgaaaacttcatgcagatccaagccgacagtgatttcgcgaagctcataaaggacgccaaccagaatgccctccaaaacaacgactcacaagacgtgataaacgacctatacaccagcccacagaacaagaaagccatccgccaaatccttctagtggtacacgacatacaaaatgccatgcacggacaggcccccacgaaaatccacgtggagttcgccaagggcgaagaacgcaacccccgccgctccgtccaacgacaacgacaggtagaagccgcttacgagaaggcaagcaatgaactcgtgggcgcgaacgtgcgggaggagctaaaagacgccatcaccaataaaagagacttcaaagaccgactgtttctctacttcatgcagggaggcgtcgacatgtactccggcgagccaataaacatagacaacctatcgcgctacgatattgaccacatactgccgcaagccttcgtaaaggatgactccctcaacaaccgcgtactaaccgacgctgaaaagaacaggcgaaaaagtgacgccgtccccaacgaattattcggggccaagatgcgcgtcacctgggagcgcatgaaggaacaaggactaatctctaaaggtaagtaccgcaaccttactatgaaccccgagaacatcaataaatacaccgagaacggtttcataaacagacagctggtcgaaacacgccaagtaatcaaactcgctgttaacatattagccgatgagtacaaagagaacactcaaatcatatcagttaaggccgacttatcccaccagatgcgcgaagacttcgaactcctcaaaaaccgagacgtgaacgactaccaccacgcgttcgacgcgtacctcgcggcattcatggggaattacctccttaagcgctacccaaagttgcggagctacttcgtatacggcgacttcaagaaattcacccaaaaggaaataaaactgagacgattcaacttcatatatgacctcaaacacgaggaccaggtcattgataaggagactggagaaatcctctggaacaaaaatgaagacatcgcatacattagacacctattcgcgtacaagaaaatactgataagccatgaggtgagcgagcgccgaggggccctatacaaccagaccgtatacaaagcatcagacgacaaagccagcggccaaggatcaaagaaactaataccaataaaatctgacaaaccaaccgagatctacggaggatacaccggacggaccttagcctacatgacaatcgtaaaagtgacgaaagggaagaaaatatcatacaaagtcgtcggcgtgccaacggctgtccttgcaaaaatggctggagtacggcaaggcagccaagaggaacaggacaaactctacggagtactaaaaccacaattcacccaccagaaagaaaacaaaaagacgggagaaataaccgaaaccgttgacaaattcgacataattgtacccaaagtcaagtaccaacaattagtcaacgacaacgggcaactattcatgatcgggagtgacacactgccctacaacgcagaacagctggtactcagcaaagaaagtgtccaaacgatcaacaacccaggaattaaggacgaaggctcagatgaggaatccgaaaataagaaactggacaacgtgtatgatgagattgtcctctgtatgaacaaatatttcccactatacgacaataggggatttcgcaacagtatcacgaacggcaaaaacaaattcctaaaactgccaatcaaaaacatatacaaaaacggaaagctaatcaacgtgggcaaacgggaggtcatcaaccgaatcctccaaggcttacacgccaacgcgtccgtaacggacctctcaaacctcggcataaagagcccgttcggcttcctacagaaaggagccggactaagcctaagcggtgaggcccagctcatccaccaaagcgccacaggcctcttcgaacaccgagtccaactcaacaaaatcaaatga

SEQ ID NO: 6674 - RNA, 4137 nt, synthetic construct
  misc_feature 1..4137: note = Cas9 variant
  source 1..4137: mol_type = other RNA
atgtcgaacaaaccctattcaatcggccttgacataggaacgaacagcgtcgggtgggcagtcataaccgacgactacaaagtcccgtcaaagaaaatgaaagtcttagggaacaccgacaaacacttcataaagaaaaacctaataggagccctgctgttcgacgagggcacgaccgccgaaggccgacggcttaaacggaccgcccgccgacgctacacacgccgcaaaaacagactcagatatctccaagagatcttcagcgaggaaattagcaaagttgactcgtcgttctttcaccgcctggacgactccttccttgtcccggaagacaaacgcggttccaaataccccatcttcgcaacgctagctgaagagaaggaataccacaaaaacttcccaaccatctaccacctcaggaaacaactggccgactcaaaagagaaagcagacctccgactcatataccttgccctagcgcacatgatgaagtaccgcgggcacttcctgtacgaggaaagtttcgacattaagaacaatgacatccagaaaatcttcaacgagttcatatcgatatacgacaacacattcgagggcagctccctctcagaacaaaacgtacaagtggaagccattttcaccgacaagatctcaaaatctgccaagcgagaaagagtgcttaagctgttccccgatgagaaaagtacgggcctcttttcggagttcctcaagctcatcgtaggcaaccaagctgaatttaagaaacacttcgacctcgaagaaaaagcccccttgcagttcagcaaagacacttacgacgaagatctagaaaacctcctcggacagataggggatggattcgccgatctattccttgtcgctaagaaactttacgacgcgatccttctatccggcatcctgaccgtcaccgaccccagtacaaaagctcccctctcagcctcaatgatcgaacgatacgaaaaccatcaaaaagacctagcgagtctgaagcaattcataaagaataacctgcccgcggaaaaatgcgtggaggtattctccgaccaaagcaaagacgggtacgcgggctacatagacgggaaaaccacgcaggaagccttctacaaatacattaaaaacctcctaagcaaacttgaaggcgcctactacttcctcgataagatcgaacgcgaggacttcctccgaaaacaaaggacattcgacaacggctccatacctcaccaaatacacctccaagaaatgaacgcgatcctacgacgccagggcgagcactaccctttcttaaaggaaaaccgtgagaaaatcgagaaaatactaaccttcagaataccctaccacgtggggcccctggcgcgcggaaacagggactttgcatggctcacccgaaactcagacgaagccatccgcccatggaatttcgaagaaatagtagaccaggcaagctccgccgaagacttcatcaacaaaatgaccaactacgacctctatctccccgaagaaaaagtccttcccaaacactcactactctacgagacattcgccgtatacaacgaactgaccaaagtcaagtttatagccgaaggacttacaagataccaattcttagacaagaaacaaaagaaagacatattctacaccttcttcaaagcggaggacaagcgcaaagtcaccgagaaagacataatccactatctacacaacgtggacggatatgacggcattgaactgaaggggatagagaaacaattcaacgccagcctatctacctaccacgacctgctaaaaatcattaaagacaaagagttcatggacgatcctaaaaacgaagaaattctcgagaatatcgtacacacactaacgatcttcgaagaccgtgagatgataaagcaaagactcgcccagtacgattccctcttcgacgagaaagtaatcaaagccttaacaaggcgccactacacaggctgggggaaactctcagcaaaactcatcaacggcatctgcgacaaacaaacagggaaaactatcctagactacctaatcgacgacgggaaaattaatcgaaatttcatgcaactcataaacgacgacggactctccttcaaggaaataatccagaaggcacaggtggtcggcaaaacatacgacgtcaagcaagtggtacaagagctacctggaagtcccgcgatcaaaaagggcatacttcaaagcgtgaagctcgtcgacgagctcgtaaaagtcatggggcacgccccagaatcgatcgtaatcgagatggcaagggagaatcaaaccaccgcgaagggaaagaaaaacagccaacaacgttacaaaagaattgaagacgccatcaaaaacctcgccccagggctggattcaacaattctcaaagaacacccgaccgataacatacaactgcagaatgaccgcctatttctctactacctgcaaaacggtcgcgacatgtacaccggcaagcccctggaaatcaaccaactatcaaactacgacatagaccacatcataccccaggccttcataaaagacgactccctagacaacagggtcctcacatcgtcgaaggaaaaccgcgggaaaagtgacaacgtcccctcactagaggtagtcgagaaaatgaaagccttctggcagcaactcctcgacagcaaactaatatcggagcgaaaattcaacaaccttaccaaagcagaacgcggcggcctggatgagcttgacaaagtcggcttcatcaagcgacagctcgtcgagacgcgccaaatcaccaaacacgtagcccaaatcctcgacgcgcgcttcaacaaagaagtgacagagaaaaacaagaaaaacagaaatgtaaagatcattaccctcaagtcgaacatggtctcaaacttccgcaaagaatttggactgtacaaggtacgagaaataaacgactatcaccacgcccacgacgcatacctaaacgcggtggtcgcgaaagcgatcctcaagaaatacccaaaactagaacccgagttcgtctacggagactatcaaaaatacgacctaaaacggtacatctctaaatcaaaggaccctaaggaagttgagaaggcgacagaaaaatacttcttctactcgaatctcctcaacttcttcaaggaagaagtccactacgcggatggaaccatagtcaagcgcgagaacatcgaatactccaaagacaccggagaaatagcctggaataaggagaaggatttcgccacgatcaagaaagtactcagcttcccacaagtaaacatagtcaagaaaaccgaggaacagaccgtaggccaaaacggagggcttttcgacaacaacatagtatcaaaagaaaaagtcgtagacgcaagcaaactcatacccatcaagtcgggactatcccctgaaaagtacggaggctacgccagacccaccatagcgtactcggtcctagtcacgtataagcaaaacaacaaaatcaaaaacaccatggtcgggatacccgtcctcacaaaacttgagttcgagcgagacccgaacctctatctccgaaacctgggcatcaataacgtgagccacgtaataaaactcgtgaaacacaccgtactcgagttcaaacacaaatacggaacgtaccgccggttcattgtttccaaccaagaactcaagcgcgccaaccagatattcgtaaccactaagcaaatgaagctgataagccaatacacaacactggacaagaacgaacacgactcactactcaaaaacaaccagcagctcatccaatccatatggaaccaattcctggagttcatgctggccacagacctagtgaacaagaaacaatacgacgaactaatcctgaccaacaaccagacgatagaggagtgccggaacatcatgaaccgggtcatcacaacactttcgttcacaaacataaacgcaggacagaaaaagatcattttcgatgacacactctccctgcctatcaaacgctggcagttcacggactccgacaagatggtgaagaaaataatcgaaagcaccctcatccatcaatcgatcacaggactctacgaaacacgtatcgacctaaataaattaggggaagattga

SEQ ID NO: 6675 - RNA, 4137 nt, synthetic construct
  misc_feature 1..4137: note = Cas9 variant
  source 1..4137: mol_type = other RNA
atgaacaaaccttactcgatcgggctcgacataggcaccaactccgttggctggtccatcatcacggacgactacaaagtccctgcaaagaaaatgcgcgtactcggcaataccgacaaggaatatatcaagaaaaacctcattggggcgttactcttcgacggcggcaacaccgccgccgaccgccgcctaaaacgcaccgcacgcagacgctacaccaggcgtaggaaccgaatactatacctacaagaaatcttcgctgaagaaatgtccaaggtggacgactccttcttccacagactcgaggactcgttccttgtggaagaggacaaacggggcagcaagtacccaatcttcgcgacaatgcaagaggaaaaatactaccacgaaaaatttcccactatctatcatctgcgaaaagagttagcggacaagaaagaaaaagccgacctccgtctcatctacctggccctggcacacataatcaaatttagaggccacttcctcattgaggatgaccggttcgacgtacgaaacacggacatacagaaacaataccaagccttcctagagatcttcgacaccaccttcgagaacaacgaccttctaagtcagaacgtggacgtcgaagcaatactaacagacaagatatccaagagcgccaagaaagatcgtattttagcacgctaccccaaccaaaagtcaacaggcatcttcgcagagttcctcaaactaatcgtaggcaaccaagccgacttcaagaaacacttcaaccttgaagacaaaaccccactgcaatttgccaaagactcatacgacgaggacctcgaaaacctactaggccaaatcggggacgagttcgcagaccttttctccgccgcaaagaaactttacgacagcgtgttactgagcggaatcctcacagtcatagacctttctacaaaagcaccccttagcgcctcgatgatacaacgatacgacgagcaccacgaagacctaaaacacctaaagcaattcgtcaaagcctcactgccagaaaactaccgcgaggttttcgccgactcatcgaaagatggatacgccggctacatagagggtaaaacctcccaggaggccttctacaaatacctcctcaaactacttaccaaacaggaaggaagcgaatacctcctggagaaaatcaaaaacgaggacttcctgcgcaaacaacgcacattcgacaacggaagcataccccaccaagtacatcttaccgaactccgcgcaatcattcgccgtcaatcagagtactacccttttctgaaagagaacctagatcgcatcgagaaaatcctcaccttccggatcccatactacgtcggacctctggcgagggagaaaagtgacttcgcgtggatgacccggaagacagatgacagtatccgaccatggaatttcgaagacttagttgacaaggagaaatcagcagaggccttcatccaccgcatgacaaacaacgacttatacctcccagaagaaaaagtcctcccaaaacactccctcatctacgagaagttcaccgtctacaacgaactgactaaggtgcgattcctagcggaaggcttcaaagacttccaattcctcaatcgaaaacaaaaagaaacgatattcaactcactctttaaagaaaaacgaaaagtcactgagaaagatattatctccttcctcaataaagtggacgggtatgaaggaatcgcaatcaaaggaatcgaaaaacagttcaatgcgtccctgtcaacctaccacgaccttaagaaaatccttggcaaggatttcctagacaacacagacaacgaactaatactcgaagacatcatacaaaccctaacccttttcgaagaccgggagatgatcaagaagagactcgacatttataaagacttcttcaccgaatcccaactcaagaaactctacagaagacactatacagggtggggcagactctcagccaagctcatcaacggcatccggaacaaagaaaaccagaaaacgatattagactacctcatcgacgacggctccgcaaaccgtaacttcatgcaactgatcaaagacgcaggtctatcgttcaaacccatcatcgacaaggctcgaacgggctcccacagcgacaatctcaaagaggtagtcggagaactcgccggatctccagctattaagaaaggaatcctccaaagtctgaaaatagtcgacgagctagtcaaagttatgggctatgaacccgaacaaatcgttgtggagatggcgcgagagaaccaaacgaccgcaaaaggactgtcacgtagtcggcaacgcctcacgactctgcgggagagtctgggcaatctcaaaagcaatatcttggaagaaaagaaacccaaatacgtgaaagaccaagttgagaatcaccacctatcagacgaccgcctattcttgtactacctccaaaacggcaaggatatgtacactgacgacgaattggacatcgacaacttaagccaatacgacatagaccatatcataccgcaagcctttattaaggacgacagcatagacaacagagtccttgtcagcagcgctaaaaaccggggtaagtctgacgatgtcccctccatcgaaatagtcaaggctagaaaaatgttctggaaaaacctcctggatgccaaacttatgtcccaacgaaaatacgataacctcaccaaggcggagcgaggaggcctcacgtccgacgacaaagcccgattcatacagcgacaacttgtcgaaacccggcagataacaaagcacgtcgcccggatactcgacgaacgcttcaacaacgagctcgactctaaaggacgtcgaataagaaaagtcaagatagtgactctgaaatcaaacctagtaagcaacttcagaaaagagttcggattctataagatccgcgaagtcaacaactaccaccacgctcacgacgcatacctcaacgccgtcgtcgcgaaagccatcctaacgaagtacccacaactagaaccagagttcgtatacggactataccgccgtaaaaagctatcgaaaatcgtaagagaagacaaagaagaaaagtattccgaagccacacgcaaaatgttcttctacagtaacctaatgaacatgttcaagcgagtagtccgcctcgcagatgggtccatcgtcgtccgacccgtcatagagaccggccgctatatgggtaagaccgcctgggataaaaagaaacacttcgcaacggtccgtaaagtcctaagctatccacaaaacaacatagtaaagaaaacagaaatccagaccggaggcttctccaaagaaagcatattagcacacggcaactccgacaaattgatacctcgcaaaaccaaagacatctacctagaccccaagaaatacggcgggtttgactccccaatcgtcgcctactctgtactcgtggtcgcagacatcaagaaagggaaagcgcagaaactgaaaaccgtcaccgagctgctcggcataaccataatggaacgatcacgattcgagaaaaacacatctgcattcctggagtccaaaggatatctcaacatccgtgacgacaaactgatgattctacccaaatacagcctatttgagctagagaacgggcgaagacgactactcgcaagtgccggcgaactccaaaaaggaaacgagctcgccctccccacccaattcatgaagttcctctacctagcctcccgatacaatgaatcgaaaggcaaacccgaggaaatagaaaagaaacaggagttcgtaaaccaacatgtatcctacttcgacgacatactccaactcatcaacgacttcagcaaccgcgtcattctcgcggacgcaaacctagagaaaataaacaaactataccaggataacaaagaaaatatccccgttgacgaactagcgaacaacataatcaacctcttcactttcacctcgctcggtgcaccggctgcctttaaattctttgataaaatcgtagatcgaaaacgatacacgagcacgaaagaggtcctgaactcgacactcatacaccaaagcatcacgggcctatacgagacgcgcatagacttaggaaaactcggcgaaggttga

SEQ ID NO: 6676 - RNA, 4137 nt, synthetic construct
  misc_feature 1..4137: note = Cas9 variant
  source 1..4137: mol_type = other RNA
atgacgaacgaaaaatattctatcggcctggacatcggcacgtcgagcataggattcgctgtagtaaacgacaacaaccgggtcatccgagtcaaggggaaaaacgctatcggagtacgactattcgacgaaggtaaagcagcggcagaccgtcgctcattccgcaccacccgcagacggctaagcagacgccgatggcgactaaaactactacgcgagatattcgacgcctatatcacgccagtcgacgaggcattcttcatcaggctcaaagaatccaacctgagcccaaaagactccaagaaacagtactcaggcgacatcctcttcaatgacagatccgacaaagacttctacgaaaaataccccaccatctatcacctccgcaacgccctgatgaccgaacatcgtaagttcgacgtgcgagaaatttatctagccatccaccatatcatgaagttccgaggccatttcctaaatgctaccccagcgaacaatttcaaagtcggacgcctcaatctcgaagagaaattcgaggaactaaacgacatctaccaacgagttttcccggacgaaagcatcgagttccgcacagacaacctagaacaaatcaaagaggtattactagacaacaagaggtcccgcgccgatcgacaacgaacactcgtctctgacatataccaatcctcagaagacaaagatatcgaaaaacgcaataaggccgtcgctaccgagattctcaaggctagccttggaaataaagccaaactaaacgtcatcacgaacgtagaggtcgacaaagaggcagcaaaagaatggagcatcacctttgacagcgaatccatcgacgacgacctcgcaaagatcgaaggacaaatgaccgacgatggccacgaaattatcgaggttctccgatcactatactcaggtatcacactctcggcaatagtccccgaaaaccacacactttcccagagcatggtcgccaaatacgacctccataaagaccacctaaaactattcaagaaactaatcaacgggatgacggacaccaaaaaggccaaaaacctccgtgcggcttatgacggttacatcgacggcgtcaaagggaaagtcctcccgcaagaagacttctataaacaagtccaggtaaacctcgatgactccgccgaagccaacgagatccagacatacatagaccaagatatcttcatgcctaaacaaagaacaaaggcaaacggctcgatacctcaccaactgcaacagcaggaactggaccagatcatcgaaaaccaaaaggcatactacccatggctggccgaactgaaccccaaccccgacaaaaagcgccaacaactcgctaaatacaaacttgacgagctggtcacattcagagtaccctactacgtcggccccatgatcaccgccaaagaccagaaaaaccaatcgggagccgagtttgcgtggatgattcgcaaagaacctggaaacataacaccatggaactttgaccaaaaagtagaccgcatggccaccgccaatcaattcatcaaacggatgaccacaacagacacttacctactcggcgaagacgtcctccccgcccaatcgctcttataccaaaagttcgaagtcctcaacgaactgaataagatccgaatagaccacaaaccaatcagcatcgaacaaaagcaacagatcttcaacgacctcttcaaacaattcaaaaacgtcacaataaaacatctgcaggactacctagtaagccagggccaatacagcaaacgccctctaatagaaggattagcggatgaaaaacgatttaactcgtccctctccacatactcagatctctgcggaatattcggggctaagctcgtcgaagaaaacgaccgacaggaagacctcgaaaagataatcgaatggtctaccatattcgaagacaagaaaatctatcgagccaaactgaacgatctaacctggctgaccgacgaccaaaaagaaaaactcgccacgaagcgataccaaggatgggggcgactgagccgcaagctgctcgtagggctcaaaaactccgaacaccggaatatcatggacatcctatggatcaccaacgaaaacttcatgcaaatacaagccgagcccgacttcgcgaaattagtcacggacgccaacaagggcatgttggagaaaaccgactcacaagacgtcattaacgacctgtatacgtccccacagaacaagaaagccatccgccagatactactcgtcgtgcatgacatccaaaacgcgatgcatggccaggcgcccgcaaaaatccacgtcgagttcgcccgaggcgaggaacgaaatccgcggcggtctgtccaaaggcaacgccaggttgaagccgcctatgagaaagtcagtaacgaactcgtcagcgccaaggtgcgccaagagttcaaggaagctatcaacaacaagcgagatttcaaggaccgcctcttcctctacttcatgcaaggaggcatcgacatctacaccgggaagcaactaaatatagaccagctatcatcctaccaaatcgaccacatcctcccacaagccttcgtgaaggacgactcgctcacgaatcgggtcctcaccaacgaaaaccaagtaaaggccgactccgtccccatcgacatcttcggcaagaaaatgctctcggtatggggccgcatgaaagaccaagggctaatctccaaagggaaatatcggaacctaacgatgaacccagagaacatcagcgctcacacagagaacggattcataaaccggcaactggtagaaacgcgccaagtcatcaaacttgcagtcaacatcctcgcagacgagtacggggactcaacacagatcatttcagtcaaagccgacttaagccaccaaatgcgcgaggactttgagcttctcaaaaatcgcgacgtaaacgactaccaccacgcattcgacgcctaccttgcagcgttcattggcaactatctactaaagagatacccaaaactcgagtcctatttcgtgtacggcgacttcaagaaattcacccaaaaagaaaccaaaatgagaagattcaacttcatctacgatctcaaacactgtgaccaagtagtgaacaaagagaccggggaaatcctatggaccaaagatgaagacatcaaatacatccgacacagctttgcctacaagaaaatcctcgtatcgcacgaggttcgcgaaaaacgcggcgccctatacaaccaaaccatatacaaagcgaaagacgacaaaggatcgggccaaggcagcaaaaagttaatccgcataaaagacgacaaagaaacaaaaatctacggaggatacagtggcaaatccctcgcctacatgactatcgtacaaatcaccaagaaaaacaaagtgagctaccgagtaatcggaatacccaccctagcgttagcacgattaaacaaacttgaaaatgacagcaccgaaaacaatggagaactgtacaaaataatcaaaccccaattcactcattacaaggtagacaagaaaaatggagagatcatcgagaccaccgacgactttaaaatcgtggtatcgaaagtccgattccaacaactgatcgacgacgccggccaattcttcatgctcgcgtcagatacctataaaaacaatgctcagcagctagtaataagcaataacgccttgaaggcgatcaacaacacaaatatcacggactgcccacgggacgacctcgagcgcctagacaacctaagactagattcggcattcgacgagatagtcaagaaaatggataaatatttctcagcctacgacgcaaacaacttcagagagaaaataagaaactccaacctcatcttctaccaactccccgtggaagaccaatgggaaaacaataaaataacagaactcggaaaacgtaccgtcctaacgcgaatcctacaaggattgcacgcgaacgcgaccactaccgacatgagcatctttaaaataaaaacgcccttcggccaactccgacaacggtccgggatatcactcagcgaaaacgcgcaactaatctaccaaagtcccaccggactattcgaacggcgagttcagctaaacaagatcaaatga

SEQ ID NO: 6677 - RNA, 4137 nt, synthetic construct
  misc_feature 1..4137: note = Cas9 variant
  source 1..4137: mol_type = other RNA
atgaccaacgaaaaatactccatcggcctcgatatcggaacatcctccataggatttgcagtcgttaacgacaacaacagagtaatcagggtcaaaggcaaaaatgcaataggagtccgactgttcgacgagggcaaagcagccgcggataggcgatcgttcagaacaacccgccggcggctctccagaagacgatggagactaaaactcctaagggagatattcgacgcctacatcaccccagtcgacgaagcctttttcatccggctcaaggaatcaaatctatcacccaaagactcaaagaagcagtactctggcgacatactatttaacgaccgctccgacaaagacttctacgaaaaatacccaacaatatatcacctacggaacgctctaatgacagagcaccggaaattcgacgtccgcgaaatctatcttgccatccaccacatcatgaaattccgcggccacttcctcaacgcaaccccggccaataacttcaaagtcggacgactcaacctcgaagaaaagttcgaggagctaaacgacatctaccaacgagtcttcccagacgaaagcatagagttccgaaccgacaacctcgaacagatcaaggaagtcctactcgacaacaagagaagcagagctgaccggcaacggacactcgtatccgatatataccagtcatcggaagataaagacatcgaaaaacgaaacaaagcagtcgccaccgagattctcaaggcctcactaggcaacaaagccaaactcaatgtcatcacaaacgtcgaagtcgataaggaggccgccaaagagtggtcaataacctttgacagcgaatccatcgatgacgacctcgcgaaaatcgaaggacagatgaccgacgacgggcacgaaatcatcgaagtcctccgatccctctactcggggatcacactctccgccatagtcccagaaaaccacaccctatcgcagtcaatggtggctaaatatgacctccacaaagaccaccttaagttattcaagaaactgattaacggaatgaccgacacgaagaaagcgaaaaacctcagagccgcctacgacggatacatcgatggcgtcaaagggaaggtcctgccccaggaagatttctacaaacaagtacaagtcaacctcgacgacagcgcagaagcaaacgagatccagacatacatcgatcaagacatcttcatgcctaaacagagaaccaaggcaaacggatccattccgcaccagctacaacagcaagaactagaccaaataatcgaaaaccaaaaggcctactacccatggctagcagagcttaatccaaaccccgataagaaacgccaacaactagcgaaatacaaactagacgaactggtgaccttccgcgtcccctactacgtaggccctatgatcaccgccaaagatcagaaaaaccaatcaggggccgagttcgcatggatgatcagaaaggagccaggcaatatcacgccatggaacttcgaccaaaaggtagacagaatggccacagcgaaccaatttatcaaacggatgacaaccactgacacgtacctactcggcgaagatgtcctcccggcccaatccctcctataccaaaaattcgaagttctcaacgaactcaacaaaatacgcatcgaccacaaaccgatctccatcgaacaaaaacaacaaatcttcaacgacctgttcaagcaattcaaaaacgtcacaatcaaacatctgcaggactacctggtctcgcaggggcaatactccaaacgcccgctcatcgagggccttgcagacgaaaaacgctttaattcaagcctttccacttatagcgacctctgcggtatcttcggcgccaaacttgtggaggaaaacgatcgacaagaagacctagagaaaatcatagaatggagcacgatcttcgaggacaagaaaatctatcgagccaaactcaatgacctaacctggttaacggacgaccaaaaggagaaactcgcaacaaaacgctaccagggatggggaaggctctcacgcaaacttctagtcggtctcaagaacagcgagcatcgaaacatcatggacatactgtggattaccaatgagaacttcatgcaaatccaggccgaacccgacttcgccaaactcgtgacagacgcaaacaaaggaatgctagaaaagacagactcgcaagacgtcattaacgacctatacacaagcccacaaaacaaaaaggcaatccgccaaatccttctagtcgtacatgatatccagaacgcaatgcatgggcaagccccagccaagatccacgtggagttcgcccgaggagaagaacgcaacccgcggcgaagcgtacaaagacagcgtcaagtcgaagccgcctacgaaaaagttagcaacgaacttgtgagcgcgaaagtcaggcaggagttcaaggaagcaatcaacaacaaaagggacttcaaggaccgtctcttcttatacttcatgcagggcggaatcgacatctacaccgggaaacaactaaacatcgaccaactatcatcctatcaaatagaccacatactgccccaggctttcgtcaaagacgattccctaaccaaccgcgtcctcactaacgaaaaccaagttaaagccgactccgtacccatcgacatattcggcaagaaaatgctttcagtctggggccgaatgaaggatcaaggactgattagcaagggcaaataccgcaacctcacgatgaaccccgaaaacataagcgcccataccgaaaatggattcatcaaccggcagctggtcgaaacacgccaggtaatcaaactcgcggtaaacatcctggcagacgaatacggagactctacacaaatcatcagcgttaaagccgacttatcccaccagatgagagaggacttcgaactgctcaagaaccgcgacgttaatgactaccaccacgcctttgacgcctacctagcagccttcattggcaactacctgttaaaaagatacccaaagctagaatcgtatttcgtatacggggacttcaagaagtttacacaaaaagaaaccaagatgcgacgcttcaacttcatctacgatctaaagcactgcgaccaggtagtaaacaaagaaaccggcgaaattctctggacaaaggacgaggacataaaatatatccgccaccttttcgcatacaagaaaatactcgtatcacacgaagtcagggagaaacggggtgcgttgtacaaccagaccatatacaaagccaaagacgacaaaggctctggccagggatccaagaagctgatccgcataaaggacgacaaagaaaccaaaatctacggaggctacagcggaaaatcgctcgcctatatgacaatagtacaaataaccaagaaaaataaagttagctaccgggtgataggtatacccacgctcgccctcgcccgccttaacaagttagagaacgactccacggaaaataacggcgagctatacaaaatcataaagccacaattcacacactacaaagtggacaagaaaaacggcgaaataatcgagaccaccgacgactttaaaatcgtagtctcaaaagtccgtttccaacaactcatcgacgacgcaggacagttcttcatgctcgcctccgacacctataaaaacaacgcgcagcagctagtcatcagcaacaatgcgctaaaagcaataaacaacaccaatataacagactgccccagagacgacctggagcggttggacaatctccgcctcgactcagccttcgacgaaatagtaaagaaaatggacaaatacttctccgcctacgacgctaacaacttcagagaaaagatccgcaactctaacctaatcttctaccaactgccggtcgaagaccagtgggaaaacaacaaaataaccgaattaggcaaacgaacagtcctcacgcggattctacaagggttacacgcaaacgcaacaacaaccgacatgagcatcttcaaaatcaaaaccccattcggacaactaagacaacgctcaggaatcagcctttccgaaaacgcacaactgatctatcaatcccctacggggcttttcgaacgcagagtccaactcaacaaaataaaatga

SEQ ID NO: 6678 - RNA, 4140 nt, synthetic construct
  misc_feature 1..4140: note = Cas9 variant
  source 1..4140: mol_type = other RNA
atgaaacaaatcttgggcctcgacctcggtactaccagcatcggctgggcactggtacgagaagcggaaaacaaagacgagcagtcttcaatcgtgcgcatcggagtgcgcgtgaacccactcaccagcgacgaacaaaagaactttgagcaaggaaaatccataaccacgaacgcagaccgcaccctcaaacgctcaatgcgtcgtaacctccaacgctataaactacgccgggatcacctcaaggactgcctacaaaagaacgggatcatcacagacaaggccgtcctcagcgagaacggaaattacaccacattccaaacgtactacctcagggccaaggcggtaaacgagaaaatttcattagaagagttcgcccgcgttctcctcatgctcaacaagaaacggggctacaaatcctcccgtaaaatgaaaagcgcagacgaaggacagctcatagacggcatgtcagtcgcgaaaagactatacaacgataacatcacgcccggacaatacgtcctaagtctcctcgaagaaggcagaaagtacatcccagacttttacagaagtgacctcctagacgaacttgacaaaatatggacttttcaacaatgtttctacccagaaattctaacgccagaatgccgaaaactcatcgcaggaaaaggcaagcaagccaccgccaaaatcttccttgggaagtacaagatctacacagcagacaacaaatccaaagataaacgcctacaagcctaccaatggcgagtcgaagccctcagcgggcaactacccatagaagtagtagcgttcgtagtctgcgaaattaacggcgcaatccaagcctcaagtggctatctcggagccatctccgatcgatccaaagaactctacttcgaaggcctcacagtcgggcagtacctcgtcaagcagctcgagaaaaaccctgacacatcgctgaaaaataaagtgttctaccgccaagactacctaaacgagttcgaaaagatttgggaaaaacaggccgaataccacacagaactgaccccacaactaaagaaggaagtccgagacataataatcttctaccagcggaccctcaaaagccaaaaaggcctcgtcgggttctgtgagttcgaatcccgtcagatcgaagtcatgatagacggcaagctcaagaaaaagaccgtcggatgccgtgtgtgcccaaagtccagccccctctttcaggaatacaagatctggcacaacctaaacaatctcaaaatagtcgaaaaggaactaggtaaatcacgattcctcaatcaggacgaaaaggaatccctattccaagaactgaacatcaaagaaaaactctccaaaacagacatactcaaacttctgtgcctcaaagccaaagaatttgacctcaacttcgaaaaagtagaaggcaaccgcactcaagcggaactattcagagcctaccaagccatcatagaaatgagcggtaacggcgactacgacttctccaaaatgacgtctagcgaaatacaggacacagtcacaggagtcttcagaggcctcggctacaacacggacatcctcagcttcgacgccgaaaaagaagagaaaaccttcgacaaacagcctatgtacttactgtggcacctcctatacagctacgagggcgactcatcggacaccggcaacaaagcacttatcaccaagataaagaaactttgcggatttgaaagcgaagaatatgcccggatcctgacggacgtcactttccaatccgaatatggaaacctcagcaccaaggccatcaggcggattctcccttttatgaagaagggctccgaatacagcgaagcctgtcggcacgcaggctatagacacagtgagcgcagcctcaccaaggaagaactcgacaagaaagtatacaaagaccacctcgagctcctcccacgcaactcgctgcgaaatcccgtagtcgagaaaatcctgaatcaaatgatacacgtagtaaataccgtcgtagatacgtacggaaaaccagacgaaatcaggatcgaactcgcacgtgaactaaagaaatcagccaaagagcgagacgagatgactgcctctatcaacaaaaccgcagccgaacacaagaaatactgcgaggtcctgcagaaagagttcggcttcactcacgtatcacgaaacgacataatccgatataaactgtacctcgaactagaaaacaacggatacaaaacactctactcggacacttacatccctcgtgaaaaactattcagtaaggagttcgacatcgaacatataatcccccaatccaaactcttcgacgattcattctccaacaaaaccctagaatgcagatccgtcaacatcgaaaaatccaacgacaccgcatatgactatgtccttaacaaatacggagaacaagggatcctcgactataaaaaccgaatcgaaaacctgtacaaagactccaaaatctcacgaaccaaataccaaaagctcatgatgaaaaacagcgacataagcggcaacttcatagaacgcgaacttagggacagccagtacattgctaagaaagcacgcgaaattctcgaagaactggtaaaatttgtggtgcccaccacgggatccgtcaccgcgcgccttcgcgaagactggcaacttgtcgacgtcatgcaagagctaaactggaagaaatacgataaactaggcctgaccgacgtccggtatgacaaagacggacgtgaaatacgttacattaaagactggtcaaaacgcaacgaccaccgccaccatgccatggatgcgctgacgatcgcgttcaccaaacgaagcatcatacaatacctcaacaatctgaacgccaagagcgacaaatccggttcgatatatgcgatagaacaaaaggagctattcagagacaaaagagggaaacttaaattcatcccacccatgccctgtaacatcttccgggcggaagccaaacgacacctcgagaacgtccttgtatcggtaaaagccaagaacaaagtcgtcaccccgaacattaaccgaagcaaggggaaaaacggcatcaacaaaaagatccaacttacgcctcgaggccaactgcacaacgaaactatctacgggagtatgaagagatacgagacgaagtgggagaaaataggaagcggctttgacgaacgccagatcgccaaggtggccaacaagaaattccgcgaagccctactttcccgcctcgccgagttcggcaacgacccccaaaaagccttcacaggcaaaaacagcctcgagaaaaatcccctatacgtggacgaactccacacccaaaaagtcccagaaaaagtcaaaatagtcaccctagaaaatctctataccataaggaaggaaataacccccgacctcaaaatcgacaaagtagtggacgccggggtgagacgcgtgctgcaagaacgcttggacgagttcgatgatgactccaagaaagcattctccaacctagatgaaaaccctatctggctcaacggaaagaaaatgaaacgcgtgacgatcatgggcgtgtctaacgccgtccctctacacgacaagaaagattacaaaggcaaccttgtgttcgactcgaaagggcgaaaacaaccagtcgacttcgtcaacaccggctcaaatcaccacgtcgctatttaccgcgacgaatccggtgaactccaagacatagtagtctccttctacgaagcaacaacaagatctacccttggcatccccgtcatcgacaaagagtataagaaagcggaagggtggaacttcctcttcagcatgaagcaaaacgaatacttcgtcttcccaaacgaagagacgggctttaacccaaaagaaatagacctgatgaacccggataactacactaccatctcacccaacctctaccgagtccagaaattcagcaagtgcatgtacgggaactcctcggtccgagagtacgtcttccgacatcatctggaaacgtcagtaaacgacagcaaaggactcaagaacatagcctacaaaaacgtcaaaagcctagtctacctcgaagggatcgttaaagtacgcataaaccacatcggccaaatagtctccgtcggagaatattga

SEQ ID NO: 6679 - RNA, 4140 nt, synthetic construct
  misc_feature 1..4140: note = Cas9 variant
  source 1..4140: mol_type = other RNA
atgcgcatcgacaatggactcgaggagctgaaagtcaacaaccgcatatataatatcggactagacataggcacaagttccgtcggattcgcagtcactgacgcacaggacaaactcgtacgagtcaaaggcaaaaccgccataggcgtacgcctcttcgaagagggacacaccgcagctgaacggagaggcttcagaacaacacgacggagacttagcagaagaaaatggcgcatcaacctcctcaaccagatcttcgagccctacatctccgaaattgacccgacattcttcgcgcgacttaaaaattcatcactcgccggaaaagataagaaattcgagggatccctacttttccccgaccggacggattaccagttctacaaagataatccgacaatgtaccacctccgtaagcacctaatggaaaaagaccgccagtttgacctacgggaaatctacctcgcaatgcatcacatcatcaaataccgcggcaacttcctcaacaccacaccaatgaaccactttaaaaacgaagaaatagacttctccgcgttattctcccgactcaacgagctttaccaggagatcgatgacgagaacatcttcgaactcaacatcgagaacgtcgacgaaataaagaaaatcttactaaaccacgatctgttcaaaatggaaaagcagaagcaagtagccaagctactgaatgtcgacaccgacgacaaacaactcaagaaagagaataccgccctagcctccaacttcagcaaagcgatactagggtacaaattcaatctggccctcgtcaccaagataccagatcaagacaagaaagagtggaccatcagcctaggggacgaggactttgacgaccgtctcgacaacgtccccgtcgcactaacagaatcgcaactggaagtagtcgaagtcctccactcaatatttaacagcatctcactgaacgaaatcgtggagaacggcgaaactctctcatccgcgatggtacgcaaatataacgaccacaaacacgatcttaaactgctgaaaaacgtaatgacaacactcgaagatcgcaagaaagccaaaaagatccaaggaatctacaatgtcttcgtcggcaaggacaccgacctcatcagcgacaaggacaaaaataaatacaaagacaaggatgagttctacaaagaaattcagaaaaacctagataacagctccgacgccgaagaaatcataaagcgcatcaaacaggaccaattcctacccaaacagcgaacatccaaaaatggagtaataccccaccagctacaccaacgcgaactagaccttatcatcgaaaatcaagccaaatactaccccttcctgaaggaggccaaccctaacaagaaacggctcaaacaggcaaaatacaaactggacgaactcatagccttcaaaatcccatactacattggccccacctcaggagcagaaaacagcgacttttcttggctaaaacgcaaaaaggacggacaaatcacaccgtggaacttcgatgagaaggtagaccgaatcgagagcgcaaaccgcttcatccgacgcatgactacgaaggatacctacctcctcgccgaagacgtcctccccctcgaatccctgatctacgaaaaatactccgtactaaacgaactgaacaatgtgagaatcaaccgacaaaaactctctgtcaacgacaagcaggacatctacaacgagctattcaaaaatagcaaaaccgtcacgctgaaacaactccagaaatacttcgaagtgaccaaaaagctcaagacagtcgtcgtcgaaggccttgcggacccgaaaaagttcttatccaacctagggacataccacgactttaaactaatttttggagatatcgtagacgacccagaatatcagaccgacctagagaacataattgagtggagcaccatcttcgaagaccgcggaatattcaactcaaagctaaacgaaatcacatggctcaccgatgaacagaggaagaaggtgctcagcaaaaggtaccagggctggggccgcttctccaaaaagctactcgtgggcctgaaaaactcacagggaaactctatactagacgaactatggaatacgaacctaaacttcatgcagctacaaagccaggacgatttcgcagaactaatacacgccgaaaacgcgaagcaattcaaagccaacgaccccgacaatccctggaacggcatcgacgcaattctcaatgatgcttacacaagcccacaaaacaagaaggcaatccgccaagtcgtcaaagtagtacaggatatcgaaaaagccatgggtaacaaaccacagaaaatcgcgatagagttcacccggtccgccgacaaaaacccaaggcgaacagactcccgcatcaaacgcttatcggatatctacaaggaagctgccgaaaaagtcgtcggagagtccctaaaacttgagctgaacgaatacctcaccagcaaaaagaaaatgaccgacaaaatgtacctgtacttcacgcaactaggaacggacatctacacaggcaaaaagatcgacatcgaccagctcaacaactacgacatagaccacgtactaccgcagagcttcctcaaggacgacagcctcgacaaccgagtactcacgaaccgatccgacaactccgaaaagagcgatacggtcccactacataagttcggagcaaaaatgggaaacttctggcgacaactagccgacgaaggtctcatcaccaagagaaaatacaaaaatctcaccacggaccccgcgaccatagataaatacaccatccaaggattcatcagacgtcaactcgtcgagacctctcaagtgatcaaacttaccgcaaacattctcggcggactctatccagaagagacggaaatcctggagatcccagccaagctaaaccaccaattccgggatatgttcgacctcgtaaaagtgagagaagtcaacgactaccaccacgcgttcgatgcctacatcacagtattcgtcggaaacttcttatacagacgctacccgaagctacgctcatactttgtatacggagacttcaagaagctaaacaaaacagatgacgacataaggaaattcaacttcctaaacctcttcaacaaagataaagtagaggacaacgagacagacgaaattctttggtcaaaagccgagagcatccgggacattaaaaacatctacaactataaattcatgctagtgtcgcgcgaagtatacacgcgccacggtgcaatgttcaaccaaaccatataccccgcgtcaaagaacgactcaaagaaactcatacccataaagaaaggaaaagacaccgctatctacgggggatactccggcaacactgacgcctacatggcaatcgttgccgtcgaggacaagaaaggcgagaaattcaaagtcgtgggagtcccgacccgggcagtcagccgcctcgaacagcttgcagcagacgaccacgaccagtacctcacagcgctacatgacgtcctgaagccaaacttcacaaagatcaaaacaaatcgaaaaaccaaagcaaaggaagaagtcaccacacctttccgaatcctagtaggtaaagtcgggtatcgccagctgatccaagacggtcaagtaaagatgatgctcggaagtagcgcgtacaaatacaacgcgaagcaactggtactgagcgaaaagtccctcaaggtaataaagaacaacaagaagtacaaccccgacgacgaaaaccaagacctgattgatgtgtacgacgaaatcctcggcgtggttaaccgcgcattcaacctttacgacaccaacggattccgaaagaaactcaacgacaatagggttaaattcgttgagctccccatcaacaacatctttgacgggaccaaattagtccaaatggggaaacgagccgtgctgacccagatcctcaacggcctacacgccaacgccgcgctgggtgacctcaaagcactcggcatctcaacccccttcggaaaaatgcaatctaaatccgggatacccctcagcatggacgcatccctggtctaccagagccccaccggtctctttgaacgcaaactaaacctctccgacctgtga

SEQ ID NO: 6680 - RNA, 4140 nt, synthetic construct
  misc_feature 1..4140: note = Cas9 variant
  source 1..4140: mol_type = other RNA
atgactaagaagaactacagcataggactcgacataggaaccaactcagtaggctgggcagtcataacggacgactacaaagtcccggcaaagaaaatgaaagtactcggcaacaccgacaagaaatacatcaaaaagaacctgctcggcgcactactgttcgattcgggagaaacggccgaagcgacacgactaaaaagaaccgcccgccgccgctacacccgacggaaaaaccgcttgcgctatctgcaggaaatcttcgccgacgaaatggctaaggtagacgagagcttctttcagcgcctcgacgaatcctttctccggtgggacgacgataacaagaaactgggacgctaccctatcttcggcaacaaagccgacgtagtcaaataccatcaagagttccccaccatctatcatcttcgcaaacaccttgccgactctagcgaaaaagcagatctgcgcctggtgtacctagccctagcacacatgataaaatttcggggccatttcctgatagaaggcgaactcaacgccgaaaacacggacgtgcagaagatcttcagcgactttgtgcgggtgtacgaccgcactttcgacgacagccacctctcagaaattaccgtagacgcagcatccatactaaccgagaaaatctccaaaagccgccgtctagaaaacctaatcaaatactaccccaccgaaaagaaaaataccctattcggaaacctgattgccctggcactcggcctccagcccaacttcaagatgaacttcaaactgtcagaagacgccaaacttcaattctcaaaggacagttacaacgaggacttggaggaactactcggaaaaataggcgacgattacgccgacttattcacatcagccaaaaacctctacgacgcaatcctcttgtctggcatactaacagtggacgacaattcaacaaaagcacccttgagtgcatcaatgataaaaagatacgccgagcaccacgaagacctagagaagctgaaagagttcattaaagcgaacaaatccgaattgtaccacgacatattcaaagatgaaacgaaaaacggctacgctggttacatagagaacggcgtcaaacaagacgagttttacaaatatctcaaaaacacactaagcaaaatagccgggtccgactatttccttgataagatcgaacgtgaggacttcctacgcaaacaacgaaccttcgacaacggctcaatcccccaccaaatccacctacaagagatgcatgccattctacgacgacaaggagactactacccattcctcaaagagaaccaagaccgcatcgaaaagatcctcacctttcggatcccctattacgtaggacccctagcccgcaaagattcccggttcagctgggccgaataccacagcgacgagaaaataaccccgtggaactttgacaaagtgatagacaaggaaaagtcggcggaaaaattcatcaccagaatgacactcaacgatctctacctgccggaggagaaagtactgcccaagcacagtcacgtatacgaaacctacgctgtctataacgaactgactaaaatcaaatacgtcaacgaacaaggcaaggactccttcttcgactcgaacatgaaacaagaaatcttcgaccacgtattcaaagaaaaccgcaaggtaaccaaagaaaaactcctaaactacctaaacaaggagtttcccgaataccgaataaaagacctgatcggactcgacaaggaaaacaaatcctttaatgcatcgctgggcacctaccatgacctgaagaaaattctagacaaagcattcctggacgacaaagtcaacgaagaggttatagaagacatcataaaaacactgaccctcttcgaggacaaggacatgattcatgagcggctccaaaagtactcggacatattcactgcggatcaactgaagaaattagaacggcggcactacacaggctggggtcgattgtcctacaaactaatcaacggcatccgcaacaaagaaaacaacaaaaccatcctcgactacttaatcgacgacggcagcgcaaaccgaaacttcatgcagctaatcaacgacgacaccctacccttcaaacaaattatacagaaaagccaagttgtaggcgacgtcgatgacatcgaagcagtagtacacgacctaccaggaagtcccgccataaagaaagggatacttcaatcagtaaaaatagtcgacgagctagtaaaagtgatgggcgacaaccccgacaacatcgtgatcgaaatggcacgcgaaaaccaaacaacaaacagaggacgatcccagtcacaacagcgactcaagaaactgcaaaactcgctcaaagaactaggctccaacattctcaatgaggaaaaaccttcctacatagaagataaagtagaaaacagccacctccaaaacgaccaactcttcctctactacatacagaacggaaaggacatgtacactggcgatgaactggacatcgatcacctcagcgactacgacatcgaccacatcataccccaagccttcatcaaagacgacagcatcgacaaccgcgtccttaccagtagcgccaagaaccgcggaaaatccgacgacgtcccctcgctcgatatcgtccgagcccgaaaagcagagtgggtcaggctatacaaatcaggcctgatctcaaaacggaaattcgacaacctcaccaaggccgagcgagggggcctaacagaggcagacaaagccgggtttattaaacgccagctcgtcgaaacccgacagatcacgaagcacgtagcccaaatactagacgcaaggttcaacacggagtccgacgaaaatgacaaggtcatcagagacgtgaaagtaataaccctcaagagcaacctagtaagccaattccgtaaagactttgagttttacaaagtaagagaaataaacgactatcaccatgcacacgacgcataccttaacgcagtggtcggcaccgcactacttaagaaataccccaaactggcatccgagttcgtctatggggaatacaagaaatacgacgttcacaaactaatcgccaaaagcagcgacgaccatagcgaaatgggcaaagctacagcgaaatacttcttctactcgaaccttatgaatttcttcaaacgggtcatacgatatagcaacggcaaggtcatagtgcgacccgttgttgaatattccaaagacacggaagacatcgcttgggataaaaagtccaactttcgcaccatctgcaaagtcctctcctacccccaagtcaacatagtaaagaaggtagagacgcaaacagggggcttttcaaaggaaagcatcctccccaaaggcgattcagacaaactcataccgcgtaagaccaagaaagcctattgggacacgaagaaatatgggggcttcgacagccccacggtcgcctactccgtattcgtggtggccgacgtcgaaaaaggcaaagcgaagaaattaaaaaccgtgaaagagctagtgggcatctccatcatggaacgatcatttttcgaagaaaaccccgtcgagttcctggagaataaaggttaccataacatccgagaagacaagttaatcaaactcccaaaatacagcctattcgagttcgaaggcggcaaacgacgcctcctcgcctctgccagcgaactacagaaaggcaacgaaatggtcataccagggcacctagtgaaactcctataccacgcgcagcgcatcaattcgtttaactcaacaaaatacctcgactacgtaagcgcccataagaaagagttcgaaaaagttctgtcctgcgtagaggacttcgccaatctgtacgttgatgtagagaaaaacctctcaaaaatccgagcagtcgccgacagcatggacaacttcagcatcgaagaaatcagcaacagcttcatcaatctactcaccctgaccgccctcggagcgccagcggacttcaactttctcggcgagaaaatcccacgaaaacggtacacatcaacaaaggaatgtctcaacgcaacgctaatacaccaatcgatcaccggtctatacgaaaccagaatagacctcagcaagataggagaagaatga

SEQ ID NO: 6681 - RNA, 4143 nt, synthetic construct
  misc_feature 1..4143: note = Cas9 variant
  source 1..4143: mol_type = other RNA
atggggaaatacaacctaggattggacataggaactaacagcgtaggctgggcggttgtcgacgaaaacaaccagatcgtcaagaaaggtggaaaggccctatggggcgtgagaatgtttgacgaagcccaatcggccaaggaaacccgcatctacaggaacagcaggcggcgcatagtacggcgcaaccagcgcctcctcctactgcaaaaggagttctacgacgaaataatcaaagtcgaccaaacgttcttccaacgtctcaaagactcctttttcaaaaaggaggacaagctaaacaaaaacaactacaccttcttcgacgacgacatcacagaccgcgagtacttcaagaagttcccaacaatctaccaccttcgatcgcacctactatacaacgatgagaaaatcgacataagaatgctgtacctggctctccaccacatagtgaagtacagaggccatttccttgacagcggggaagtcaatgaaagcaacttctccaaaatcaaagacgtccttgacaccttcaacaacaaaatgagcgaaatgtccctagagttcgaagacaatgaagattacttctgcaaaatcgagttcgacgaaaacttcgaaaacaaactcaaagacatcatgctaagccagttgtcaaagaaagaaaagcgacaagaactaatagacctcttcaaagtggacaagaaaagccttgttaacgaacttctgattgaactcctcgtaaataagaaagtcaaactaaacagcctctcgatcacaaacggtaagaaatacgaagtttgtgaaatcgatttcgaaaaagaagaactatttgagaaactggaagacgccaaaaagatcatcaccgagctgttcgacatactggacgaaatagtaaacatcaagaagatcgtagactactactacgtcctcaagatcataggtgataacgaatacctctctgaagccatggtcaagaaatacgacaaacacgacaaagacctaagagaactcaaatcctttatcaaaacgtactgtccaaacaaatactacgaatgcttccgaaaaacctccaacccgaatctgtgcaactaccccaaatacgtcggcattaattcggtcaacaagaagatagagagattcgcgcattgtaagaaagaagagttctacaaatacctcaagtcactcttcaataccatcaaagacgaaaacgccaagctcaaaatcgacttgttccaaaaagacatggaaaacgacgacttcctcaaccgccaaaactccaaccacaattcaagcatccccatgcaactcaatttctgtgaactcaaaaagattcttgaaaatcagtccaagtactacccgtttctcatgctcaagaactcagacggatacagcacttccgaccgaatcatagccatattcaaatacaaaatcccctactacgtcggacccctcaacaaaaactccaagtactcatggctcgtaaagaaatcgaacgaaaacataaccccctggaattacgagaaagttattgatctcgacgcatccgccaaagaatttatccagcggatgcaaaacaaatgcacctacctgaaaggggaaaacgactactgcctccccaaaaagagcatcctgttctctgagtacaactgcttacaatacctcaaccgcctgatcataaacggagcgctcatcgagaacaaattaaagaacgaaatctacgagaacatcttcctctgttacaaaaagccaaccaagaaaagcatagtggaatacctcaaaacgaactataactacgacgaaaccaccctaaagtcaaacatactcgaagtcaactgtgacatgagctcctacatccaattcaaggaaatatacggcgaagacttcgagcagaacctcaacatcgtggaagacataatcaaagacatcaccatcttcgaggacaagaaaatcctggagaaaagactacgagaaatctaccacctatcagaggacaaagtccagaaaataaaaggcttaaactacaaaggctacgcaactctgtctaaacatttcctaaacaacttttactcggtcaatgaggaaaccggggaaatctatggaccaatcatccaaatcatgcgagacaccaactacaaccttcaacaagtcatatacaacgaccgctacaatttcatgaaagctatcgacaaatacaacaagaagaacttggatacggagaagaagctcaacgtttccgactttatcgatgaatacatttacgtcagtccaataatgaaacgctccctgatccaatcctacaatataatacaagaactcgagaaaatcctaggagaatcaatatctaagtactacatcgaatgcgcgcgtgtccgctcgaacagcaaggacgtcattaactcgcgatacagacaactctcagaactatacaaggactgcgaacaccaagtgtccgacataagcaagaactacatcaacataaacaagttaaagaaacaactcgaggacaacaaaaacgaactccgagccgacaaactgtatctctacttcactcaatttggcaagtgcatgtacacactaaaggacatagacctggacgacgtcttcctgggaaagtacgacatagaccacatatacccacagtcactcatcaaggacgactcactaaacaatagggtattggcctccaaagagaaaaacggaaagaaagataaccaatttatattcaacatcccagagtttctgccgaaaaacgcagaactattctataaaaagctgcttgagtgcaaactaatcacaaaagaaaagtatagacgcctaacgatgaaaaagatagacgacgacgaactcgacatcttcgtcaaccgtcaacttgtagctacaaatcaatcagtaaaaggcctggttgacgtcctcaaaatctacaagggcgtcaagccgaccaacatagtgtacagcaaagccgtaaacatcagcgacttccgcaataactataacttgtacaaaagccggacagctaacaactaccaccacgcccacgatgcctacctaaacgtcgtgatcggcaaggcactagacgtctactaccaatgcaactacttccaaaactataaagacgtaatcaagctgaaagaccgaaacataacaataaaccccgaaattatcttgtccaaaaaccgctacgtaaaccgcaacggggagaagaaagtaatctgggatcttgacaacaccctcaaattaatcaaaaacaacctctataaccgcttcgatataaccgagaccatcatgacccgtaaatcaaataaaatgttttcaaaatcctccatctcccccgccaaaaactccaagaacctaatcccgatcaagacctcggacccccgatgcaacgtactaaaatatggcggcatcaagtcaaattcttacaacttctactgcatcgtcgagctttacgataagaaaggcaaaaagtcctacatcctggaggccatcccaaaaacccactccgacaaactagaagaatacatcaaaaacagcatagacgagaaaaacgtcagcaacttcaaaattatcaataaaaacataaagtcgaacataattatagaatataagaagctccgctacgttatcacaggaaaaagcggcaaatactatctcattaaaaatttcaaagaccggaacttcagctacaacgcgataaagacgataaagtatatagagaaatacaactaccaaaagaagtacgaaataccctttgaggagaccaaggaaaagatcatcctagcacccaaaaagaaagacacgaaggagataagcctgaccctagacaactgccaagcacttctagatgaaataatctccctattcaagaaagacatctacaactatgacatcatatacaagatcacctcaaaactcgaagagaacaagcagaatctaactctgaccaacctgatcaaagtgctgaccgagatcttgatcctcctaaagacaaatgagagaggtacagccgacctcaccctaattgatatgtcgaaagacaccggaaccctatgcataagtaaaacactaaagcccggtatgaaatttatctcagaatccccaactggctattaccgaaaaattatattcgaggtgccgaacggaatttga

SEQ ID NO: 6682 - RNA, 4143 nt, synthetic construct
  misc_feature 1..4143: note = Cas9 variant
  source 1..4143: mol_type = other RNA
atgaaacgaatactcgggctagacctcggcacaacctcaatcgggtgggcactggtgaacgaagcagaaaacaacaacgaggcctcatcgatcgttcgactaggagtccgcgtaaacccactaacagtagacgagaaaagcaactttgaaaaggggaaagccatcaccacaaacgccgataggcagctacggcacggagctcgcattaacttacaacgttacaagctacgccgccaaaacctgcacgactgcttacaaaaacagggatggctcggcaccgaagccatgtacgaagagggaaaagccagcacattcgaaacctacaagctcagagccaaggccgcagaagaggaaatctctctacacgagttcgcccgggtactctttatgctcaacaagaaaagagggtacaaatccaaccggaaggccaacaataaagaagatggccaactcttcgacggcatgacaatagccaaaaagctctacgaagaacatctcaccccggcagaatacagcttacaacttctcaacaagggaaagaaattcacacaaggctactaccgatccgacctaaacgcagagctcgaacgcatctgggacgagcaaaagaagtattacccggagatcctcaccgacgaatttaagcaacagctggaaggaaaaaccaaaacaaacacaagtaaaatatttctcgcaaaatacggaatatacagcgcagacctaaaagggttggaccgcaagttccagccactcaagtggcgcgtcgaagctctgcagcaacaagtcgataaggaggtattagccttcgtcatatccgacctgaaaggacagatcgcgaatacgtcaggactattaggggccataagcgaccggtcaaaggagctgtacttcaacaagcaaacggtgggccaatacctctgggcctctctagaagaaaacccccacatctctatcaaaaacaagcctttttaccgtcaagactacctagacgagttcgagaaaatctgggaaacacaagccgcattccacaagcaactcacgccagaactcaaacaggaaatcagagacataatcatcttctatcaacgcccccttaaatcaaagaaaagtctgatcagtgtctgcgaactcgaacaacgaaaagtcaaagcaaccatagacggaaaagaaaaagaaatcaccatcggaccaaaagtagccccaaagtcatcacccgtcttccaagagttccgaatatggcaaaaccttaacaacgtactactcatcgacaacgacaccaacgaaaaacgcccactcgacgaggtagaaagaaacctcctatacaaggaactcagcataaaagccaagctcagcaaaaccgaggccttaaagattctcaacaagaaaggaaagcaatgggacctcaactatcgcgagctggaagggaatcgaacccaagctatactcttcgactgctacaaccggatcataaccctcacgggacacgaagaatgcgacttcaagaaaatcaaagcctccgaaatacgccactacgtatcaaccatattcaaaaacctcggcttctccacagaaatccttgacttcgacccgtcactgaagaaacacgaactcgaaaaacagcctatgtaccagctctggcatctgctctactcgtacgagagcgacaactcccgcaccggtaacgaatcactcttgagaaaactcgaaactactttcggtttcccagaagaatatgcaaccgtcctctgcgacgtagtcttcgaagaagactacggcaacctatcagtaaaagccatgcgcgaaatactcccctacctccaggccggaaacgactactcccaagcatgcgcatacgccggatacaatcactcccgccactcactaaccaaagaggaactggaccaaaaagtttacaaggaacgactcgaactattacccaaaaactccctacgcaacccagtcgtagagaaaatcctaaaccaaatgatcaacgtcataaacgcgatcatagacgagtacggaaaacccgacgaaatccgaatcgaaatggccagggaactcaaatcatctgcggcagaccgaaagaaaacgacacacgcgatctcacaaggaaacgccgaaaatcaaagaatcagggagatcctcgagaaagagttctccttgtcgtacatctccagaaacgatataattaagtacaaactatacgaagaactcgaacccaattattataaaacactctatagtgatacatatataacaaaagacaaactgttctcaaaagacttcgacattgaacacatcatcccgaaagctagactattcgacgactccttctccaacaaaaccctagaggcccgcaacataaatctagaaaagtccaacaaaacagccttcgactttattaaagagaaatacggggaagacggggctgaggcgtacaaaaagaaactggacatgctgttagaaaacgacgcgataagccgcccgaaatacaacaacctcctcagagcagaagccgacatccccagcgatttcattaaccgcgacctacgaaacacccaatacatcgccaagaaagcctgcgagattcttggagaattagtcaaaaccgttacaccgacaacgggcaaaataacaaaccggctccgcgaggactggcaacttgtcgacgtaatgaaagaacttaacttcgaaaaatacgaaaaactggggctcaccgagatcgtggaggaccgagacggccgaaaaatcaaacggataaaagactggacgaagagaaacgatcacagacaccacgccatggacgcactagcaatcgccttcaccaagcctagcttcatccagtacctgaataacctgaacgcccgctcaaataaaggagacagcatctacgcgatagaaaataaagaactccactacgaagagggtaagctccgatttaacgcccctattcccgtaaacgagttcagagccgaagccaaacgccacctctcagcgatactcgtaagtataaaagccaaaaacaaagtgatgacacaaaatgttaacaagataaagactaagcacggcatcatcaaaaagatacagctcacaccacggggacccctacacaacgagacaatttacggaaccaagatgcgcccgataataaaaatggtaaaggtaggtgcagcactcgacgaggccaccataaacaaagtcagctcccccgccattcgggaggcacttctaaagcggctaaacgaatacagcggtaacgcgaagaaagcattcaccggcaaaaacacgctcgagaaaaaccccatatatttgaatgcaggtcggaccaaaaccgtgccgagcctggttaaaaccgtggaatgggaatcattccaccccaccagaaaactaatcgacaaagacctaaatgtagacaaggtggtcgacaagggtatccgcgaaatcctcaaggcgagacttgaagagttcaacggagatgccaaaaaggcgttcagcaacttagaagaaaacccaatatatctggacgaagccaagaaaatcgcccttaaacgagtatcgatcgaaggcgtcctatctgcaatacccctccacacactcaaaaaccaagccggcaaacccataacgggaaaggacggaaaacccgtactaggcaactacgtccagacctccaacaaccaccacatcgccttctactacgacgaggacgggaacctccaagacaacgcggtttcattcttcgaggcagccgaacgaaagtcacaaggcatacccgtcatcgacaaagattataaccgcgataaaggctggcgctttctgttcaccatgaaacagaacgagtacttcgtcttcccgaacgaagccacagggttcataccctctgaagtagacttaacagacgaagccaactacggcattatatcccccaacttgtaccgagtccaaaaagtcagtagaatcgacaaaggaacatcggcctcacgggactactggttccgacaccacctcgaaaccatactcaacgacgacgccaaactcaaaaatctagcattcaagcgaatccgcggcctactagaactcaaagatattatcaaagtcaggataaactcgaccgggaaaatagttgccgtcggagaatacgactga

SEQ ID NO: 6683 - RNA, 4143 nt, synthetic construct
  misc_feature 1..4143: note = Cas9 variant
  source 1..4143: mol_type = other RNA
atgaagaaaatcctcggcctcgacctgggaaccacatccataggctgggccctcgtcaatgaggcagaaaccgaaagcgaaaagagctcgatcatacgcctgggtgtacgggtcaaccccctcaccatcgacgaaaaaggcaactttgagaagggaaaagccatcacaacgaatagcgacagacagcaaagacactctgcacgcatcaacctccagcgttacaagctgcgcagacaaaacctctgcgactgtctgcaaatcggtggcctgctcgggtccgaaagcatgtacgaagaaggaaaagaaagcaccttcgaaacctataaactccgtgcgaaagccgccaccgagaaggtagcactacacgagttcgcccgcatactcttcatgctgaacaagaaacgtggatacaaatcaaatcgaaaagcaaacagcaaagaagatggccaggcattcgacggaatgaccatcgccaaaaagctgtacgaagagaacctcacgccagcagagtactccctccaactactaaacaaaggcaagaaattcagtccgagttactacaggagcgacctcgaatccgaactcaaccggatatgggaggaacagaagaaatactaccccgaaatcctaaccgacgacttctatcagcaattagaagggaaaaccaaagttaacacaactaaaatcttcctagcaaaatacggaatctacacagccgacctgaaagggctcgacaagaaaatgcagccgctcaaatggagaatcgaggccctaaacaaacaagtagataaagaggtacttacgttcgtcgtcagtgacctgaaaggccagatagagaaaactagcggtcttctcggggaaataagcgaccgcagcaaagaactatacttcaacaaacagactgttggccagtacgtatgggcgagcctaaaagaaaacccccacgtctcaataaagaacaaaccgttctaccgacaggactatctcgacgagttcgagaaaatatgggaaacacaagccgcttttcacaaggaactaaccccggaactcaaaaaggaaatacgggacatcataatcttctaccagcgccccctcaagagcaagaaaggcctcattagcatctgcgaactcgaacaaaagaaagaaaaagtaatcatagaaggcaaagaaaaggaaatactaatcggctcgaaagtggcccccaaaagtagtcccatgtaccaggagttcagaatatggcagaacctcaacaatgtacttctcatagacactgaaattaacgaatcccgccccctcgatgaggaagagaaggcactattgtacaacgaactctctgtccgcgcgaaactgagcgaaacagaggcgctcaagacgatcaacaagaaaggcaagcactgggacctcaacttcaaagagctagagggaaaccggactcaagccgtcctattcgaatgctataaccggataataacccaaacaggccacgaagaatgcaacttcaagaaaatcagcgcggaagacatccgccactacgtggccaccattttcaaaaacctgggcttcaacaccgacatactagatttcaacccgagtctagaaaaacacgagctcgagaaacaacccatgtatcaactgtggcacttactatactcctacgaaagcgataaaagtagaaccggcaatgaaagcctactcaacaaactcgaggcaaacttcggtttcccccaggagtatgccagcgtactagccgacgcgaccttcgaagacgactacgggaacatcagtgtaaaagccatcagaaaaatactcccccacctacacgacggctacgattacagcgaagcgtgcgagcgcgccggctacaaccacagcgttaggagcctgacaaaagaggagctcgcacaaaaggtctacaaagaccggctagacttgctccccaaaaacagcttacgaaacccggtggtcgagaagatactaaaccagatgataaacgtaattaacgcgatcatagtggagtacggcaagcccgacgaaataagaatagaaatggcccgcgaactaaaatcttcggccgcaaagcgcgaagaacgcacaaaatccataaaccagaacgcagcggagaacaaaaggatcaccgaaatcctacaaactgaatttggcctctcatacatatcacggaacgacatagtgaaatacaaattataccaggaactggaggcaaacggtttcaaaaccctatacagcaacacgtatataccaaaagaaaagctattcagcaaagacttcgacatagagcatatagtcccaaaagccagactattcgatgattccttcgggaacaagaccatcgaagcccgagacgtaaacctagcgaaatcaaacaagaccgcattcgacttcgtcaaagaaaagtacggggaacaaggcatagaagaatacaaaaagaaactggatacactgctaaaagagaacgccatcagctccggcaaatataagaagctaatgatgagcgaggcagacatcccgtcagacttcatcaaccgcgacctaagaaacacccaatacatcgccaggaaggcatatgaaatcctcggggaactcgtgaagaccataaccccaacaacgggaaagataactgacaggctgcgggaagactggcagctcattgacgtcatgaaggagctgaacttcgaaaaatatgaccgcctaggcctcaccgaggtaatagaagaccgcgacggacgcaagattaaacgaataaaggactggacgaagaggaatgatcacagacatcacgctatggacgccctcaccatagccttcacgaaaccatcatacatccagtacctaaacaacctaaacgcacgctccgacaaatcgggatcaatatatgcgattgaaactaaagaactccacagggaaaacaatacgttgcgattcaacgcccccatgcccctaaacgagttcagaaaagaagccaaacgccacctcagcgcaatcctggtctccataaaagcgaaaaataaagtcatgacccaaaacgtcaacaaaataaaaaccaaaaacgggataattaagaaagtccaattaacaccacgcggggcactccataacgaaacaatctacgggaccaaaatgcggccgataatcaagatggtaaaaatcggggcagcactagacgaagcgacaataaacaaagtatcaagccccacaatccgtgaagccctgctaaaacgcctcaatgaatactcaggcgacgctaaaaaggcattcgcgggcaagaacgccatcaccaaaaatcccatatacctaaacgcggagcacacaaagaccgcccctgcaatggtgaaaatcgtcgagtgggagatgtactaccccatccgaaaactcataacaccagacctaaagatagaaaaagtcatcgacaatggcataaaagagatcctcaagaaacgcttgaaagagttcggcggagacgccaaaaaggccttctctaatctggatgaatgcccaatttacctagacgaagaaaagaacatcacgttaaaacgcgtatcaatagaaggggtcctcagcgcaatcccagtacatactctcaaaaaccacgcaggaaaagaaataaaagatgaggatggaaaagccgtactcggcgattacgtacaaacaagcaacaaccaccacgtggcaatctaccaagacgcaaagggaaacctacaagacaatgtaatatccttcttcgaagcagcagagcgaaagtcccaaaacgtccccatcgttgacaaaaacctcaatagagacaaaggctggcacttcctctacaccatgaaacagaatgaatacttcgtattcccgaatgaggaaaccggattcgtcccttcagaaatagatctaatggacgaaaacaattacgagatgatatcccccaacctgttccgagtccaaacaatgtcccgggtcgactacggaaaaacaatcatcagagagtacgtcttccgcaaccatctggagaccatcctcaacgacaacctcaaactaaaaggtctagtcttcaagaaaatcaaaagcctgaaagccctagaaggcatagtcaaagttcgggtaaatgccatcggcaaaatcgtcgcggtcggagagtatgactga

SEQ ID NO: 6684 - RNA, 4143 nt, synthetic construct
  misc_feature 1..4143: note = Cas9 variant
  source 1..4143: mol_type = other RNA
atgaagaagaaatacgccattggaatagacatcggcacaaactccgtcggctggagcgtcgtcaccgatgactacaaagtcccctcgaaaaagatgaaagtcttcggcaataccgaaaagcgatacatcaaaaagaacctccttggaaccctattgttcgacgaaggaaacaccgcggaaaaccgccgcctcaagcgcaccgcacgacgccggtacacgcggagacgcaaccgcatattatacctacaagaaatattcgccgaagaaataaacaagatagacgacagcttctttcagcgcctcgacgacagcttcctcatagttgaagacaaacaggggagcaaacacccaatctttggcacactacaagaggagaaagaatatcacaaacaattccctaccatctaccaccttcggaagcagctggcagactcgagccagaaagccgacatccgactcatctacctggcccttgcccatataataaagtaccgaggccacttcctattcgagggcgacctcaaatcagaaaataaagacgtccagcacttattcaacgactttgttgagatgttcgacaaaaccgtcgagggctcctacctatccgaaaaccttccaaatgtggccgacgtcctagtagaaaaggtgagcaaatccagacacctagagaacatacttcactacttccccaacgaaaagaaaaacggcctattcggaaatttcctagcactggccctcgggctacaaccaaatttcaaaaccaacttcgaactagccgaggacgccaaaatccagttcagcaaagagacatacgaggaagaccttgaagaactactcggtaaaatcggtgatgactacgcagacctttttattgccacgaagtcactgtacgacggtatactcttggccgggattctctctacaaccaattctaccactaaagcgccgcttagctcctcaatggtcaaccgttacgaggaacaccagaaggatctcgcgctcctcaaaaacttcatccaccagaacctatcagattcatataaagaagtattcaacgacaagttaaaggatgggtacgcaggctatattgaagggaagacaacacaggagaacttctacaggtttataaagaaagccatcgaaaagattgacggctcgaactacttcatcgagaaaatcgaacgcgaagacttcctccgaaaacaacgcacgtttgacaacgggtccattccccaccaaatccacctccgagagatgcaggctatcatacgaagacaggccaaattttacccctttctagaagaaaaccaggacaagatcgagaaaatactgacattccggattccatactacgtaggaccccttgcccgaggtaagtccgaatttgcgtggctaaataggaaaagcgacgagaaaatccgcccctggaacttcgacgaaatggtcgacaaggaaacatccgcagagaacttcatcacgcgcatgacaaactacgaccaatatctcccggatcaaaaggtccttccgaagcacagcctcctctacgagaaattcgctgtctataacgagctcacaaaagtcaggtacgtcacagaacagggcaaatccttcttcttcgacgcaaatatgaaacaagaaatcttcgaccgcacctttaaagtatatcgcaaagtgacaaaggagaaactgatggacttcctaagcaaagagttcgacgagttccggattgtggacctcctgggccttgacaaagacaacaaatccttcaacgcctctctagggacctaccacgacttaaagaaaatagtctctgaagacttcctcgacaacagcgaaaacgaagatatccttgaaaacgtagtccttacgctcaccttattcgaagacagagaaatgatcaggaaaaggttagaaaaatacaaagacgtgctcacagaggaacagaggaaaaagctagaacgcagacactacaccggatggggccgactcagcgccaaactcataaacggaatacgagacaaagttacacgcaaaacaatcctagactacctcatagatgacggaacaagcaaccggaacttcatgcagctcataaacgacgacaccctatcgttcgtagacgagatcagattagctcaaggaagcggaaaagccgaggactaccgggcagaagtccagaacttagccggatcccccgccatcaagaaaggcatactccagtcactcaaaatcgtcgacgaactaattgaagtcatgggatacgacccagagcacatcgtcgtagagatggcacgggaaaatcagttcacaaaccaagggcgaagaaactcccagcaacgctacaagaaaatcgaaaacgccatcaaaaacctcgactccaacctgaacagcaaaattttgaaggaatacccgaccaacaaccaggccctacagaatgaccgcctctttctatactaccttcaaaacggtaaagacatgtacaccgatgaagaactcgacatcgaccagctgagccaatacgacatcgaccacatcatcccacaagcattcattaaagacgactcactcgacaacaaagtgctcacaaaatccgcaaagaaccgcggaaaaagcgacgacgtcccctccctagaaatagtatataaaaagaaaaacttctggaagcaactcctcgatagccaactcatctcgcaacggaagttcgacaacctcacaaaagcagagcgtggcggattaacgaacgaagacaaagcccgattcatccagcgccagctggttgaaacgcgccaaataacaaaacacgtcgcacgaatcctggacactcgcttcaacaccaaactcgacgaagccggcaaccgaatccgtgaccccaaagtcaacattatgaccctcaagtccagcctcgtcagccaattccgtaaagattaccagttatacaaggtacgggagatcaataactaccaccacgcgcacgacgcctacctgaacgcagtcgtcgcaacagcgctcctcaagaagtacccacaactggctcctgagttcgtgtatggcgactaccccaaatacaactcctacaaatcgcgaaaaagcgcaaccgaaaaagtactcttctactcaaacatcatgaacttctttaagcgcgtactcgtctactccaaaactggggaagttaggattcggcctgtcatcgaagtcaacaaggaaaccggagagatcgtgtgggacaaaaagtccgatttccgcaccgtccgcaaagtcctcagctacccccaagtaaacgtcgttaagaagaccgaagtacaaaaccacgggctggacagaggcaagccaaaggggttctacaacgcaaacctgtcgccccgaccgaaagagggctcagtcgaaaacttagtacccgccaaacagtccttcgacacaaaaagatacggcggttacgccgggatctccaacagctatgcggtgctcgtcaacggaatcatcgaaaaaggcaaaaagaaatcaaaagcggaggtgaccgagtttcaaggcattagcattctcgcgcgcaaagactttgataaaaaccccaagcaatacctcctcaacctcggttacaaggacatcaaaagtataattaagctaccaaaatacagcctcttcgagctcgagaatggatcacgccggatgctcgcatcaatcctctcaacgaataacaaaagaggcgagatccacaaaggaaacgaaatgtacctgccagataaatttgtgacccttctataccatgcaatgcgggtgaatagaaccctcgagcctggccacaagaaatacgtagaagcacaccgccatgtcttcgacgaactacttacctacatcctcgagtacaacgaaaagatagtaggagccaaggctaacggcaaacgaattgtagaagcctacagcgcccgaaaggacaccgacaaccttgaggaactgtgtaactcctttatcaatctcctcaacctaacagcactcgggtcagcagtagacttcgagttcctaggcacaaagataccacgctaccgagactacacaccaagcagcctcctcaaagcaaccctcatacaccagtccgtcaccggactatacgaaacgcgcattgatctcagcaaactaggcggggactga

SEQ ID NO: 6685 - RNA, 4143 nt, synthetic construct
  misc_feature 1..4143: note = Cas9 variant
  source 1..4143: mol_type = other RNA
atgaagaaaatcctaggcctcgacctaggtacaaccagcatcggctgggcccttgtctatgaatcggaaaacgccgatgagaaaagcagcatcgtccgcctcggcgtaagagtaaacccactcagcgtggatgaaaaaggcaacttcgaaaagggcaagagtataacgacaaacgccgaccgccagcaaacacatggcgcgcgcatcaacctacagcgatacaaattgcgcagagaaaacttgaaggactgcctgcagaagcagggttggatcgggaccgaagccctgtacgaagaaggaaaaacgtccacgttcgagacatacatgctgagagccaaagccgcggaagaagagatctcactgcacgagctatgccgagtactgttcatgctaaacaagaaaagaggatacaaaagcaaccgcaaagccaacaacaaggaggacggaaagctattcgacggaatgactgtagccaaaaagctctacgaggaacatctgacccccgcagagtactccctaaagctgctgagcagtggcaagaagttcaagcaagagtattaccggtccgatctcaaagaagagttcgatagaatatggaacgaacaacaaaaatactacccagaaatcctcaccgacgactttaaacaacaacttcagggcaaatcgaaaggtaacaccagcaagatctttctcggtaaatacggaatatatagcgcagaccttaaaggactagaccgcaaactccaacccctaaaatggcgcgtggaagccctgaaacaaaaagtagacaaggaagtcctggccttcgtcatctctgacctaaacgggcagattgccagtacgtctgggctcctcggggccatcagtgacagaagcaaggaactctacttcaacaagcaaacggttggccaatacctatggaccagcctaaaggaaagcccacacgtcagtattaagaataaaccattctatcgccaagattacttggacgagttcgagaaaatatgggaaacacaggccacgtaccacaaagaactcaccccggaactcaagcaagagatccgcgacataataatattctaccagcgcccactcaaatccaagaaaggacttattagcgtgtgcgagctggagcaacgcaaagtcaaggtcaccatcgacgggaaagagaaggaaatctccatcgggccaaaggtcgcaccgaaatcttccccgatgttccaggagttccgaatttggcaaaatttaaacaacatcctattaatcgacaaaggtaacaacagcaatcgaccactatacgaagaagaacggaacctcctgtacgaagaacttagtgttaaagaaaaactttctaaggcagaagctctcaaagtcctcaataaaaacggaaaacaatgggacttaaattacaaagagatcgagggcaatcgtacccaagccgtactctacgactgctacaaccgaatcatcgggatgaccggccatgaagaatgcaacttcaagaaactcaaagccagcgacataagatacaacgtgaagacgatcttcaaaaacctaggtttctccacagacatactagacttcgatagtagcctgcagggccacgagcttgagcgacaaccctcctaccaactctggcatctgctatacagttacgagtccgacaacagcagaacaggcaatgacgccctgctccgcaaactggaaacggccttcagcatcccaaaagaatacgctgctgtgctcagcgacgtcgtgttcgaggactcctacggtaacctcagcgtgaaagcaatgcgaaacatcctcccgcatctgcaagcaggcttagactacagccaagcctgtgaaaaagcaggatataaacacagcaggaggtcactcaccaagaacgagcttgataagaaagagtacaaagagaaactggaactactaccgaagtctagcctacacaatccggtcgtagagaaaatcctaaaccaaatgatcaacgtgatcaacgccgtcattgacgaatacggaaaacccgacgaaatacgcatagaactagcccgcgagctaaaaatcggggccgccgagcgggaaaacatgacaagatcaataaatcagggaaacgcagaaaacaaacggattcgcgaaatactcgaaaaggagttcgctctcagctacatcagtcgaaacgacatcataaaatataaactttacgaagaactcaaatccaacgggttcaaaaccctatactccgacacctacataagtaaggacaagctattcagcaaagacttcgacatagaacacatcatcccaaaagcgcgactcttcgacgacagcctctccaacaaaactatagaggcacgggacgtaaacatcgcaaaaagcaataagacagcgtttgatttcatctcagaaaagtacgatcaacaaggaatcgaagcatacaagaagaaactcgacatactcctacaagacgggtctatctctaaagctaaatacaaccgccttctaatgaaggaggccgatattccaagcgggttcatcgacagggatctccgagacacacaatacatcgcgaagaaagcctacgagatcctcagcgatctcgtgagaaacgtcacgccgaccaccggggccgtcacctctcgacttcgagaagactggcagctagtagacgtcatgaaagaactcaacttcgaaaaataccaaaaactagggctagtagaggtcatagaagaccgagacggccgaaagataaaacgaatcaaagattggacaaagcgcaacgaccacagacaccacgcaatggacgccctcacgatcgccttcactaaaccgtcctacattcaatacctcaacaatctaaacgcacgctccgataagaatagctcgatatacggaatagaaaacaaagaactccaccgagaggacaacaaactacgattcaacgcacccctccccatcaacgagttcagagccgaagcccgccgccatctgaaaagcatactcgttagcgtcaaagccaaaaacaaggtaatgactcaaaacgtcaacgtcataaaaaccaaacacggggtcatcaaaaaggtccaactgacgccccgcggcgaactgcacaacgccacattttacggaaccaaaaagcgccccatcatcaaaatggtcaaggtcggcgcagcactcgacgaagtcacaattaaaaaggtcagcagctcctttatccgggaagcgctcctagaccgacttcacgaatacaacggggacgccaaaaaggccttcacgggccggaactcgatagataaaaatccaatatacatcgacgaagaacacaaaaagaccgtgccggctctagtcaagacgatagaatgggaaatgtaccacccaacgcggaaaatgatctcacccgacctcaagatcgataaagtaattgacaagggaattagggagatactacgaacccgactagcgaaattcaacggagacgcgcaaaaagcattcagcaacctcgacgaaaaccctatttacaaagacgaagcaaagaagatcacactgaaacgagtatcactagaaggagtaagcagcgtcatcccacttcacaaactaaaggacatgggaggaaaaccggtagttggcaaagatggcaagccagtctggggagactacgtacagacaagcaacaaccaccacatcgcgttctacatggacgagaacggcaacctgcaagatgacgtagtaaccttcttcaaagcagcaaggcgaaaaagccagggggtcccggtcatagacaaaaattacaaccatgacaaaggctggcacttcctgttcaccatgaaacaaaacgagtacttcgtatttcccaacgaagccaccgggttcatccccacggaggtagacctcatggatgaagccaactacgacatgatatcccccaacttataccgagtgcaaaagatgtccaagacgaagcaggggatcacggacaaaagggactactggttcagacaccacctcgagacagtgctaaacaacgacctcaaggtgagaaattccatattcaaacagatcaacagtctcaaacccctcgagggaatagtcaaggtgagaatcaatgctataggaaaaatcgtcgcaatcggcgaatacgactga

SEQ ID NO: 6686 - RNA, 4143 nt, synthetic construct
  misc_feature 1..4143: note = Cas9 variant
  source 1..4143: mol_type = other RNA
atgaaacgcattctaggcctggacctgggcacgacatctatcggctgggccttggtgaacgaagccgaatctaacaacgaggcaagcagcatcgtccgactcggggtccgagtcaacccccttacagttgatgaaaaatccaacttcgaaaaaggcaaggcaatcacaacaaacgcagacagacaattgaggcatggagccagaatcaacctgcaaaggtacaaactccgacgtcagaacctccacgactgcctacagaaacaaggctggctcgggacggaagcaatgtacgaggagggcaaagcaagtacattcgaaacctacaaactacgagccaaggccgctgaagaagaaataagcctccacgagttcgcccgggtcctattcatgctcaacaagaagagaggatacaaaagcaaccgcaaagccaacaacaaagaggacggacagctgttcgatggcatgacaatagccaagaaactatacgaggaacacctgactccagcagaatactcactacagctcctgaacaagggtaagaaatttacccagggctactaccgcagcgacctcaacgctgaactggaacgcatatgggacgaacagaaaaagtactacccggaaatcctcactgacgagttcaaacaacaactagaaggaaagaccaagacgaacacatcaaagatcttcctggcgaaatacggaatctactccgccgacctaaaggggcttgaccgcaagctccagccactgaaatggcgcgtagaagcactcaaacaacaggtggacaaagaagtgttagcatttgttataagcgacttaaagggccaaattgcaaacacatccggcctgctgggcgcgatatccgaccgcagcaaagaactttacttcaataaacaaacagtgggacagtacctctgggcctccctagaagagaacccgcatatatcaatcaagaataaacccttctaccgccaggactacttagacgaatttgaaaagatatgggagactcaggccacgttccacaagcaactgacccccgaacttaagcaagagatcagggatataatcatattttaccaacggccactcaaaagcaagaaaagccttatctccgtatgcgaactagaacaaaggaaagtaaaggcaaccatcgacggaaaagagaaagaaatcaccatcggcccgaaagttgctccaaaatcaagccctgtgttccaggagttccgcatctggcagaacctaaacaacgtactcctcatagacaacgacaccaacgaaaaacggcccctagacgaagacgaacgctacctcctttacaaagagctgtccatcaaagcgaaattatccaaaacggaagctcttaagatcctgaacaagaaaggcaaacagtgggacttgaactacaaagagctagaaggaaacaggactcaagccatactattcgactgctacaaccgcattatcaccctcactggccacgaagaatgcgacttcaagaaaatcaaagcctcggagatccgccactacgtatccacgatcttcaaaaacctggggttcagcaccgaaatcctggacttcgacccaagcctcgaaaaacacgagctagaaaagcaacccatgtaccaactctggcaccttctatactcctatgagagcgataactcacgtacaggcaacgaatctttactccgcaaactcgaaaccacattcggattccccgaagaatatgccacggtactctgcgatgtggtgttcgaagaggattatggaaacctatcagttaaggccatgcgaaaaatcctcccctacctccaggcgggcaacgactactcacaagcatgcgcctacgcgggatacaatcactcgcggcactcactaaccaaggaggaactagaccagaaagtttacaaagaaagactagagctcctcccgaagaactccctacgaaacccagtcgtagagaaaatattgaaccagatgataaacgtgatcaacgccatcatcgacgaatacggtaaacctgacgaaataagaatcgaaatggcccgtgaactcaaaagcagcgccgcagatcggaagaaaaccacacatgcaatcaaccagggaaacgacgaaaaccaatgcatccgcgaaatcttagaaaaagagttcgccctcagttacatctcgcggaacgacataattaaatacaaactctacgaggaactcaaacctaacgggttcaaaaccctctactcggatacctacatacccaaagataaactcttcagcaaagacttcgacatcgaacacatcattccgaaagcccgcctattcgacgattcctactcgaacaaaactttggaggcccgagacataaatctagcaaaatcaaacaagacagccttcgacttcgttaaagaaaaatacggcgagcaaggcgccgaagcctacaagaagaaacttgacatgctgctcgggaacaacgtcatctccaaaccgaaatacaacaaactgctcatgaccgaggccgacatcccgagtgactttataaaccgagacctaagaaacacacaatacatagcccgcaaggcgtgcgaaattctaggagaactcgtccgtacagtcacacccaccaccggtaagatcactaatagactccgcgaagactggcaactcgtagacgtaatgaaggaactcaacttcgagaaatacgaaaaactgggtctcaccgaaatcgtcgaagaccgcgacggccgcaaaatcaagcgcataaaagactggactaagcgcaatgatcaccggcaccacgcaatggatgcactagccatcgccttcacaaaaccctcatatatccaatacctgaacaacctaaatgcccggtcaaacaagggtgactcaatctacgctatcgagaacaaagaactacactacgaagagggaaaactccgctttaacgcgcccatccccgtgaacgtattccgtgccgaagcaaagcgccacctgtcagcgatccttgtctccatcaaagcaaagaacaaggtgatgacccagaacgtaaacaaaattaagacaaaacacgggatcatcaagaaaattcagctcacccctcggggccccctccacaacgaaacaatctacggcaccaaaatgcggccaatcatcaagaaagtcaaagttggtgcagctctagacgaggcaacaattaacaaagtctcctcgcccgcaatccgcgaagtactcctaaaacggctaaacgaatattcaggaaatgcgaaaaaggcattcacgggcaaaaacacgctcgataaaaaccccatctatctgaacgccgaacgcaccaagactgtgcccgcctcagtaaaaaccgtcgaatgggaaaactaccatccaatcagaaaacccataaccccagatctcaaagtggataaggtaatagataagggaataggagaaattctgaaggcgcgcctcgaggagttcaacggggacgccaagaaagcattctcgaacctagaagaaaaccctatatatctcgaccagacaaagaaaatcgccctcaaacgagtctccatcgaaggggtcctttcaacgatacccttacataccctgaaaaaccaagcagggaaaccaataatgggcaaagatggcaaaccagtcctagggaactatgtacaaacctccaataatcaccacatcgcgttctactacgacgaggacggaaacctccaagacaacgccgtatcattcttcgaggccgctgaacgtaaatcacaaggcatcagcgtaatcgacaaagactacaaccgagacaaaggatggcgcttcctctttacaatgaaacaaaatgaatacttcgtattcccaaacgaggccacaggcttcatacctagcgaggtagacctgacagacgaagccaactatggcatcataagcccgaacctgtaccgcgtccagaagatgtccaggatagagaagggcacgagcgtctcgagagactactggttccgacaccacttggaaaccatactaaacgatgacagccgcctcaagaactccgcctttaaacgcattaattctctcaaacccctggagggcatcatcaaagtgcgtatcaactccatcgggaaaatcgtagcggttggcgaatacgactga

SEQ ID NO: 6687 - RNA, 4143 nt, synthetic construct
  misc_feature 1..4143: note = Cas9 variant
  source 1..4143: mol_type = other RNA
atgaaaaaggggtactcaatcgggcttgacataggaacaaattccgtaggattcgccgtcataaccgacgactacaaagtcccctccaagaaaatgaaagtcctcgggaacacggataaacgcttcatcaaaaagaatctcataggggcccttctattcgacgaaggaacaacagcagaagcgaggcgtctcaaacgcacagcaagacgacgatacacacgtaggaagaaccggctaaggtacctccaggaaatcttttcagaagaaatgagcaaagtcgacagctcctttttccaccgtctcgacgactcatttctaatacccgaagacaaacgggaatccaaatacccaatctttgccaccctcgaagaggaaaaagaataccataaaaagttcccaaccatctatcacctccgcaaacacctagccgactccaaggaaaaagcagacctgagactaatatacctagccctggcacacatgataaaataccgaggccacttcctatacgaagacacgttcgacatcaaaaacaacgacatacagaaaatcttcaacgagttcatatccatatacgacaacgcctttgagggctcatcactttctggccaaaacgcgcaagtagaagcaatatttaccgacaaaatctccaaaagcgccaagagagagcgcgtactcaaactcttccccgacgagaaatccacggggctattctccgagttcctcaaactgatcgtcggcaaccaagccgattttaagaagcacttcgacctggaagacaaagcaccccttcaattctcgaaggacacttacgacgaagacctcgaaaacctcctcggccaaataggggacgattttgcggatctattcgtagctgctaagaaactatacgacgccattctgctttcgggtatactgaccgtcaccgacccctcaacaaaagcacccctatccgcatcaatgatcgaacggtacgaaaaccaccaaaatgacctcgtcgtattgaaacaattcataaagaacaacctcccagagaattacgtcgaagtcttctccgacgacagcaaaaacggatacgcaggatatgtaggcgtcgactcaaagatccgaaaacgcaatgcgaaactagccaccgaggaagagttctacaaatacctcaaaaatatactcaacaacgtaaaaggcgcagactacttcctcgacaaaatcgagcgcgaagactttctccgcaaacaacgcacctttgacaacggctccatcccacaccaaatacacctacaagaaatgaacgcgattctgcgccggcaaggggagcactaccccttcttgaaagaaaaccgagagaaaatcgagaaaatcctcaccttccgtataccatactacgtcggccctcttgcacgcggcaaccgggacttcgcatggctgacgcggaactctgaccaagccatacgcccatggaacttcgaggaaatcgtagacaaagcctcctctgcagaggacttcataaacaagatgaccaactacgatctctacctaccagaggagaaggtactcccaaagcatagtctactgtacgaaaaattcgccgtatacaacgaactcacgaaggttaaattcatcgccgaaggcttgcgggactatcaattcctggactcaggacagaagaagcagatcgtgaatcaattattcaaagagaaaagaaaagtgacggaaaaagacatcatccactacttgcacaccgtagacggctacgatgggatcgagctcaaaggcattgagaaacaattcaacgcaagcctctctacctatcacgatctactgaaaatcatcaaggacaaagagttcatggatgaccccaagaacgaagaaatcctagaaaacatcgtccataccctgaccatatttgaagaccgcgagatgataaagcaaaggctcgctcaatacgactccctcttcgacgaaaaagtcatcaagtcactcacccgacgacactacacgggctgggggaaactaagcgcgatgctaatcaacgggatcagagacaaacaaaccggcaagactatcctcgactacctcatagacgacgcatactacaaccgcaattttatgcaactaatcaacgacgacggactgagcttcaaagaaatcatacaaaaagcacaagtggtaggcaaaaccgacgacgtcaaacaagtcgtacaagagctacccggcagccccgcaatcaagaaaggtatcttacaatcgataaaaatcgtcgacgaactcgtaaaaatcatgaggcacaatccagaatccatagttatcgaaatggcccgagaaaaccaaacaacagcccgaggaaagaaaaactcacaacaacggtacaaacgaatcgaagacgccctcaaaaacctagcccccgggctagacagcaatatcctaaaagaacacccgaccgataacgtccagctccaaaatgaccgtctcttcctttactacctacagaacggcaaagatatgtatacgggcgaagcactggatatcaaccagctctcatcttacgacatagaccacataataccacaagccttcataaaagatgacagcttcgacaaccgggtactcacatcatccaaagacaaccggggcaaaagcgacaacgtcccatccatagaggtcgtccagaaaaggaaggccttctggcaacagctgctagacagcaagctaatctcggaacgcaaattcaataacttaaccaaagcggaacgcgggggcctcgacgagcgagacaaagtcggcttcattaaacgccagttagttgagaccagacaaattaccaaacacgttgcacaaatcctagacgcccggtacaatacggaagtgaatgaaaaagacaagaaaaataggactgttaaaatcataacactaaaaagcaaccttgtctcaaacttccgaaaggagtttcgcctatataaagtacgggagatcaatgactaccaccacgcccacgacgcatacctcaacgcagtcgtagctaaggccatactaaagaaataccccaaactcgagccagagttcgtatatggagaataccagaaatacgatctgaagcgatacatctcgaggagcaaagaccccaaggaagtcgagaaagcaacggagaaatacttcttctacagcaatcttctcaatttctttaaggaagaagtgcactacgccgacggcaccatagtaaagagggagaacatcgagtactctaaagacacgggagaaatcgcatggaacaaggagaaggatttcgccatcatcaagaaagtactatccctcccccaggtcaacatcgtgaagaaacgtgaagtacaaaccggaggcttctccaaagaaagcattcttcccaaaggcaactcagacaaactaatcccgcgaaaaaccaaagacatcctatgggacaccaccaaatacggcggctttgactcaccagtcatcgcatactcaatcctgctcattgccgacatcgagaaaggaaaggccaagaaactaaaaactgtaaaaaccctcgtcggaattaccattatggagaaggcggcgttcgaagacaatccaataacttttctggaaaacaaaggttatcataacgtccgaaaagagaacatactatgtcttcccaaatatagcctattcgaactggaaaatgggcgacgccggctacttgcaagcgccaaggagctccagaaaggcaacgaaatcgttctccccgtttacctaactacgctcctctatcactccaagaacgtccacaaactagatgaacccggacacctggaatacatacaaaagcaccggaacgagttcaaagacttgctaaacctcgtgtccgagttctcgcaaaaatacgtcctcgcagacgccaacctagagaaaatcaaatccctctacgccgacaacgaacaggccgacatcgaaatcctcgccaattcgttcattaacctcctaaccttcacagccctcggagcccccgcggcattcaaatttttcggcaaggacatcgaccggaagcgctacaccacagtcagcgaaatcttaaacgcaactctaatacaccagtccatcaccgggctatacgaaacaagaatcgacctatccaagctgggcgaagactga

SEQ ID NO: 6688 - RNA, 4143 nt, synthetic construct
  misc_feature 1..4143: note = Cas9 variant
  source 1..4143: mol_type = other RNA
atgaacctcagacatgttggcaactacaacataggcctagacatgggcacagcaagcgtgggctgggcagccatcgacgaacaaggcgagctgcttcacttcaaaggcaaaccaacgtggggcagccggctattcgactccgcaaacaccgccgcaactgcaagaatgcctcggggccaacgtcggagatacatccgacgcagatggcgactagacctcttacaaaagttcttcagcgaggaaatggcggaaaaggacccggagttcttcatccgtctacggcaatccagcctgtggcctgaggaccgcgagggcggacacacagcgtaccactggccactatttaatgactcggactttaacgaaaaagagtactacgaaaaatttccaacaatattccaccttaggcaatggctaatggaaactgacgaaaaggcggacatacgcctaatctacttggccttccacaacatagtaaaacacaggggcaactttctacaagagaacaacgacagcctttccgcacaaaacgcgaacatgcgggagagcctagagtcattctgcatagcgctagaagaatggtgcgacgaaaaagagctgacgtgcagctgcgacccccagaagttggaacatctctttaaggaggtaaaataccgctcggacatccgcgacggcttcgcagcactgctaggtctcgcgtgctccggcgaaaacgaagtagacgtgaaggcgatggcgaaagaaatgggcaaagccatagtcggttacaaagcggacttcagcaagatcttcaccgagtgcgacaaggaaggatccagcttccgcctatcagacgacgagggccctgaagcgttcctagacatatgcccagacgacggaatagccctgttcgaagccatacagatggtctacagctcattcatccttaccggaatgctaacggaaaaaggtctaagcctgagcaaaataagcgcctacaaccaatacggacaggacctcgaaagcctcaaagccctagtaaaagagtacgtacccaacgaatatagctcatttttcaggggtccaacatactcaggaagcacagaatacgacccctcaaaagcgcaaggctacacgcgctacaacctcggcccatccaagaaaggctcaggcgcgaagccaatggcatacgaggacttcaagaaatcagtcgaacagctgttcgcaaacactaacgcaatcaatgacgagcggtacaaagaaatgatgggacgattcgcggaagagaaatttctccgacgactacgtactagcgacaacggacgcatacccttccaactaaacctcgaggaaatgacagccataatcatcaaccagggcaagtactacccctttttactggaacaacaagaaaaactggaaagcctcgtacgattccgtataccttactacgtgggtcccctcacgcgaatcaacgcgcggctcgattcgaaaggtaacgcatgcttcgcctggagcaaaaggaaagatggaatggactctgcgagcatcaaaccgtggaactgggacgaagtcatcgacaagcacgcatccgctcaggctttcatagagcgtatgaccggaacctgcacctacctgcgaggcgaacccgttctcccgcgatgttccctactttacgaagaatactgcgtcctgaacgaactcaatggagcccgctggacacaggacggtgacaaattcatacgattcgactacaaagaccgctcagacataatcgaagaactcttcaagaaacgacgagggcggatccaatacgccgcagtggccgactggatgaagcaagaaagatcacacgccaacgtccatgttagtgggggacagggcgaaaatgcgttcgagagccgactgtctagctaccacttcttctgcaacgacgtcttcggagtagacgaacttccgggatcgtacgtggatatggtcgaagaaataattctgtggtcgaccctgttcgaagaccgcagcatcctaagggaagaaatccaacgtaagtacggggatgttctcaacgaagaacagatcaaaacaatctgcaagaaacgattcagtgggtgggggcgacttagccgcaaacttttatgcagcctcaaagcccagaccgacaacggccccaaaagcatcatggacatactccaagaaggcgaccaaaacaacggacgcgtgggccgagcaatggtcttccaagagattctccatgacgaacaactcggcttcgaacagaaaatcgaggaggaaaacacccaatcgatgctggaaggggaaaacctactaatagaagacctacctggcagccctgcgatccgccgatcgataaatcaagcagttagaatcgtcgacgagatagtagggatcgccggacacgcgcccgataacatattcatagaggtaactagggaggacgacaccaaaaagaaaggcaaacgaaccacaaccagatactcgaatatccagaaagcactggaagcgctgaaagaagagggcgcggaagccctcagagaactcaaaacatacaaacacaacgagctcgataagcgcctgtcactatacttcatgcagaacggcaaatcgctctactcaggaataccattagatatacggagattatccgagtaccagatagaccacataataccgcaatcgtatatcaaagacgacagctacgaaaacatggccctagtgctacccggcgaaaaccaatcgaaagcagacaacctactaatctcacaagacatccggatcaagatgaaagcaacttggacggcacttcacaaagcaggattgatgggcgataagaaatacaacaacctgatgaactcaagtatctcagatgcaaaaatgaaaggcttcatcaaccggcagctcgtggaaacctcgcagagcgtcaaactaacacaaatgatgctcagtcagaaatatccaggcgccaaggtccgacccatcaaggcctcaatatcatcccaactacgcgacgcatgcgacctagtaaaatgtcgggaagccaacgactaccaccacgcacacgacgcataccttgcatgccaagtcggaagattcgtactgaaacggcattcaagcatgttcgacaacccaataggaatgacaaaagtaatccgcgacttcgtgaaacggcaaggtcaggagttcaagagaaacggtaaacttccagcctacgcgagcagatcaggtttcatagtccagagcttcatgcgatcgggattcgacgcagaaacaggggaactactccgagacgactggaacgcaccctttgaaatagcacgtataaaacgatgcctaaactacagagattgctacatatcccgtatgccaatggaggactcaggagcgttctgggacgccacgatatactccccgaaagccggcaagaaaggagccctcccagtgaaacaggggctccccgtggagaagtacggctcctactccagagaacaatttgcgtacttcttcgtttacaaggcctacaacccaaagaagaaagcctaccgcctggagttcgaagcggtgcccgtccgcgtagcaagcgcggtcgaaacacgcgaaaacgccctagaagagtatgcaaaatctgtggcaaaacaagcaggcttggagttcgtcgaagtcgcccgcccgaaagtatacaaatatcaactgatagaactaggggaagaccgcctgtatatcaccgggaagcgcgaagtaagaaacgcaagtcaactggccttctcgctcgacgaaatagacctacttaaacggctagccgagggcgaagagacaagctctgaggagcgcgaacgcctattcgacgtactaatagagaaatacgcgagatacgcaccacgactcgcccgacaactctccgtcgacagcatgtcagcgacatttgaaacactcaacgccgaagaacagctaggcatactattatccctcgtggaaatagctaatggaaaacgcaacatgatagacctctcgtccgccggcggcagcaaaaatgcggggtgcatgaacccaacattttcatcggagctatcaagcccaggaagtaatttcacattcatagaccagagcgtgaccggtatgttcgagagacgacaacgcctggaactctga

SEQ ID NO: 6689 - RNA, 4146 nt, synthetic construct
  misc_feature 1..4146: note = Cas9 variant
  source 1..4146: mol_type = other RNA
atggtaaagaaaaagtatgccatcggaatagatataggaaccaactctgtcggctggtccatagtcaccgacgactacaaagtaccctccaagaaaatgaaagtgttcggcaacaccgaaaaacgctacataaagaaaaacctactaggaacgttactcttcgacgagggcaacaccgccgagaaccggcgcctgaaaagaaccgcacgccgacggtatacacgccgacgcaaccgcattctctacctccaagagattttcgccgaagaaataaacaaaatagacgactctttcttccaacgcctggacgactccttcctaatcgttgaagataaacagggctccaaacacccaatattcggcacccttcaggaagagaaagaataccacaagcaattccccaccatatatcacctacggaaacaactcgccgacagcagccaaaaggcggacatacgcctcatctacctcgcccttgcacatatcataaagtaccgagggcacttcttattcgagggagacctaaagtcagaaaacaaggacgtccaacacctattcaatgacttcgtggagatgttcgacaaaactgtcgaggggtcctacctaagcgaaaatctcccaaacgtcgcagatgtcctagtagaaaaagtctccaaaagccggcggttagagaacatccttcactacttcccaaacgaaaagaaaaatggcctcttcggaaactttctcgccctagcactgggactgcagcccaacttcaaaaccaatttcgagttagcagaagacgccaaaatacaatttagcaaagagacctacgaagaagacctggaggaactccttggtaaaatcggagacgactacgctgacctcttcatcgcaacaaaatccctgtacgacgggatcctcctcgctggcatcctatccaccaccgacagcaccaccaaagcgcctctatcctcatccatggttaacagatatgaggaacaccaaaaggacctcgcgctactgaagaacttcatccaccaaaacctaagcgacagttacaaagaagtcttcaatgacaagttaaaagacggatacgcaggctacatcgaagggaaaaccactcaagagaacttctaccgcttcatcaaaaaggcaatagaaaagatcgagggttccaattacttcatagacaaaatcgaccgcgaggacttccttagaaagcagcgaacatttgacaacggctcaataccccaccaaatccatctgcaggagatgcacgcaattattcgaagacaagccgagttctaccccttcctcgttgaaaaccaagacaaaatcgaaaagatcctcacgttccggattccatactatgtaggcccactcgctcgagggaaatcggaatttgcctggctgaacaggaaaagcgatgagaaaatccggccctggaactttgacgaaatggtcgacaaagaaacgagcgccgaaaacttcatcacccgcatgacgaactacgatcgctacctgccggaccagaaggtactcccaaaacacagcctcctatacgaaaaattcgcggtatacaacgaactcacaaaggtgaaattcattgccgaaggcatgcgcgactaccaatttctagactccggacaaaagaaagacattgtcaaaaccctcttcaaaaccaaaagaaaggtcaccgccaaagacattaaagcataccttgaaaatagcaacggatatgccggtgtagagctaaaaggcttagaggaacaattcaacgccagcctgcccacgtaccacgacctcctcaaaatactccgagacaaagcattcatcgatgcggaagagaatcaagaaatactcgaagacattgtccttaccctgaccctgttcgaagatcgggaaatgatacggaaacgactcgagaagtacaaagacatattaacagaggaacagaggaagaaactcgagcgacggcactacacgggctggggtcgcctgtcggcgaaactcataaacggcatactcgacaaggtcacacgcaagaccatactgggatatttaatcgacgacggcacttccaaccggaacttcatgcaactgatcaacgacgacacactctcttttgttgacgaaatacgcctcgcacaaggctcaggcgaagctgaggactaccgtgccgaagtccaaaacttagccggatccccagcgattaagaaaggaatcctccagagcttaaaaatagtagacgaactcatcgaagtaatgggctatgagccagagcacatcgttgtagagatggcacgcgagaaccaattcaccaaccaaggccggcgcaactcccaacaacgtatcaaccgactcgaaaatgccctcaaagacttcggcagcaaaatcctcgaggaacaaaaaccctacggggtttccaaagtaaataacatacacctacaatcagacagactgttcctctactacctgcaaaacggcaaagacatgtacaccgacgaggaactcgacatagaccacctcagcgaatacgacatcgaccatatcataccccaagccttcatcaaagacgactccctcgataacaaagtattaacaaagtcggcgaaaaatcgaggaaaaagcgacgacgtccccagcatggaaattgtccacaaccgcaaaaacttctggcgtcaactgctcaagagcaaactcatatcacaacgcaaattcgacaaccttacgaaggcagaacgcggaggcctaaccaacgaggacaaggcccgctttatccaacgccaactggtggaaaccaggcaaataactaaacacgtggcccgtatgcttgacacacgattcaatacaaaactggacgaggcgggaaatcgaatccgcgatcccaaagtaaacatcatcacactaaaatcaaatctagtcagccaattccgaaaagactatcagctctacaaaatccgcgaaatcaacaactaccaccacgcacacgacgcctacatcaacgccgttgtcgctaccgccctactcaagaaataccctcaactcgcacccgaatttgtatacggcgaataccccacttacaactcgtacaacagccgcaaatccgcaaccgaaaaagtcctcttctactctaacatcatgaacttcttcaagcgcatagtcgtacactcgaaaaccggcgaagtccgtatacggcccgtaatagaggtcaacaaagagactggcgagatcgtctgggacaaaaagagcgactttcgaacggtacgaaaagtcctcagctacccacaagtaaacgtggtcaaaaagacagaggtccaaaaccacgggctagatcgtggaaagccaaagggcttctacaacgccaacctttcaccacggcccaaagaaggatcagtcgagaacctcgtccccgccaaacaatccttcgacaccaaacggtacggcggctatgcaggaatcagcaactcgtacgctgtgctcgtaaacggcatcatagaaaagggcaaaaagaaatccaaagccgaggtaacagagttccaaggaatcagcatcctcgctcgaaaagacttcgacaaaaatccgaaacaatacctactcaacctcggatataaagacataaaatccataataaaacttcccaaatactctctattcgaactagaaaacggctcccgccgaatgctggcgtctatcctatccacaaacaacaagcgcggcgaaatccataaaggcaatgaaatgtacctcccagacaaattcgtaacgctcctataccacgccatgagagtcaacagaaccctggaaccgggacacaagaaatacgtcgaaacacacaggcacgtgttcgatgaactccttatttacatccttgaatacaacgagaaaatagtcggcgctaaggcgaacggaaaacgtatcgtcgaagcctactccgcccgcaaagacaccgacaacctagaggaactctgcaactccttcatcaacctgctcaatctaacagccctaggctctgccgtcgacttcgagttcttaggaacaaaaattccccgataccgtgactacaccccctccagcctcctgaaggcaacactcatccaccaaagcgtgacaggcctatatgaaacacgcatcgacctcagcaagttaggcggagactga

SEQ ID NO: 6690 - RNA, 4146 nt, synthetic construct
  misc_feature 1..4146: note = Cas9 variant
  source 1..4146: mol_type = other RNA
atgaactacgtaaaggaataccacattggccttgacatcggaacctcctccataggatgggcggtaacggacagccaattcaagctaatgcggattaaaggcaagactgcaatcggagtccgcctcttcgaggaggggaagacagcagccgaacgccgcaccttccggaccacccggcgaagactaaaacgacggaaatggcgcttacattacctagacgagatattcgcaccgcatctgcaagaggtcgacgagaactttctcagacgactgaaacagagcaacatacacccagaagatcccgccaaaaaccaggctttcattggaaaactactcttcccggacctactaaagaagaacgagcgagggtacccgacgctaataaaaatgcgagacgaactaccagtagaacaacgggcccactatccagtcacaaacatctacaaattacgagaagcaatgataaacgaggaccgacaattcgacctccgagaggtatatctcgcagtgcaccacatcgtcaaatacagaggccactttctaaacaacgcatcagtagacaaattcaaggtaggccgtatagacttcgacaaatcctttaatgtcctaaacgaggcctatgaggagctacaaaacggcgaaggatccttcaccattgagccgtccaaggttgagaaaataggacaactgctactcgacaccaagatgcgtaaactcgaccgccagaaagccgtggccaaattcctcgaagtcaaggtcgccgacaaagaagaaacaaaacgcaacaagcaaattgcaacagccatcagcaaacttgtgctagggtacaaggcggatttcgccaccgtagcaatggcaaacggcaacgaatggaaaatagacctcagctcagaaacctcagaggatgaaatagagaaattccgagaggaactgagcgacgcgcaaaacgatatactgacggaaatcacgagcctattcagccaaattatgctcaatgagatagtgcccaacggaatgtcgataagcgagagcatgatggaccgatactggactcacgaacgccaactggccgaagttaaggaatacctagcaacccaacccgcatccgccaggaaagagttcgaccaagtatacaacaaatacataggacaagcgcccaaagaaaaaggtttcgacttagaaaagggactgaagaaaatcctatccaagaaagagaactggaaggagatagacgaactgctaaaagccggagacttcctacccaaacaacgcaccagcgcgaacgtcgtcatacctcaccaaatgcaccagcaggaactggacagaatcatcgagaaacaggcaaaatattatccttggcttgccaccgaaaaccctgcaacaggagagcgagaccgacaccaggcgaagtacgaactcgaccaactcgtcagcttccgtatcccctactatgtaggcccgctcgtaacccccgaggtccaaaaagcaacatcgggggcgaaattcgcgtgggccaaaagaaaagaggacggcgaaataacaccctggaatttatgggacaagatagaccgggcggaatctgccgaagcattcattaaacgcatgaccgtgaaagacacatacttactgaacgaagacgtcctcccagcaaactcactcctttaccaaaaatacaatgtcctaaacgaactcaacaacgtccgcgtcaacggacgacgactatcagtgggtatcaaacaagacatctacagcgaattatttaaaaagaagaaaaccgtgaaagccagcgacgtcgcaagcctagtgatggcaaaaacccgcggtgtaaacaaacccagtgtcgagggtctatccgaccccaaaaagtttaacagcaatttagcaacatacctagacctcaagtcaatagtaggagacaaagtagacgacaactgctatcaaaccgaccttgagaacataatcgagtggcgcagcgtcttcgaagatggggaaatcttcgccgacaaacttacagaagtggagtggctgacagacgaacaacgcagcgccctcgtcaagaagcgctataaggggtggggaagacttagcaagaagctactgaccgggatagtcgatgaaaacggccagcgaatcatagaccttatgtggaacaccgaccaaaacttcatgcagatcgttaaccaaccggtcttcaaagagcaaatagaccaactaaaccagaacgcgatcactaacgacggcatgaccctccgagaaagagtggaatccgtactggacgacgcctacacctccccgcagaacaagaaagccatctggcaggtagtacgtgtggtggaagacatcgtaaaagccgtaggcaacgcacctaaaagcatctccatagagttcgcgcgaaatgaagggaacaaaggagaaattacacgatcaaggcgaacgcaacttcaaaaactattcgaagaccaagcacacgaactggtaaaagacacctcgctaacagaggaactggagaaggcactagacctctcggaccgctattacctatacttcacccaaggcggtaaagacatgtacaccggagacccaataaacttcgacgaaatatctacgaaatacgacatagatcacatcctgcctcagagctttgtcaaagacgacagcctcgacaaccgcgtcctagtcagtcgagccgaaaacaacaagaaaagcgaccgagtgcctgccaaactctacgccgccaaaatgaaaccatactggaatcaactcctaaaacaagggctcatcacacaacgcaaatttgaaaacctcaccatggacgtagaccaaaacatcaagtaccgcagccttggattcgtaaagaggcaactcgtagagacccgacaagtgatcaaactgaccgcgaacatcctgggctctatgtatcaagaggccggcacagacatcatcgaaacgagagccggattgacaaagcaattacgcgaagagttcgacctcccgaaggtccgcgaagtgaacgattaccaccacgccgttgacgcatatctcaccaccttcgccgggcagtatctcaaccgacgctatcccaagctaaggtctttcttcgtatatggagaatacatgaaattcaaaagagggtccgacctgaagctcagaaatttcaactttttccacgagctgatggagggagacaagtcacagggcaaggtggtagaccaacaaaccggcgaactaataaccacccgagacgaagtggcaaagagtttcgatcgactcctcaatatgaagtatatgctggtcagtaaagaagtacacgatcgaagcgaccaactatacggggctacaatagtaaccgcaaaagaaagcggcaaacttacatcccccatcgagatcaagaagaaccgcccagtcgacctatacggagcttacactaacggcactagcgcctttatgaccataatcaagttcacaggaaacaaacccaaatacaaagtaatcggagtcccaacaacatcagcagtaggtcttaagcgagtcggaaaaccgggatcggagtcctacaaccaagaactacaccgaatcatcaaaagtaaccccaaggttaagaaagacttcgaaatcgtcgtgccacacgtatcctactcgcaactcatcgtcgacggcgactgcaaattcacgctcgcgagcgacacataccagcaccctgcgactcagctagtcctgagcaaagaaagcatggagattatcgccgacgactttaaattcgtgaaggaaaaccccgcaacagccgacgaacaactcgtcagggttttcgacgagatcgtcaaccaaatgaatcactacttcacaatcttcgaccaacgctcaaacagacaaaaagttacgaaagccagagacaaatttgtgtccctaccaacagaatcagaatatgagggagccaagaaaacgcaagtcgggaaaacagaagtaatcaccaacctactcatggggctacacgcaaatgccgcacaaggagacttgaaagtcctgggactatcaacgtttggctttttccaatcatctggaggactcaacctgagcgaagacgcaatgatagtctaccaatccccgaccgggctctttgaacggcggatatgcctgaaagacatctga
